United States Patent 12,227,810 (METHODS AND COMPOSITIONS FOR DETECTING ESOPHAGEAL NEOPLASIAS AND/OR METAPLASIAS IN THE ESOPHAGUS) - sequence listing, part 3

SEQ ID NO: 9840 - DNA, 201 bp, Homo sapiens
  source 1..201: mol_type = unassigned DNA
cgccctcccgccttcccggtacctgcctacccccgcaactgtcccggcccccaacacctgcatcgcccaaccccttccccccccgccccctgccttccccgcacctgcccggagtcccagcacctgccccgccccccgctatccccctccttgctggcctgatggggtgtgggcccaagggagccacacttgggcggaggc

SEQ ID NO: 9841 - DNA, 201 bp, Homo sapiens
  source 1..201: mol_type = unassigned DNA
ccccggtctgacggaacacaggcgacgcacgtgaagtccaggccctatcccagcgcaggcgggcctccagcgacccacagttgtcacatatccggccagcgccgactcccgaaggcgcactccccatactccactccgagcaccggtcccatcgttagggaaggtccccctggatagcaaggccggggcccaggatctgcg

SEQ ID NO: 9842 - DNA, 201 bp, Homo sapiens
  source 1..201: mol_type = unassigned DNA
cggcaaccccctctatcgtcccctgcagcaggcgccgagccgccgccatcttgtcccccgtccctccccccccctcaccgatatttacatagcgaaaatcggcccggccggcctgcggccttcacctcacgcctgcagccttcgcctcctcgccaggcctcaccccggcgcggtgccccaggtcggccgcggagccgaccc

SEQ ID NO: 9843 - DNA, 201 bp, Homo sapiens
  source 1..201: mol_type = unassigned DNA
cgccggcgggcgggaggcacacacgcgcgcacaagcggaaagaaagcgggcttactgcgtggggatgctcgcccgcgcagctgtctcggcggcggcggccgctgcctgcaccgaggccgaggcgcggcggtggcggcggcggctgcggactgagccccctccgccgggcggtggatgtagggcgcgggaggggcgcgaggg

SEQ ID NO: 9844 - DNA, 201 bp, Homo sapiens
  source 1..201: mol_type = unassigned DNA
tctcccgccagcgtcctccgcccgcccgccccttctcggccccgccccgcggggctgctggagaaatcaagtctggggctccccttgtcgagcacggggcgagctccagaaggctctgccgtgatggaaaacttccaggcaaattcctccgggcccgtggcccccaggccgggaagcctccgccacgtgaagggcccccgc

SEQ ID NO: 9845 - DNA, 201 bp, Homo sapiens
  source 1..201: mol_type = unassigned DNA
tctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatt

SEQ ID NO: 9846 - DNA, 301 bp, Homo sapiens
  source 1..301: mol_type = unassigned DNA
gcggatggggccttgattagctgtggatttctgtcccagcgcactcatttaaccgtgtttctcttggttggcagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaa

SEQ ID NO: 9847 - DNA, 223 bp, Homo sapiens
  source 1..223: mol_type = unassigned DNA
ccagagctgcacgtagatgaacacgaagagcagcgcgtagaacacggtgtagacgacggtgaggccaagcttcacgtaggggggcacggccggggtcagcgtgggcggcagcgagtcgttgcgggctgggtcccacggcggggtctccatcgggccgggggcgctgccgcgcggccggggacgctcgggcctcatcggggctcacggccgccgccgcccccgc

SEQ ID NO: 9848 - DNA, 720 bp, Homo sapiens
  source 1..720: mol_type = unassigned DNA
cagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtc

SEQ ID NO: 9849 - DNA, 1683 bp, Homo sapiens
  source 1..1683: mol_type = unassigned DNA
accgagggagggtgcaaaaggcggggggcggagggggggtagatcagattaggcgaaactcaataagctcccagccctccagcccaaagcttccaccatcgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcggcccagtggctcctgcgcgccggagtccgccgcgaagactgagcggccgcggggatcgccgcgggctccgcgcgtattcctgggctcaacactgccacta

SEQ ID NO: 9850 - DNA, 233 bp, Homo sapiens
  source 1..233: mol_type = unassigned DNA
aaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggg

SEQ ID NO: 9851 - DNA, 213 bp, Homo sapiens
  source 1..213: mol_type = unassigned DNA
ccttcccccaaagcaaacagcatcctcccactaccctgcagctgggccccccccactggtccccgctttcccggtggagacggcgacgtggcccacacgcgagcccctcgccgaggatgaatcaccagccagctcgagttgccacactttatctcagtacagttatcgcgagagtcccggggccgcgccggcgtgctctacgcacgcgcagtc

SEQ ID NO: 9852 - DNA, 236 bp, Homo sapiens
  source 1..236: mol_type = unassigned DNA
cgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcc

SEQ ID NO: 9853 - DNA, 233 bp, Homo sapiens
  source 1..233: mol_type = unassigned DNA
ttagctgtggattcccaatacctgcaggtcacaggaccagaggctgggcctctaggagcagaggacacagagcagtgaagacgagacccggagttccagcggcagccaaagacaaagaagcggacaaatcccgccacatcccggaagccgtcctctccgctcaagctgcgtgcctgattggacagttcccagcccagcgtcgctgattggataacgtttaaaaccccaccctc

SEQ ID NO: 9854 - DNA, 737 bp, Homo sapiens
  source 1..737: mol_type = unassigned DNA
ctcgcccgactcaggctccgagttctcccctcgaccctccccagcctaaaggctgtacccgcttcaggccttcccagcccggccctccagttccttcttcggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtggttagtgctattgtttacgacgtcatt

SEQ ID NO: 9855 - DNA, 308 bp, Homo sapiens
  source 1..308: mol_type = unassigned DNA
acagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtgga

SEQ ID NO: 9856 - DNA, 1100 bp, Homo sapiens
  source 1..1100: mol_type = unassigned DNA
tgatgcgtttggtgacttttcctgggttcttgcttaagcggagccacaggttgtgggggcggccaggcctctggggaagagcaggtgccgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccag

SEQ ID NO: 9857 - DNA, 214 bp, Homo sapiens
  source 1..214: mol_type = unassigned DNA
gaagaaataatatattgcagattgtaacgagcacggggagccagcgaaaggcagggcgtccactagggcgcgctgagagaccgggaatccccgcaagggcgcccgcgccgcccgccacccgccgccgcgcgcacgccgcgccctcgcccacctccaaataatatttacagttagggtttttttttttttttttttttttttttttgctctcgcc

SEQ ID NO: 9858 - DNA, 582 bp, Homo sapiens
  source 1..582: mol_type = unassigned DNA
agcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagag

SEQ ID NO: 9859 - DNA, 203 bp, Homo sapiens
  source 1..203: mol_type = unassigned DNA
cctccaggaggcgtcctgaccccgcactccggcctttcacctcccgaccgtcagcctcagggccgccgcggcgacgcgcgaccccttccctctgaggggcgcgggctccggacgcgccgggctctgccaggcatctagtggagggtcggaggtcggcgaccagcccgagcccagccgtcccgggagctggcgcgagtgtcgcc

SEQ ID NO: 9860 - DNA, 823 bp, Homo sapiens
  source 1..823: mol_type = unassigned DNA
caactacttgttccagaccgcgttacctgcaacctgctccgggctggcgccatactcggcgtcccggcgcttctcacaagtgccctcgcccatgaccagcgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcgttggctgcgggctctgggggttccctgctcttcccgggccccgtccctccgcactcttctggcctgactatgactcctgaaggagaatacggataactcg

SEQ ID NO: 9861 - DNA, 293 bp, Homo sapiens
  source 1..293: mol_type = unassigned DNA
ctctgttcctaagggagagggacagcaccctcccgggcttccagctcccttgggtgtggcgggagagttctgggcgaggctgcgcctacacctgcacctcggccggctcctccggctgatttcgctctggttgatttcgcgcacattcctctcccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcgg

SEQ ID NO: 9862 - DNA, 262 bp, Homo sapiens
  source 1..262: mol_type = unassigned DNA
gcggggcatgttggcgcggcccgagggcacggcactggctcggtcccccctccgcgctcggccccggcggccctcagtgcccccggcccattgcccgggcgcggcggctgcgggactcgcgtggcgccggcgacggctcggcccagctctgcgccctgcacgcgcgtccctgtccccgggcccggcagccgctcccttttaacggggggagggggccattgttctcgcctcccgcttcccctggagccaatcagcgcgtccg

SEQ ID NO: 9863 - DNA, 240 bp, Homo sapiens
  source 1..240: mol_type = unassigned DNA
gccttcctcccactgtcctcccgccaccagccgcccctgtcgccgagcccgcagtcgccagcgcgccccgagcccctccaggccagaggctcccgcaggcgatggcggacaagagggcggggaccccagaagccgcggcgcgcccgccgcccggccttgcccgggagggggacgcgcgcacggtccccgcggcccgggcccgagaagctggggggcgcgggtccctccaccccgcagcgg

SEQ ID NO: 9864 - DNA, 1240 bp, Homo sapiens
  source 1..1240: mol_type = unassigned DNA
ggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgct

SEQ ID NO: 9865 - DNA, 222 bp, Homo sapiens
  source 1..222: mol_type = unassigned DNA
aataaaaacccacactacacagcgatggtggtgtctggtggcggtggcggggtggggggtctgactagatgagccgctcctcgcgcccccggcgccgggcgccatggcccgagccgaaggcgcctctggccccggagcgcccgcggcctctgcgcttggcgcggccgcccaagtaggagaagaaggcgcagcccaggaacactcggaagcagcaggtcgccc

SEQ ID NO: 9866 - DNA, 714 bp, Homo sapiens
  source 1..714: mol_type = unassigned DNA
tgtgattcctttttcctgccccaagtggctggcgatacagcccccggcgcgccgggcactgaggccctggagcacagcgtggggggcctggcacagacacgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcggaccctgagtcttaggaaggaggcttataacagcggaaagccatttttttttaagaattgctgagttttccggattgtactttcaaagactttccctgaa

SEQ ID NO: 9867 - DNA, 1216 bp, Homo sapiens
  source 1..1216: mol_type = unassigned DNA
cttaccctgaggttccccagaccccgtagggtctcccacgccaccaagtttgcctcgacttcccctcgctgcctcccacacctcctgccgcggcgcggccggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccgggccggtgtccctgccgcgggaaggaggattcggacgcttaactcagcggcgaagtcgcttcccattggaggaggctttccgaaaacgtttctgaaactt

SEQ ID NO: 9868 - DNA, 207 bp, Homo sapiens
  source 1..207: mol_type = unassigned DNA
ggcctgcctagctcccaccccggcatcgaagccgcagctctcgggcccacctccgcatcctcaggggttcccgggggctgccgacaggttcctgaccagcgagcgcgcccccggggcaagcattcttggcgggcagaaacctgggagcggagcacagcggtgcaagggaaccgtgccaggcgggaagggcggaatttgcggggaact

SEQ ID NO: 9869 - DNA, 253 bp, Homo sapiens
  source 1..253: mol_type = unassigned DNA
ggctgcgcagcgctctcaacccaacccctggactcatcttcgccccagcctccttcgtgcccagcgtcccttgtaaatgacccccccggccgggtgccccgctttctctctcggcctcttccgcgtggtctgctctccgcccgcctgcgctcgcccggcctccctgcctctgcgccttcacctgaccgcaaaggcggccagggcagcctccgcgcggcctgacagtcacggctcccagtttgtccctggacgt

SEQ ID NO: 9870 - DNA, 209 bp, Homo sapiens
  source 1..209: mol_type = unassigned DNA
ggccaggcctgagcctcacctacctacgccgtatttctcctcctccgtgggggtccacatggccgtgccgggcgcggccccgcgggcgcggcgaccgggcgacaacgcggcggggacggccgcgggcccggctgtggcgcaccgcgagtcgaggcggggacggtcaggcggcgcggggcagtgggcggcgcatccctcacaggccgtcc

SEQ ID NO: 9871 - DNA, 225 bp, Homo sapiens
  source 1..225: mol_type = unassigned DNA
ctgcgatcggcttccaacttgggtcgagttgcgcagcggggcgggcgcgcggggcggggcgggccgcgggccctggggagctggccgggaaccggagcccgcggccgcctggtcgaacctgcccgcgcggcgccggggaggagtccggggcggcggcgcggggcgcgcgctcggcgagggcgccccctccagggccgcctgcagcctgcgggacggggccgagcg

SEQ ID NO: 9872 - DNA, 1133 bp, Homo sapiens
  source 1..1133: mol_type = unassigned DNA
ggaggagaagcgacgcaagtgggtagcttttcagcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctt

SEQ ID NO: 9873 - DNA, 478 bp, Homo sapiens
  source 1..478: mol_type = unassigned DNA
tgaactgagggggtccggcggccgctgaggaggggagcgcgcgggaggaggggcgaggagcccggaggcgggcgcggctggcagcttagagggcccgggcggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcgatcctggcctcctcgtaagctccccggacccgggcgtcctcggtctcccctcatctactcttctgtcgggcaggtccgcgaccttccgcctcccgggccg

SEQ ID NO: 9874 - DNA, 201 bp, Homo sapiens
  source 1..201: mol_type = unassigned DNA
ttaatgtgttttaacacgttttaatgtgttgtgacaggaaaagagccggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgg

SEQ ID NO: 9875 - DNA, 208 bp, Homo sapiens
  source 1..208: mol_type = unassigned DNA
gctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatc

SEQ ID NO: 9876 - DNA, 210 bp, Homo sapiens
  source 1..210: mol_type = unassigned DNA
ccagctccccgggaagcagcaggcgcacggccgtctggatctccctggaggtgatggtcgagcgcttgttgtaatgcgccaggcgggaagcctcgccggcgatgcgctcgaagatgtcgttgacaaaggaattcatgatccccatggctttagaggagatgccggtgtcggggtggacctgtttcagcaccttgtacacgtatacggagt

SEQ ID NO: 9877 - DNA, 229 bp, Homo sapiens
  source 1..229: mol_type = unassigned DNA
ttttaagacagggtctccctctcgcccgggctggagtgcggtggtacgatctccggtcgctgcaacgtccgctcctgggttcaagtgattctcctgcctcggcctcctgagtagctgagattacaagcgtcagccaccatagcccggctaatttttgtattttttagtagagacagggtttcaccatattggtcatcctggtctcaaacccctgagctcaggtgagcca

SEQ ID NO: 9878 - DNA, 209 bp, Homo sapiens
  source 1..209: mol_type = unassigned DNA
ctctctctctcttctaacattcccctccagaaaaagaggaacgcaacgaagggagttcagctactatgttggagctgtggaccggccctgtgaggcccacgcgggagcgcggaggctcctgggtctcagggcgccggcagatggcctgcagcgcaccgcccggcccccgcgctggccacgtccgccagcgtcatctctctcccccgcct

SEQ ID NO: 9879 - DNA, 255 bp, Homo sapiens
  source 1..255: mol_type = unassigned DNA
gttattccgcagcgagtcaaagccactccctaccctgggcccgctacgcgacctctgccggcctccgccccacgcggttttagtacggcgccaaggccccgcccacaaatcggccccgtcccctcgtgtccgggcccgccgctcatcagacgccgttccggcgcagcgagttgagggcacgcctaccctccctccgggtccccagtcctcaaggtcccagcacaatgccccaggaggaagactccaggccccttc

SEQ ID NO: 9880 - DNA, 297 bp, Homo sapiens
  source 1..297: mol_type = unassigned DNA
ctcaccattgtcaacgccgccgccgcgtcccccctactccactcctcttccctcaggagaactcccagccccggctccctccgctccggcgctccgtcacgtgacctcgggccgcccctcacacgtgaccgctcccttcctctcccccacccccgcacccgtccctctcccagcctcctgccccgccctgctggccgccaggcactccggggagaggccgcttggaggcggggcctcaggctccacccttcggagggtggagaggggcgggcaaattacgtcgagtgggcggggcct

SEQ ID NO: 9881 - DNA, 232 bp, Homo sapiens
  source 1..232: mol_type = unassigned DNA
tagtcgctccaagccccttcctcctcctcctcctcctcttccgccccggaaagttagcgagcctccggcagcggccgcattttcgccccggtggcctgacgacggcggcggccgcccctgcgcgtcctcccgcctccctccggctcagcccagacgccgcagtggcggcaactgcggcagcggtggcggctctgactccgcgcactccgccccctctttccagccagctcac

SEQ ID NO: 9882 - DNA, 247 bp, Homo sapiens
  source 1..247: mol_type = unassigned DNA
cccttcgcggcctcccctcccccgcgccttccctcccacatcgggctctcggggcagcagcggggaggggagaccggcgggggagggaggacagggaggcgaaggaattggggtggggggtgcgtgtgtggtggagggggtgggacgacacaggtgtcctgaggggaggagccgggaggaaggcgaggaggccgggccaagtgggggtgcggaggtcggggagacaggaacgcggctgcgggcgcgg

SEQ ID NO: 9883 - DNA, 292 bp, Homo sapiens
  source 1..292: mol_type = unassigned DNA
gggcgctgaggctgaagctggggccgggggtgggactgggggcgctggggctgggccgggggtgggactgaggctgcgggcgttcaactgggattgagtcgagggcagcggtggggctgggccgggggagcaggggtcgcgccgggcagcgtcgcgtgctggagcggaggcgggtgcggccggggcaggtcgcgggaggaggaagcgcctggggagcaggagctgggccgggcgggtccgcgccccgcacccgcgggggtgaatcggagtcgccgcagggggctcggggggc

SEQ ID NO: 9884 - DNA, 201 bp, Homo sapiens
  source 1..201: mol_type = unassigned DNA
tgctgtggggctcagggctgcatggggcagcaaggcgcgggggcccgggccgcagagcctccggggaggatccggaggggaggcagtggctcggcggctcgggttacagcccggtgtggtgggggggagggagacggggcgggagagggggcaaggctgcccctgaagggaaccagctggcccgtccgttggccgagctgc

SEQ ID NO: 9885 - DNA, 201 bp, Homo sapiens
  source 1..201: mol_type = unassigned DNA
acccttgctcctcacactcactccccactctcgccccagaaacacgcccctcacaccgggcccgccggatccccacacttcccactcgcgccagaaacgcgcgcaccctcgtggcccctccctgccgcgcgtaaacacgcccggtccgcgcacgccctcccggcctggccccgcacactcgcgccagaaacacgcgtggcc

SEQ ID NO: 9886 - DNA, 201 bp, Homo sapiens
  source 1..201: mol_type = unassigned DNA
cgacgcccgagccagcggagcccggagccgctgggcctcccgtcccctccgcccgtccgccctccccgccccctcggctccctccgccccgccgccccgcgccgctttaccataaaaggtgaggctcggggggagggggcgcgggattcccgccccgcggaagcggcccctacctgccccccaacctgcccggccgcgccc

SEQ ID NO: 9887 - DNA, 201 bp, Homo sapiens
  source 1..201: mol_type = unassigned DNA
gctttattaagcggtctcagctacaacggcgtgcatgccaattacgcctgcaggctaccgcccgcccccggctgccggaccacccagcgcgcctccccccgagtcccggacggggagaggaggagccaggggaggaggcgggaggaagggaaggatggggaggacaatgggggaagaagagggaggatggaggaagggggt

SEQ ID NO: 9888 - DNA, 201 bp, Homo sapiens
  source 1..201: mol_type = unassigned DNA
cactactccgctgtcggcggcgtctccttgggaagcagcagcaactggtggagctggagccgcagcagcctgagtcgccgcagcagcccctgccggagccgcagcaggaggaggaggaggcgggcgccggggtgggcgccggggcgggacacggagcggggccctgggacgaccccttggaaaagcctttggcggaaacgg

SEQ ID NO: 9889 - DNA, 201 bp, Homo sapiens
  source 1..201: mol_type = unassigned DNA
gggcggggtcggaggaaaaggggcggggcggcggggaaaatacaaattaaaatttaaaaatcagtcaaaggaaggatggaagccccgcggctcctccggcgcccagcggtgcttttgctttggtgtccggatcccagcccgcggcctgcctgcctgtcagtcccgtggacaccgcactgccgggcagcgccccggccgcac

SEQ ID NO: 9890 - DNA, 201 bp, Homo sapiens
  source 1..201: mol_type = unassigned DNA
cagcatgatgccgtcctcctggcagtggcagggggccgggcaggcggtgggccccgggccgggctggggggcgccgccggccctccgggaagcgcacagcgcggcgcaaagccatagcgcccggagccccggcgggctgggcatctcggcggtcgggctactggggcacctggcggccgggcgcggacgcacggcgcgatg

SEQ ID NO: 9891 - DNA, 241 bp, Homo sapiens
  source 1..241: mol_type = unassigned DNA
cgaagaaaggggcgcgggggcgcgggggcgcgggggcgcgtggggcgctgggcgccggaggcctggcaggatgcgcggtggggtcgccgccgtcgccgccgttgcgcgctcgctctctggccgggcgcgcgcctcgctccgcagtacttatagggcgccgcggtcccgcccctccataggccccgccccggccagctcacgccccgcccccggccccgcctcctgccgccagggcgcgcag

SEQ ID NO: 9892 - DNA, 201 bp, Homo sapiens
  source 1..201: mol_type = unassigned DNA
gccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgcc

SEQ ID NO: 9893 - DNA, 201 bp, Homo sapiens
  source 1..201: mol_type = unassigned DNA
agaggaagtgagaggtgtccaattcggtcatgcagaacgcagctgggctgctcgaaacgaaacaaagcggctactccgaaggaggtgttgtccctgggccggtccaggttgagtcagagcagacgccactcccacgtcaaaaataccaggccactgtcccagggagctgggctattcactgaggtcattttcaccccactt

SEQ ID NO: 9894 - DNA, 201 bp, Homo sapiens
  source 1..201: mol_type = unassigned DNA
gcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcggg

SEQ ID NO: 9895 - DNA, 201 bp, Homo sapiens
  source 1..201: mol_type = unassigned DNA
ggtccctggagtcactggctcagggcgggcccgcgggatggggcgggcggcccggggcgcagccggccaggccgttgctatggcaacgcggtggaaaaacgggcctctgggtatctcgctgccggccggctggtaaccccccagcggagggaccgggccgagcccgcggacccctccgagtgtctcctggggcccagccgt

SEQ ID NO: 9896 - DNA, 201 bp, Homo sapiens
  source 1..201: mol_type = unassigned DNA
ccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctgga

SEQ ID NO: 9897 - DNA, 201 bp, Homo sapiens
  source 1..201: mol_type = unassigned DNA
ggtcttgctctagggctctgcattcccgagagctgctgtatgccggggattggcttccaagcctgcctgagcttctccagtctcccgggcatcgccatgcggtgggagggtgagccttcctctcctgctgaaattccggcggcttggcaaccggccggggggtcttggattcctcggggagacaccactgatgctttgtgg

SEQ ID NO: 9898 - DNA, 201 bp, Homo sapiens
  source 1..201: mol_type = unassigned DNA
gtgctttccgctgatccccagaggagacactggccagggctcttttttccgagacaaacttcattctggaaaggctgtcagaccgggcgcggtgactcacgcctgtaatcccagtactttgggaggatgaggtgggcggattgcctgagctcaggagttcgaaaccaccctgggcaacatgttgaaaccccgtctctacta

SEQ ID NO: 9899 - DNA, 201 bp, Homo sapiens
  source 1..201: mol_type = unassigned DNA
gcacactccggccgggtgcgggccggcggggcacagcggcctctacggcccgcctccgtcagtcattccccggtccctcctcccgctgctcgcgtgctccgggccggcccagcaccctccgagttacgtgcccgcgctccccggcggggaggagcgcagccgcgggggcgcgccccggtgactccgcccctcagctcccct

SEQ ID NO: 9900 - DNA, 201 bp, Homo sapiens
  source 1..201: mol_type = unassigned DNA
cccccgcgcaccgccgccgcgtactcaccctcacgggtggagcggggcggggcagcacggttccgcgcgcagctccgatccgctaggcgcaccgaccggcggcgcagcgctggcgcgacggctcgactcggccgggtccctgtcccgggcgcgggtccggcctgggagcgggcgagtccgcctgcaggggaggcggggacc

SEQ ID NO: 9901 - DNA, 201 bp, Homo sapiens
  source 1..201: mol_type = unassigned DNA
ggggcggagcggggaggggcggggcggagcggggaggggcggggcggagaaggatcgcagggctgagcggggcgccagcgccagtgcccggcactgccccgggctgggtcccctgcgttagaggaaggggagcccggggacggggcacggggcccgcgaggcacgggtgctctctcggggttccggaagcctccctccccg

SEQ ID NO: 9902 - DNA, 239 bp, Homo sapiens
  source 1..239: mol_type = unassigned DNA
gagaggaagggggaaggagacagaggaaccgagactggggtgagggagcggccgcgcgtggcccccggagaggcgcccatcacctgcgtggcgcccccccgcgccggagtgcggccctgctcccagcgccagtgcgccgcgcggctcgccggcctcgtaggattggctaccgcctcccattcatgtaacctgcgtgtgcgtgtgcgtgtgtgtgtgtgtctctctctcgctcgccctct

SEQ ID NO: 9903 - DNA, 201 bp, Homo sapiens
  source 1..201: mol_type = unassigned DNA
tcttctcgtgggtggtctccgtgagctccttggttagcctctctatctcagtcttataatggtccaccgtctgcaatacctcttctgcggccatagccccggtggatggaggcaggagggggttacggggtgggggagatggatgcgaagctggcggggaaagggagaaggaaatgggaagggatgggtggaaacggaaaa

SEQ ID NO: 9904 - DNA, 201 bp, Homo sapiens
  source 1..201: mol_type = unassigned DNA
ccacctgaaattgacaggcctgccctctatgataatagctgctactaactagtcctcctcacaccctttcactcaccggtctcagcactctgcacacctcgcggagaatccgctcctggttcttcacagagcacagcaccagggtgcagaccaccacatccacagagccatcagccacctggtgcatgttctccccggcag

SEQ ID NO: 9905 - DNA, 201 bp, Homo sapiens
  source 1..201: mol_type = unassigned DNA
aaaacagtagtctcatggaaaacaacagaaaaaaaccccactccagcctggtaaccaacggttggccgggggacgtgtccgcgctgctccccctccggccgccagggggcgcaggaagaagctttggaggtctgtcccgggaccgcgtactcgtccttctttcccgttagtcttttcttcacttccgttgagttccgcctc

SEQ ID NO: 9906 - DNA, 201 bp, Homo sapiens
  source 1..201: mol_type = unassigned DNA
gcctgacgaagccctccttgggggtcgatgcctctctccgggtgggaaggggcgctgtcggtgagggctatcctggcgccggcctgcgccgtccgaagtcgggggggaggggaggtctccgttcagcaggggtcacgcccgccccggacgggggccgcgcgggcgctcaggcgacgcatcttcgccggggcccgtgatcgc

SEQ ID NO: 9907 - DNA, 201 bp, Homo sapiens
  source 1..201: mol_type = unassigned DNA
tcttgagaagcaatagatttcgaccaatgtgcaccgttcccgcggcgccccgccgcgcccggaaccgctgcttacctggcgcccggcaaggaaggctgccggagggttcataggtgtttcctccgcccccggagaagcccggtgtgggcggcgtcacctcagaaacgccatcggcgcgcctgccccgagcggcgggggcga

SEQ ID NO: 9908 - DNA, 201 bp, Homo sapiens
  source 1..201: mol_type = unassigned DNA
cctgccatttgcatccaagatggactctccgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcggg

SEQ ID NO: 9909 - DNA, 201 bp, Homo sapiens
  source 1..201: mol_type = unassigned DNA
ccctagggcggccgcctccactcccggctcccacccagcggggatccaccagggcgagggctgaagacctcgcgggacgccgcgcgccggggacagcgacgcacctaccttcccagccacctgggaggctgcaggtccgggccggagcccgaggctcaggggcgcgcggagcagtcctggttaaggcgcagggcgcggggt

SEQ ID NO: 9910 - DNA, 201 bp, Homo sapiens
  source 1..201: mol_type = unassigned DNA
ctttggggccgggcggggcggggcggggcaggggggccgggcgcggcctacgcgccccctcgagtgcgcggtgcgggacgggcgcggttgacgcgctcccgccggtgtctgtgcttctccgcaggccaggagggcatcctgcgctgccacccggacctggcgggcagcgagctgcagcggggcacgctcacggccgagtcg

SEQ ID NO: 9911 - DNA, 201 bp, Homo sapiens
  source 1..201: mol_type = unassigned DNA
cgggcttggacaggtcagcctgagagcatgcgaagtcggtccccgggcagacaacaagagacaccgccgggaagtgccaggaactccgcgcgttgcccgcggggtcctcctgtagccggggctgggccagaaggatggcaaagttgcgcggcgccgtccgggctggagccgcagccgaggagccgaagccttcccaggccg

SEQ ID NO: 9912 - DNA, 201 bp, Homo sapiens
  source 1..201: mol_type = unassigned DNA
gactcggagctacgcggggcgggggccggcaccgagggccgggaggcgcgaagggtacgcggcggcgggaagcggggcgacccgaaggcccacgggggccgggaggttgcggggcgcccgggatcccctcccgggtggtcaccgtgcggccggggcgcggaagccagaggtgcccagaggcgccgactccgccgaggttgc

SEQ ID NO: 9913 - DNA, 201 bp, Homo sapiens
  source 1..201: mol_type = unassigned DNA
cagccgaggcagaaatccgtcccgaggcgcgggcgccgggtccgggtcccaaggatgcgcgtcgggctccctcccgcggggacagccgagctccgccggcgctccaggtgttcccgcagtgcgtccgggcgcggacgcctctctgccctcggaggggaagcgggagggcccttggggtaacgccccgacctcgggcttcct

SEQ ID NO: 9914 - DNA, 201 bp, Homo sapiens
  source 1..201: mol_type = unassigned DNA
cacaggtgctcccgtcgtaggtctcgcacacccactcatggcactcacacaggggcccgaagaacatgcccggctcagtcacgtggcagatgcagacgccgcagtcgcagcggccccggccgtggcacagcgcggcccccgggggctgcccaggtgcgcggcagcgtcgctccgactcggcccgggacagcctgcaggcgg

SEQ ID NO: 9915 - DNA, 201 bp, Homo sapiens
  source 1..201: mol_type = unassigned DNA
agaccgctgcttggccactctacgcccctgagccccccacacagccagccccgtgacctccgagccccgtgacctccgagccccgtgacctccaagccccggaagccgctgtaggcagcggcccagccaggccccgccccctccaccggagctccacgcgtcaattccagccaggccccgcccccggccgccccaggcgtg

SEQ ID NO: 9916 - DNA, 201 bp, Homo sapiens
  source 1..201: mol_type = unassigned DNA
gcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggcc

SEQ ID NO: 9917 - DNA, 201 bp, Homo sapiens
  source 1..201: mol_type = unassigned DNA
attctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtccggcctctgcgcgcgcacaacaggcggcacggcgcagcccccgggagcgc

SEQ ID NO: 9918 - DNA, 201 bp, Homo sapiens
  source 1..201: mol_type = unassigned DNA
aggatggcgatggcattggcgcggatcttcctcatggtgggcagacgggcgccccaggtgggggactgggccggcgtgctctcggggccggggcgggggcgctcgcagccccagctgtttgttttcgctcgcgcctagctgctcagtcctgcagagcagaaaaaggagagaggtgggggggcgggggggtgatagggagag

SEQ ID NO: 9919 - DNA, 201 bp, Homo sapiens
  source 1..201: mol_type = unassigned DNA
ccagccctttctgagggagctcagcggtgcgggctcgcctcctcccagcccagcttccctgacatcgcccctttcctggggacgttgcctgcgggcccgcgcgtccccgcccccgactcccctgcaggttcctccgggggccggggcaggaccgcactcaccgaggacccgggcgctggagccagcagcagcggcacgagc

SEQ ID NO: 9920 - DNA, 201 bp, Homo sapiens
  source 1..201: mol_type = unassigned DNA
caagccgaagcctttgaaggaggctcggtgccatctcggtgtgatcgcgtcccggcgacgctgggtagggtgcagggagccagctcggccgcggctcagcgggaggggagggggccggtcccgaacccgggcgcccgggccgcgggtgattcactgggaacgccaggttcgcgcgcctagaccggcgggcgacgcccagcg

SEQ ID NO: 9921 - DNA, 201 bp, Homo sapiens
  source 1..201: mol_type = unassigned DNA
gggggcccggcccagggcgggaaatgggtggggaggggcggggcctgggttggagactggacggaggagccgggcggagatgcaactggaggaagagggcgggacggggcggagaaggtttcccgcatcggcggagggagagggactaggagggggctgcggcgggggaggagagggggcttccggcccagagactgaggc

SEQ ID NO: 9922 - DNA, 201 bp, Homo sapiens
  source 1..201: mol_type = unassigned DNA
gcgacccctgtccctcccctgggccgagcggcaggcgcgctcgcaccgcccccgccccctcgtcgcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatc

SEQ ID NO: 9923 - DNA, 201 bp, Homo sapiens
  source 1..201: mol_type = unassigned DNA
ttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagac

SEQ ID NO: 9924 - DNA, 241 bp, Homo sapiens
  source 1..241: mol_type = unassigned DNA
tctcactcccacacactcacacccggccgctcctcgttccctcactcgcctgccgcgcgcgcgcgcgaccccgctcacacacagcgcgcgcgacgccggcggagaccgccccgctccctcagaccgaacgccgcccgcccgcttgctgaggagcggcgcgcgccccggccccgccctcctggcgccgcggcgcggcgggcggggggcggcggccggaggagctgggggccgggccagcgcg

SEQ ID NO: 9925 - DNA, 201 bp, Homo sapiens
  source 1..201: mol_type = unassigned DNA
tcctcgccgcctcccaggctcccagtgaggttcttcagctggccgcccaccatggtcttcaccatgaacgccatggtcttcgccggccggggcaccgggcgcctgctaccacgcgccaggcaccgggcacgtccgcgcctacttcagcactaggtttcgcggacagctcccgccgcgggcccgcgccccacgcttggcacc

SEQ ID NO: 9926 - DNA, 201 bp, Homo sapiens
  source 1..201: mol_type = unassigned DNA
gacccggcatgaggagcccggcacccttgctccccagcctcctggaagctcttccttggactggccggcgccgtcttcccgacatctgggggctgaggccggcatcccgggcctgcgtggaggggcgagcgccaaggctgcgagagtcgggtcccgatttgtaatcacttcttccaactttcatggagctccgtcccgcgc

SEQ ID NO: 9927 - DNA, 201 bp, Homo sapiens
  source 1..201: mol_type = unassigned DNA
gcgcccggcagagagcccccagccgctccggaccccgcgcagccccgcagagacgcgcgtgtcgcccgcacgggccggcacccgggtcgcccccgccggcgtgccaggaccccgcacagaagcgcccggacgcggacgcacgcagccgcggtcacgatccccgccgcccgcccggcccgtgcccggctctggccagcaggg

SEQ ID NO: 9928 - DNA, 201 bp, Homo sapiens
  source 1..201: mol_type = unassigned DNA
ccttcccggcttctcccccactcttcgcccccggggcccctccctgctgagcgggggctgccgggatttgggattgcggggctgccccgaccccgcagccgtccgcggtggaagccagcccgggcctggccctgagcgcgcggctggggcggccgctgtccatggtgctggcgcgggtggcgcgccggccggcggggtctg

SEQ ID NO: 9929 - DNA, 201 bp, Homo sapiens
  source 1..201: mol_type = unassigned DNA
ccgcccgcgcactggggccttcgaggtgtgatgtcacctgcccgcagaatcggcccccctcgcgccgcccccctcgcgcccccaccccagcctccctctcgccgctcccggggctaatatggcagcggcgccgccgccccacccccgcaaccgcacgacccggctggcagggccgccggcccggacccccgagactcacac

SEQ ID NO: 9930 - DNA, 201 bp, Homo sapiens
  source 1..201: mol_type = unassigned DNA
ccgcgggcgcggcccctggaacggaccctcccccgagccgcgcccgccgggccgcccctcccccgcccgcagaccccggcccggccccgccgccgcgcgcgcccctcctcgtcctggcctcccccttcccgcccccgggccccggcgcccccgcccggcccgagcgcgcggcctgccccgcccggctcaccatggcgcggc

SEQ ID NO: 9931 - DNA, 201 bp, Homo sapiens
  source 1..201: mol_type = unassigned DNA
ggccaggtctcccaggagtagttggggaacacccggcgattctggcggctgcttcctggtggcgcagggagcccgcgtgtttgcgagtgcgtgtgtgtgcgaagttctccgggtaagtgtgccagcgcgcgcctgggtgtgtgcaagggtgtgagcgtgcacacgtgggcacgggcgtgtgcgcgcgggggtgcccggttg

SEQ ID NO: 9932 - DNA, 201 bp, Homo sapiens
  source 1..201: mol_type = unassigned DNA
cctcgccttcatccgcctctctcaccgcgccgctccctcgtcctgccctgcgggctcaggcggaacccggaacggccgtcctcttcccccgccctccgccgccgcctcctcctcctccttctcggcttcctcctcagccccgggccggagcggggtgtcggcggcggccggttcgggcggcggcgcttggccatgtcgtgt

SEQ ID NO: 9933 - DNA, 201 bp, Homo sapiens
  source 1..201: mol_type = unassigned DNA
ccaagcccgctgggcgcccgcccctgcgcaccgcgcccgctctttccgtttgtgcgcttgggctccggcgcacgcactgcatctgtcgcccgcccctgccgtgtgtgtgcactgccggggcccgctcgcccacgcccgcgcgtgcgcccccactcccaccccgcatccgcgtgcacgacccactcgccgccgctgtgcgcg

SEQ ID NO: 9934 - DNA, 201 bp, Homo sapiens
  source 1..201: mol_type = unassigned DNA
tgccgaatgaagctgagcgtctcagtggaaccagggatctcaggggtgagcgaccgcgaggggagagcgacgaaaagggcggccggagctggaggggcgcggagttaaacaaaaaagggcggccggagctgcaggggcgccgagttaaacacgtcatttccagatggggggcttcaggcgagctgcttagctcccctgagg

SEQ ID NO: 9935 - DNA, 219 bp, synthetic construct
  misc_feature 1..219: note = Description of Artificial Sequence: Synthetic polynucleotide
  source 1..219: mol_type = other DNA
tttagggagggggygggaggttttttttgtttagtttygagtyggtggtgtagygttygttttyggtygygggygtagattggyggtygttttygggttaygtggtgygygyggygggygygttygaggagtttgyggttgtttttggtttatagygtttygggygaggagagygggyggaygtygggggttgggtyggtgygggyggygaggtaggyg

SEQ ID NO: 9936 - DNA, 315 bp, synthetic construct
  misc_feature 1..315: note = Description of Artificial Sequence: Synthetic polynucleotide
  source 1..315: mol_type = other DNA
ygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygtt

SEQ ID NO: 9937 - DNA, 201 bp, synthetic construct
  misc_feature 1..201: note = Description of Artificial Sequence: Synthetic polynucleotide
  source 1..201: mol_type = other DNA
gtattyggtttagggttggagttggttgtagggttggttygyggygatttgggtagggtggyggttgttttttttttttttatttygtttygaggygtagygygyggtagagyggttyggtgttyggygggygggyggttygggygggtttgyggtygggatgaggayggygttttygttgtagagygttggggyggygyg

SEQ ID NO: 9938 - DNA, 201 bp, synthetic construct
  misc_feature 1..201: note = Description of Artificial Sequence: Synthetic polynucleotide
  source 1..201: mol_type = other DNA
aataatagggaygttgagaataataattaygattagtayggygaaggygtttttttygygggttagaggtyggygttttagtttygtagaattyggygttyggttagygttttttggtagtttttttyggtagttttaggtttttaagatttgtaggttygtttygaagtttttygttygttttttayggtygtttygagt

SEQ ID NO: 9939 - DNA, 201 bp, synthetic construct
  misc_feature 1..201: note = Description of Artificial Sequence: Synthetic polynucleotide
  source 1..201: mol_type = other DNA
ygygtatttttttygttygtttgttygyggttttttttttgttttyggagygttagtygttttatttygtgatyggtttttygttttgtttygtaggattygttyggaygggattaygtygtygtygtygtygtygtygttyggagtygygtttygggttttgtttgagtygagtygygygyggggtygtagttatygtyg

SEQ ID NO: 9940 - DNA, 201 bp, synthetic construct
  misc_feature 1..201: note = Description of Artificial Sequence: Synthetic polynucleotide
  source 1..201: mol_type = other DNA
atagagttgttttttttttttttgggttttgtaagttttygaattggaggyggaaatgggggaagggttggaagttgtgtgtgaaaaataattattgtaaygggttttttttaggagtttagttyggtttgtattttggtggaattgttgttatyggtttatagygtttaggtygagtyggtagggttgggygggaggttt

SEQ ID NO: 9941 - DNA, 201 bp, synthetic construct
  misc_feature 1..201: note = Description of Artificial Sequence: Synthetic polynucleotide
  source 1..201: mol_type = other DNA
tagttatygyggyggttgyggyggyggtattttygtttttattttygttygggattgttttttattgttttttygtttttttyggatagtgagttygyggyggggygggggaaggagtygtttttattttttttaagtttatttttaaagagatttttttttttttttttygtygtttggygyggagtygggaygatgttg

SEQ ID NO: 9942 - DNA, 201 bp, synthetic construct
  misc_feature 1..201: note = Description of Artificial Sequence: Synthetic polynucleotide
  source 1..201: mol_type = other DNA
aataagtagttygggagatattttttttttttttagttttygtttttttattttgttattttttagttygtgattagttgttttttttttttttygygggygtttagggttgagtaaatatttygggtygttygtttygttattagttggtttygatyggygtatygttggygattttttaggtaattyggygttatgaga

SEQ ID NO: 9943 - DNA, 201 bp, synthetic construct
  misc_feature 1..201: note = Description of Artificial Sequence: Synthetic polynucleotide
  source 1..201: mol_type = other DNA
ygtggtttggtygaggagttaatgggtygggaggggygygygggggaggagtttaggtgtagagtgtygattggttagttygtttttyggtatgtagatayggtgggagttaygtgttaggggtygggaygattttttgttggaggttaaygyggggyggggaagggggygygagygtttygtttggttgaagygggggga

SEQ ID NO: 9944 - DNA, 201 bp, synthetic construct
  misc_feature 1..201: note = Description of Artificial Sequence: Synthetic polynucleotide
  source 1..201: mol_type = other DNA
ggaggaggggaggygttgttygaygygtttttttaagttttygygttttttttyggyggyggttgttygggggyggtggttyggygtygtttttttygatygttttttttagggtttttttttygtgtygyggttaggttgttyggtyggyggygygttggaaatatgaagagaygttgtagttgyggtggyggtggyggt

SEQ ID NO: 9945 - DNA, 201 bp, synthetic construct
  misc_feature 1..201: note = Description of Artificial Sequence: Synthetic polynucleotide
  source 1..201: mol_type = other DNA
tttatttgggaygygatttataggggygttgtttygttttgygggaagaggaggyggyggtygtygtgattggggygttyggttttattygtttatagaaygtttttaatattaggggtttgaaagygaaaatttygggaaggtattttttgatygtagattatattttgtagttgatttatatygtttaggaggtagtga

SEQ ID NO: 9946 - DNA, 201 bp, synthetic construct
  misc_feature 1..201: note = Description of Artificial Sequence: Synthetic polynucleotide
  source 1..201: mol_type = other DNA
ataaaagagtagttttygyggagygggtttagagtttgttyggattgttygatggttttyggttttttgagygtygyggttgtygggttttgtgttygygyggggggygggaaggayggtyggggtttttagtgygygtttygyggagyggygygyggygttygaattggaaagttgtygtyggygtttgtygtttttayg

SEQ ID NO: 9947 - DNA, 243 bp, synthetic construct
  misc_feature 1..243: note = Description of Artificial Sequence: Synthetic polynucleotide
  source 1..243: mol_type = other DNA
gttaaggttyggatygttattttagtaatagttttagttatgtgatyggtaatggyggygttgaygagaggtaggtgagttyggygttttttatatttatygygygtttttygggtttygttygtattttttaygygtttttygttttttyggygtttttttttttattttttttttttgygygyggtttygggtttttygtttygtgttyggtygattatttttttagtattttttagtttt

SEQ ID NO: 9948 - DNA, 201 bp, synthetic construct
  misc_feature 1..201: note = Description of Artificial Sequence: Synthetic polynucleotide
  source 1..201: mol_type = other DNA
tagttygtttatttttttttggagaagttygaygtagygttygttattttttttttttygtgtgtagtttttyggttttaaagtatttatttgtttaattygatttttattttataagatygtaatyggttattatttttgtttttygttaggatatygaggttagttgtgttattgtttygaggggttgtaggtgtagag

SEQ ID NO: 9949 - DNA, 201 bp, synthetic construct
  misc_feature 1..201: note = Description of Artificial Sequence: Synthetic polynucleotide
  source 1..201: mol_type = other DNA
tygtagtatyggttattttattgttaagggtgttttttgtatttgttgygatattttgggtygtttttagtttagtttgtatagtatttttggttaygttygtagtatyggtgattttattgtagatagtgtttttggtatyggttagtayggttttggtygtgtttatatttatttggayggtttttttggttatattyg

SEQ ID NO: 9950 - DNA, 201 bp, synthetic construct
  misc_feature 1..201: note = Description of Artificial Sequence: Synthetic polynucleotide
  source 1..201: mol_type = other DNA
tttygggtygaggggaattygygatyggatttgtgggggagaatgaggatgaaaaygtggagtttttattgtttagggtttgatyggtygatagggatttygaygggggatyggggatttggggagggggtygtattttttygtttttttygyggtttttyggtttttgtttgtttttttgatygtttttaggggygyggc

SEQ ID NO: 9951 - DNA, 201 bp, synthetic construct
  misc_feature 1..201: note = Description of Artificial Sequence: Synthetic polynucleotide
  source 1..201: mol_type = other DNA
agtyggggtagaaggaggagtttgaaggtttattatggggtggaggttgtttgttygygggttygtttttagagttyggggtttattaygttgttttatgygtttttgttggtttttgttaaatagttttttttttttgtgttttagttttttggttgtaaaaagggggtgtttatagagtttttttgaggagtygttata

SEQ ID NO: 9952 - DNA, 201 bp, synthetic construct
  misc_feature 1..201: note = Description of Artificial Sequence: Synthetic polynucleotide
  source 1..201: mol_type = other DNA
ttggtttttatttggtttgygagaaattaaattttgggtataagttatgaagtygataagttygggagatatagtgttagaattataaggtgagattagtygttyggttaagttattttttygttagtaggtgaggttygtgaatagttaagttttttttggtayggyggaatygtagtggaygygtggaggggtttygta

SEQ ID NO: 9953 - DNA, 201 bp, synthetic construct
  misc_feature 1..201: note = Description of Artificial Sequence: Synthetic polynucleotide
  source 1..201: mol_type = other DNA
aattttttatttattaaygtyggygtygttatgggtttagggggttgggtgaggtygtgagagtyggygaggaagtyggttttgygggttyggtygatttygggtttyggttttgggttgygagggattttagttttygtygtygtgtaaaatgtatataaggttygyggygtygtttttgygygtygtgaggatataggg

SEQ ID NO: 9954 - DNA, 201 bp, synthetic construct
  misc_feature 1..201: note = Description of Artificial Sequence: Synthetic polynucleotide
  source 1..201: mol_type = other DNA
gatagaaggggagagtggttaggaaggaggggaggatggatatagggygtttgtagaattggtgggtagatggayggagggaygggtygtgtagtgtagtyggyggggttagggttaggtygagggygygaggtggtagtyggttyggggaggyggaggttgagygagyggtggtgtttgtggagttgtyggttgyggtgg

SEQ ID NO: 9955 - DNA, 201 bp, synthetic construct
  misc_feature 1..201: note = Description of Artificial Sequence: Synthetic polynucleotide
  source 1..201: mol_type = other DNA
ggggttgggaygtttyggyggagtaggyggyggyggtggygagttggggagttttaggttyggygttgtyggaggggttygagtygagtygtttgygtttyggtygggtagygtygggttygtttttygyggggttaygttttgttaaattttgttgyggyggttagygtagygggttygtaagygggygggaggggygtc

SEQ ID NO: 9956 - DNA, 201 bp, synthetic construct
  misc_feature 1..201: note = Description of Artificial Sequence: Synthetic polynucleotide
  source 1..201: mol_type = other DNA
ttattggtgagtttggtagggtatagagaggatggtattattagttggagggggataggttttaattatgagtttaggatgtagagagyggtagggattatyggagttttttyggttttggtgttttggttttttttgtatayggtttttatatgaygtttagtaagtyggattttaatttgtttatttattttttatttt

SEQ ID NO: 9957 - DNA, 201 bp, synthetic construct
  misc_feature 1..201: note = Description of Artificial Sequence: Synthetic polynucleotide
  source 1..201: mol_type = other DNA
gaggttaaggygggtagattattygaggttaggagttagagattagttyggttaatagggygaaatttygttttttttaaaaatataaaaattagttaggygtggyggygttygttygtaattttaggtatttggtaggtygaggtaggagaattaygggagttyggggtagggaggttgtagtgattygagattayggta

SEQ ID NO: 9958 - DNA, 233 bp, synthetic construct
  misc_feature 1..233: note = Description of Artificial Sequence: Synthetic polynucleotide
  source 1..233: mol_type = other DNA
ggagagagagagagagagagagagayggagtyggagagggagggagygagagaaagygagagtttttygttatttttygtygtttttagaatttatygggygtttgttyggyggttttagaaggtygggttgygttgtgggttgyggggagtyggaggttttttgattggttttttgaygttttyggattaattgtgttgttgtataggygtggtttttataggtygagtgtt

SEQ ID NO: 9959 - DNA, 201 bp, synthetic construct
  misc_feature 1..201: note = Description of Artificial Sequence: Synthetic polynucleotide
  source 1..201: mol_type = other DNA
ygyggtatagttatttttttygtygaggyggtattttaattttgtgtttttttaggatygygggttgtaggtattyggttttygaagyggaggtyggagtygygyggagaagttaayggtaatgaygttttttgtygatttttaggaggggataggttgagggtttggaygaggtyggaagygtttttattgtagtttygg

SEQ ID NO: 9960 - DNA, 201 bp, synthetic construct
  misc_feature 1..201: note = Description of Artificial Sequence: Synthetic polynucleotide
  source 1..201: mol_type = other DNA
ttttgagaagtagtagtagttggtttgtttgttgtttygttttygtgtatggttgtttagygttggttttagtgtttagygttttygtttagtattttttyggttttttttttttatttttygttttygagttgyggggagttttagtttgggatttttgttttatgtttttgggtttttgttttggttggttygtttttt

SEQ ID NO: 9961 - DNA, 201 bp, synthetic construct
  misc_feature 1..201: note = Description of Artificial Sequence: Synthetic polynucleotide
  source 1..201: mol_type = other DNA
ggtttygtygggtyggtygttgygagtttygtttyggtttyggttatygtyggggaggaygaygaygaygtggtgggggaygtgttggtattgttggtygygtttttggtttyggggtygygggygtygygygtggaggtygtttttttttgtygtttgygtygggaygygttggtggagyggygygygttgtaygagttt

SEQ ID NO: 9962 - DNA, 201 bp, synthetic construct
  misc_feature 1..201: note = Description of Artificial Sequence: Synthetic polynucleotide
  source 1..201: mol_type = other DNA
ttttttttagtatattttatgtaaaagttagtaaaaatattttttttataagtttaaataaatgtttaaaaatatgtaagttaggaagttatttttaataygtatattttttttatatgtagaagtaatggtgagaattttttatattttttgtagtagattttyggtttyggggttgggtttttagtaagtttatttttg

SEQ ID NO: 9963 - DNA, 201 bp, synthetic construct
  misc_feature 1..201: note = Description of Artificial Sequence: Synthetic polynucleotide
  source 1..201: mol_type = other DNA
ttyggtygtattttygttttatttttayggtagggtttttagtgtttgattaagtttaagttygagtttttyggygygttgtttatyggttgttttttygygttttttttttttttttattygtatygtttygttttttattttttttttgttttttttttattatttagtttatatttttttygttttttttttygtttt

SEQ ID NO: 9964 - DNA, 201 bp, synthetic construct
  misc_feature 1..201: note = Description of Artificial Sequence: Synthetic polynucleotide
  source 1..201: mol_type = other DNA
gggattgggaaygggatagggaygygttttaatttatttagyggtggagttggggggyggygyggttaygtgggatggygggtagtttaggggattygggygayggggtttggygggtagggttgttttagtygtttttataaagtyggttttttygatttttttttttttttgtagtttttttttttttttttgggggtt

SEQ ID NO: 9965 - DNA, 201 bp, synthetic construct
  misc_feature 1..201: note = Description of Artificial Sequence: Synthetic polynucleotide
  source 1..201: mol_type = other DNA
tagttatttatttgttttttaygttttatttattagygygtayggtttyggtaattttattyggagyggggygtygtygtygtttttgtygtagttyggtygggtygttgggygtaggggatttygygtygtygttgtygttgtygtygtygtygtygtygttgtygttgttgtatttttyggygagygttgttgtttttt

SEQ ID NO: 9966 - DNA, 201 bp, synthetic construct
  misc_feature 1..201: note = Description of Artificial Sequence: Synthetic polynucleotide
  source 1..201: mol_type = other DNA
tttgggggaygtyggaygttatgttgtggaaaataatygataatgttaagtaygaagaggattgygaggtgagttggggtttyggggtgtagtttygtttygtygaggatagttygggaggtaggggttattggatygaggtyggggaygagggtataggagttttggtttttyggtgggaygggatttattttttyggat

SEQ ID NO: 9967 - DNA, 201 bp, synthetic construct
  misc_feature 1..201: note = Description of Artificial Sequence: Synthetic polynucleotide
  source 1..201: mol_type = other DNA
gggagggaagaaggaggyggygagygggaagaggaagaagaygtaggtagygttaggygagtttaggggygtygggagygyggagttygggttayggattygygggagtttattgygttttygggttttggagggttgtttttgttygtaggttygggygttttygttaggaggygatagygttatgtttttttaggtttt

SEQ ID NO: 9968 - DNA, 201 bp, synthetic construct
  misc_feature 1..201: note = Description of Artificial Sequence: Synthetic polynucleotide
  source 1..201: mol_type = other DNA
tttagtyggtttttygtatgattggattatatgagggatttaagttyggttagttgttatttttyggattatatgygtgtttagggatygttttttaattyggtatggggatttggaaaaaaagattagggtagagggattggggtygggttyggtgatygtttttyggtaattaaaggatagtaaaggayggtttttgat

SEQ ID NO: 9969 - DNA, 410 bp, synthetic construct
  misc_feature 1..410: note = Description of Artificial Sequence: Synthetic polynucleotide
  source 1..410: mol_type = other DNA
ygtatgygtttaggtyggttygtaggtttttttygttttagtyggtagttagttygttygygttggggttatygygagtyggttygtagyggggttatygygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtygyggattggaggttttyggttggaaaagttttttggyggttaattggggaggattggaagaaatttaggatggagttagtattgttggtttaatatgttt

SEQ ID NO: 9970 - DNA, 201 bp, synthetic construct
  misc_feature 1..201: note = Description of Artificial Sequence: Synthetic polynucleotide
  source 1..201: mol_type = other DNA
aagtttttgggaaagattygttttattttyggaagttagagggygttagttgtygggttgaaaaggggtgtggggaggggaagtagttttatttygggttyggagtttgtaggagagagaagtggggagtaagaagtgaattttaggggtttatagggttttygtagatgtttaggtyggttaggaatgtatttttggttt

SEQ ID NO: 9971 - DNA, 201 bp, synthetic construct
  misc_feature 1..201: note = Description of Artificial Sequence: Synthetic polynucleotide
  source 1..201: mol_type = other DNA
tttattaygtyggggygattygttgtttgagygagtaygtttygtatttttttygygaygygygtatgttgttyggygtttyggtyggggygttgtattgygtyggygtttttttyggtatttygttgggtgygtttggggaygttgttygggttttaygtgyggagtgggtgttttttaggtyggggagygggggatttt

SEQ ID NO: 9972 - DNA, 201 bp, synthetic construct
  misc_feature 1..201: note = Description of Artificial Sequence: Synthetic polynucleotide
  source 1..201: mol_type = other DNA
atttttggattaggaaatagtgtgtgtgtataygagagagagggatagagagaggggggatatgtggagtgtattggaattattataatttttatgaaggyggtatyggagttattggtattatttgtgtaatttttttttatgtttgaygtygttttaaaataaagagtgagttgagtaaattaattyggtagggtatat

SEQ ID NO: 9973 - DNA, 201 bp, synthetic construct
  misc_feature 1..201: note = Description of Artificial Sequence: Synthetic polynucleotide
  source 1..201: mol_type = other DNA
gyggyggggttgggtttggggttggaygttgatttaggatttygtttttgttygttttgygtygygtttttttygggtyggttttgatygagtagttttaygygggttyggggttygtttattygataggagyggggggttgtagtttaygagtttaygagttygtagygaygtattyggagtgtaatttygtagagttac

SEQ ID NO: 9974 - DNA, 201 bp, synthetic construct
  misc_feature 1..201: note = Description of Artificial Sequence: Synthetic polynucleotide
  source 1..201: mol_type = other DNA
gtatygygyggyggygtttggygggtattgttgttygyggagggayggtgggggggttttagtagttggygggggtggagggggygggagagggagtttgygtygggttgagtttggaggtgyggggygggttyggggagygtttttggggttttttttgttatagtyggggyggttggaatttttttttttttttttttt

SEQ ID NO: 9975 - DNA, 201 bp, synthetic construct
  misc_feature 1..201: note = Description of Artificial Sequence: Synthetic polynucleotide
  source 1..201: mol_type = other DNA
gtygygtygtygggtttyggggatatttttygtygtttttttygattygygtygtyggggtygtygggtygtagggtayggggtyggygyggggggggagyggagaggggttggggagttttaggggttyggggttygttygygggggatgggtagggatttygggtygygtggggtgygggggtygttygtattgaggac

SEQ ID NO: 9976 - DNA, 201 bp, synthetic construct
  misc_feature 1..201: note = Description of Artificial Sequence: Synthetic polynucleotide
  source 1..201: mol_type = other DNA
tttttttttaaaaagagttttttagagttgtygaaattttygyggggtgaaagttaaatttttggagtygttgtgtagtygggtagaggatayggyggygygagtyggaaagataagtgtttaggygaatgggaaaggaaagattttaatttttgtttttattgttagttgaatgtttataaaaattaaagggaatgyggg

SEQ ID NO: 9977 - DNA, 201 bp, synthetic construct
  misc_feature 1..201: note = Description of Artificial Sequence: Synthetic polynucleotide
  source 1..201: mol_type = other DNA
atggtttattgygtaagtttatatttagttttaggaagygagttttaygtygttttagttttgtatttatagtygttaagyggtttyggaagtygaatgtyggataggttaaagatagygtygttgtttyggtattgtygttagagggygyggagtygtygtgttggtttgtattttttttgttaygttagtygaayggtt

SEQ ID NO: 9978 - DNA, 201 bp, synthetic construct
  misc_feature 1..201: note = Description of Artificial Sequence: Synthetic polynucleotide
  source 1..201: mol_type = other DNA
gyggttyggaaatgagygtttttyggggatagggggttttgyggggyggygatagttggatttttagygygtataaagtttgygggaggatttattgtagyggtygttttttttygtttagygagggygggygtaggggygggggatgtygaagggttaggtttgtttaggtygygttattttygttttagaygtttagtt

SEQ ID NO: 9979 - DNA, 201 bp, synthetic construct
  misc_feature 1..201: note = Description of Artificial Sequence: Synthetic polynucleotide
  source 1..201: mol_type = other DNA
tttygagggtygygygggtttaggygtttayggtttygtagygtygygtttttygygagaaygtagagattygggttygttttgagtygtygattgygggygggagtyggygggtaaggygygyggtyggtagtyggagyggygygtaaygtagttgagtgaggtygtyggtggaggtayggagtagtaggygttyggggc

SEQ ID NO: 9980 - DNA, 294 bp, synthetic construct
  misc_feature 1..294: note = Description of Artificial Sequence: Synthetic polynucleotide
  source 1..294: mol_type = other DNA
tttygygaaggtttyggttyggtygggyggggtggggyggtttyggttttattaattagyggtttgttgtggatgtyggyggaggagatgttatttagggygggaaaaggggygyggaagaggggyggggygggttayggygygtagggtttttttttttygtttyggatttaattaattgggtttgagtttttgtyggggagggggygtygggyggggtygyggttgggyggggygggggatygggatyggyggygggggttgyggttttgtagtggaagtatgggyggygag

SEQ ID NO: 9981 - DNA, 201 bp, synthetic construct
  misc_feature 1..201: note = Description of Artificial Sequence: Synthetic polynucleotide
  source 1..201: mol_type = other DNA
gtgtggaggtttaygtagygtttttggttggaayggggaagtttgtatttagttttgggagtgggtttgggagagggaggaggagtygtygggagtttggygggagggyggtgttttygtttgggtttttttttgttgttttagtttyggtagtttttatagtagtttygaagggtgagaatttgtttttttatggatttg

SEQ ID NO: 9982 - DNA, 201 bp, synthetic construct
  misc_feature 1..201: note = Description of Artificial Sequence: Synthetic polynucleotide
  source 1..201: mol_type = other DNA
ttttttagtttttagagtaagttaattagggataygttttygtggtttagttyggaaataatgtttggtgggaatttgtaattttggttgtyggaattttyggggaggattaaygtyggygtatygtgyggtyggggyggggygtygtttaaatttaggttttgtgatagygattgtggyggtttggaaagygtgggtttc

SEQ ID NO: 9983 - DNA, 201 bp, synthetic construct
  misc_feature 1..201: note = Description of Artificial Sequence: Synthetic polynucleotide
  source 1..201: mol_type = other DNA
aattatttttaaaataattttttyggggggtgagaggtaattataattttagygagtggagggygygggggatgggygtygggygggygggggyggggagygyggygygggtttttaggtggygagyggaggtgttttygtygyggggggaggggygggggygtaygyggtyggyggyggggggaggyggygygyggggga

SEQ ID NO: 9984 - DNA, 201 bp, synthetic construct
  misc_feature 1..201: note = Description of Artificial Sequence: Synthetic polynucleotide
  source 1..201: mol_type = other DNA
aggttttygtatttatygygtgggtttttgttttggttttatttgttttygatatttttygttttygygatgtttaatttyggttygagaaggttggtygygatttygttyggtattygtygtttygatattattattygttttttygatttttttyggygtygttgtttattygtttttygtttygtttatyggggtygt

SEQ ID NO: 9985 - DNA, 201 bp, synthetic construct
  misc_feature 1..201: note = Description of Artificial Sequence: Synthetic polynucleotide
  source 1..201: mol_type = other DNA
ggggaygttygtttttttttygggtagttttttttatttaggygggatttgggttttygttggatttagggtygttttttygtaggyggggtyggttyggygygtattttgtttyggatgttttggygtayggtttygygtttygtttttattttggygtatttggttttgygtttttttttygtttggygtagygttttt

SEQ ID NO: 9986 - DNA, 201 bp, synthetic construct
  misc_feature 1..201: note = Description of Artificial Sequence: Synthetic polynucleotide
  source 1..201: mol_type = other DNA
tattttttttttgygygtttgtttttttttygtttgtaggatttygtttttggttygttttttttttttttgttgggtaggttttttyggagtttattttyggyggyggyggyggtagtygyggtygyggtygttggatttygagaggygyggggaatttttttattttttgttttggttttatttgtttttttttttttt

SEQ ID NO: 9987 - DNA, 201 bp, synthetic construct
  misc_feature 1..201: note = Description of Artificial Sequence: Synthetic polynucleotide
  source 1..201: mol_type = other DNA
tagggaattataaaagayggtyggyggygagtaggttggggtgayggggatttygtggataaygggtttgaggaygtttagggttttagttttttttaggygtttttygtyggggtaaygtagagtagttgtygtttttttygygttttagtagatggtggtgttagttyggtttygtgttyggtygtygttgygttygyg

SEQ ID NO: 9988 - DNA, 201 bp, synthetic construct
  misc_feature 1..201: note = Description of Artificial Sequence: Synthetic polynucleotide
  source 1..201: mol_type = other DNA
ttagataggtatggttaaggtagtttgtgatttattttataaaattagagatttttgttttttgtggagtaagatttttyggaggttagagtaggatgatygttaatttttttttttagagtyggtttagtttgataaagtaggggttatttyggagtttggaggggaagagagtttaggtataaggttatttttgggaaa

SEQ ID NO: 9989 - DNA, 201 bp, synthetic construct
  misc_feature 1..201: note = Description of Artificial Sequence: Synthetic polynucleotide
  source 1..201: mol_type = other DNA
gggygygyggygttttttatttaygttyggtyggggygyggygyggyggygggtattyggayggtyggyggaggtaggtyggttygggtattagtttgggyggttygygggtyggggyggyggyggggtggyggtggyggyggtagtagygyggagtyggtgggygtagtygygygttaggtyggyggtyggggtttgggg

SEQ ID NO: 9990 - DNA, 201 bp, synthetic construct
  misc_feature 1..201: note = Description of Artificial Sequence: Synthetic polynucleotide
  source 1..201: mol_type = other DNA
tttgttatagataagttttygaagtygttttggtgtaggttatttggttttttagtttttggtgtgtggttagtgtttggtgtttttggaaagttattttygggtagtttttgatagtgygattyggygtttaagtagtttgggattttgygyggatttgatttttttagatygtaggtagtttgggaggaggttyggtyg

SEQ ID NO: 9991 - DNA, 463 bp, synthetic construct
  misc_feature 1..463: note = Description of Artificial Sequence: Synthetic polynucleotide
  source 1..463: mol_type = other DNA
aygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygtt

SEQ ID NO: 9992 - DNA, 201 bp, synthetic construct
  misc_feature 1..201: note = Description of Artificial Sequence: Synthetic polynucleotide
  source 1..201: mol_type = other DNA
atygggagtgtttagygattttaggttagttygggggaaagaagyggtygtygtygtygaggttttttggtttygggatttyggygttgtttttttttttygtatttgttggggtgggttggagtygtaatygaatttyggtygyggygtttgtaaagtttttttttygaagtttygyggttttagtttattggygttttt

SEQ ID NO: 9993 - DNA, 201 bp, synthetic construct
  misc_feature 1..201: note = Description of Artificial Sequence: Synthetic polynucleotide
  source 1..201: mol_type = other DNA
gttttatagtttyggttagaatttggtgggggaygyggggggggggtgtttgayggggagggggtatagttttttygggttaatttttatatttttgtttygtttaggyggggggtgagtyggggtgagtagtyggttttaagttggtyggttttttggaaagggagggttagtaggagaattgtagatttttttagtttt

SEQ ID NO: 9994 - DNA, 201 bp, synthetic construct
  misc_feature 1..201: note = Description of Artificial Sequence: Synthetic polynucleotide
  source 1..201: mol_type = other DNA
gggatygttttaagtagttygttaataaygtggyggtggtgaaggagttygayggygttaagttygtggtgttgaggaagaagtttyggttttyggagttygagttygtatttttyggtttttygggggtagyggtttagtygtygaaatttatttygayggttttgtygyggagygtttttgtttygggagtttygtttt

SEQ ID NO: 9995 - DNA, 201 bp, synthetic construct
  misc_feature 1..201: note = Description of Artificial Sequence: Synthetic polynucleotide
  source 1..201: mol_type = other DNA
gtttttagaggtttagttttgttttttattatatatagttattattttattygtttttggggttyggttgtttttttyggtgttttttaaatttttttttygatttgggtgttaagtttatttatttttyggygtygttttyggtygaatagttttttgtttttttttygtttgggtyggagtttttygtagtttttttyg

SEQ ID NO: 9996 - DNA, 201 bp, synthetic construct
  misc_feature 1..201: note = Description of Artificial Sequence: Synthetic polynucleotide
  source 1..201: mol_type = other DNA
ggttyggtttggggttgggttggggagygyggyggttgyggttggggtayggggyggtygggtgagttggtyggygttygttttttttatttagtgagtayggtagatatyggagaygyggggtttattttttyggttttttttygattaagaaaygttaatttygttttttattggttgygtygygygttatgtygatta

SEQ ID NO: 9997 - DNA, 201 bp, synthetic construct
  misc_feature 1..201: note = Description of Artificial Sequence: Synthetic polynucleotide
  source 1..201: mol_type = other DNA
atygagtttaaaagtygtyggyggtatattttagyggttttttttttttygggttgggattygtttttgtaagaaaygttatgtttttttttttagatatygtttygggagttttagatgtaaaattagaggttttttatttggtattattgatttttgtgttaataaaatgttagtttttaagggaaaatttaaaaaaag

SEQ ID NO: 9998 - DNA, 201 bp, synthetic construct
  misc_feature 1..201: note = Description of Artificial Sequence: Synthetic polynucleotide
  source 1..201: mol_type = other DNA
gtygygygggayggggtagggatttygagaatatyggggatttgygggtyggtggtttygggtaggttatttttgaygygggtgygaggtttttygygggygtgtayggttgggtyggagtygygtygggggtygggataygtttggggttagygttggygtygtygttygggtggggtgggtygggttygggtttagttt

SEQ ID NO: 9999 - DNA, 201 bp, synthetic construct
  misc_feature 1..201: note = Description of Artificial Sequence: Synthetic polynucleotide
  source 1..201: mol_type = other DNA
ggyggygygyggtagagttgggtttttygttaggtggtygggggtgtgtttttagggtattttattygttattttygygtttttagtttyggyggtygygyggatttygtttttgttgatttyggygtaygttttygygtygygygtagtttttygtttttygtygatttygtygygtygtyggtagttttttttagtttt

SEQ ID NO: 10000 - DNA, 201 bp, synthetic construct
  misc_feature 1..201: note = Description of Artificial Sequence: Synthetic polynucleotide
  source 1..201: mol_type = other DNA
ttttttttttgttgttttaaaatatttttygaygttagtaaaatataatgygtttyggtygtygtaaatagtygggagggagagtatatattyggygyggygyggtygtyggttyggtttttatttttttttygtttttagaaaatgttataaaagygggtagggygyggggagggyggttgygygttyggyggtyggggt

SEQ ID NO: 10001 - DNA, 201 bp, synthetic construct
  misc_feature 1..201: note = Description of Artificial Sequence: Synthetic polynucleotide
  source 1..201: mol_type = other DNA
agttaggaaatgyggggtttggtggggtgaggagtayggggttttttttttattttygyggggattttgttatyggtttagtgtggaggttttatygtttygttyggattygtggggtttygatagtgtggtttttgygaggattttttttatttttttygttttggggttgttgygggagggygttygggtagtattagg

SEQ ID NO: 10002 - DNA, 258 bp, synthetic construct
  misc_feature 1..258: note = Description of Artificial Sequence: Synthetic polynucleotide
  source 1..258: mol_type = other DNA
gyggyggtagyggyggtttggtttttttagagggttagagttagggatatgygggygttygggatttygygtttygygyggttyggygtttgagygttttygtttttygtttyggagttgtyggyggtatgattygataygtyggggygttygygygyggggattttayggggtaagttygggyggtygtttttttttttttygygatttttayggttygygttttggtygttttattttattttttgttttagagag

SEQ ID NO: 10003 - DNA, 201 bp, synthetic construct
  misc_feature 1..201: note = Description of Artificial Sequence: Synthetic polynucleotide
  source 1..201: mol_type = other DNA
tygayggttaaggaaagtttattagtttttygtatygtgggygaygggttaagattyggttttaaayggttagatttagtttttagtyggttgtygttttygttttaygtaggygygtttyggggttttttttttttttatygygygttygyggggttygaygggggyggagygattttyggaaggggygtggygatyggg

SEQ ID NO: 10004 - DNA, 201 bp, synthetic construct
  misc_feature 1..201: note = Description of Artificial Sequence: Synthetic polynucleotide
  source 1..201: mol_type = other DNA
agggggayggttagaygggatgtyggaagttaagggaygtagaggtyggygggtggyggygatggagaggatagattyggtttttagaggaggtygtgagygyggggtttgygtyggtyggaggagggattyggggggttgtaatatggttgttygggygtygttttttttttgttaagttagggttttggggagttgttg

SEQ ID NO: 10005 - DNA, 201 bp, synthetic construct
  misc_feature 1..201: note = Description of Artificial Sequence: Synthetic polynucleotide
  source 1..201: mol_type = other DNA
ttygtygygtttyggtygggatggatttataygttygatgagtttygygtyggyggttgygagygtygagtttttttttgttgyggttttagtygtttttygygygttyggtttygyggattaggatttttgggtttttyggttgagggygyggtygtttyggagaggtygagyggggaygggttygagatggygygggga

SEQ ID NO: 10006 - DNA, 201 bp, synthetic construct
  misc_feature 1..201: note = Description of Artificial Sequence: Synthetic polynucleotide
  source 1..201: mol_type = other DNA
tagttaggatagtataaaatttttttatygtttattttttgtaaaaaatygtggttttyggyggattttggagataggaggtgtaaagggygtttataygyggttygggttygyggtygagagttggggggatttggagyggggtygggtygtaagaagattttgattttgtttyggygttggggygygtgttaagggttc

SEQ ID NO: 10007 - DNA, 201 bp, synthetic construct
  misc_feature 1..201: note = Description of Artificial Sequence: Synthetic polynucleotide
  source 1..201: mol_type = other DNA
tgtygggttygaygtgtatagtttagygtttttttttattagttattgtttaggtttttygattttgtattygtyggaatgagagaaagtagtttttygtygtttagttttygggtagttgtttyggtygggttttgygttggtgagaaagttttatttagaggyggtygygygtaattgtaggyggygttttaggttygg

SEQ ID NO: 10008 - DNA, 201 bp, synthetic construct
  misc_feature 1..201: note = Description of Artificial Sequence: Synthetic polynucleotide
  source 1..201: mol_type = other DNA
ygygggtaaggaaagygygtaggttttgtagatttttttatttyggttttttggttyggttygttttttygtttyggggyggyggttttttgttttgtagygagygttygtaggagggaygttaggatttyggaygttatttttgaggtttttttgtatttgggtttttgatagtygggaataggtaggaggtggggygag

SEQ ID NO: 10009 - DNA, 201 bp, synthetic construct
  misc_feature 1..201: note = Description of Artificial Sequence: Synthetic polynucleotide
  source 1..201: mol_type = other DNA
gtgggaggtyggtagygygggygtygygttttyggaggagttygygttttttgaggagygygygtgttyggaagagttygyggygtygtttttygaatygygygtttggtttgaggatttygygtttttygaggagttyggggagttygygttygtattttyggggttyggggyggtgtayggggagtyggatttggtgtt

SEQ ID NO: 10010 - DNA, 201 bp, synthetic construct
  misc_feature 1..201: note = Description of Artificial Sequence: Synthetic polynucleotide
  source 1..201: mol_type = other DNA
agtgyggatttyggtygygtgyggttttgatygygtygttttatttttggyggggttaygtayggaygttatggttggygtygyggagtygggygatgygygyggattttttyggggttttgattgtttttgagttttttttgyggggggygtgygyggttygtttttygyggygttaygyggttttttttyggtygggga

SEQ ID NO: 10011 - DNA, 201 bp, synthetic construct
  misc_feature 1..201: note = Description of Artificial Sequence: Synthetic polynucleotide
  source 1..201: mol_type = other DNA
gtttgyggagggtgggattttatagtttgtttatttgtttaggttgagatttygtgttttagttttggatgttttaygggtttttygtttygggtagyggygtaygggaggagaagattttyggtttgtagttagatttttttttgagattttttttagtttaggtttagagttttgggatttttttygattttttttagt

SEQ ID NO: 10012 - DNA, 201 bp, synthetic construct
  misc_feature 1..201: note = Description of Artificial Sequence: Synthetic polynucleotide
  source 1..201: mol_type = other DNA
tyggttttttttttygyggggggtttygtttygygtttygttttttygggttgtagtyggtagtttaygtttagggagggtggagggaggaggagaggygyggagaggagggaggggagaggggagggaggaaggygagagaaagggagttgtttttatttyggattttttagagtttgtttggagygygtatttagyggt

SEQ ID NO: 10013 - DNA, 203 bp, synthetic construct
  misc_feature 1..203: note = Description of Artificial Sequence: Synthetic polynucleotide
  source 1..203: mol_type = other DNA
gygagyggttayggggtggggagtaaggggygygygggyggtaggtatggaayggaygyggygtatttygtttatygygggaygttyggayggyggtyggygygygyggttygtttygagttygagagggyggggagataatgtttgttyggyggggtagtttaggtygtaygttttygttygyggataygggtygtttttat

SEQ ID NO: 10014 - DNA, 201 bp, synthetic construct
  misc_feature 1..201: note = Description of Artificial Sequence: Synthetic polynucleotide
  source 1..201: mol_type = other DNA
tygtggagtygygttaggttayggggtttyggttagaygggagygttagtttttttttttgtttygatgtttttaaatttaggtttagttttttttttttygattygatgatatttttgggttttagaatgttgttgggggygggagatyggagaagaagtaggtgtayggggaggtgggtgttttgttttttgygaggag

SEQ ID NO: 10015 - DNA, 201 bp, synthetic construct
  misc_feature 1..201: note = Description of Artificial Sequence: Synthetic polynucleotide
  source 1..201: mol_type = other DNA
tttgggggggygggtyggatttgaaggttataggtttttttttgygtttattttttttgtaatttttatagtttttttygtygatttttttatgttttttygtttttttgttyggygttttttttyggtygygggttaattggttgtgatagttggagttttgggtagttgagyggtgttattgtaaattaggtaggygtt

SEQ ID NO: 10016 - DNA, 201 bp, synthetic construct
  misc_feature 1..201: note = Description of Artificial Sequence: Synthetic polynucleotide
  source 1..201: mol_type = other DNA
ttggaagggygggggyggtgatagyggtaggggygggattyggaggyggggygtttgtttaygtygtttagtagyggagggaggygyggttttagtttygygtttaggagtygtataggygttyggggtygtagtaggagtttttttagggygtttagygttgtatttaygagtygygygtygttttygtttagtgygttt

SEQ ID NO: 10017 - DNA, 201 bp, synthetic construct
  misc_feature 1..201: note = Description of Artificial Sequence: Synthetic polynucleotide
  source 1..201: mol_type = other DNA
tygtatttygttygtttgttttttatyggttaggttttgtygggtygtygyggtttyggygttttattttttttygggttagyggggggttgggagggggygaggaggaagggggtttttttttttttttttyggagggggtygtagyggyggtttyggtttttttttttttttatattttttttygtttttttttatttg

SEQ ID NO: 10018 - DNA, 201 bp, synthetic construct
  misc_feature 1..201: note = Description of Artificial Sequence: Synthetic polynucleotide
  source 1..201: mol_type = other DNA
tyggagggagggggtaaaggaagaaaaagaaagygygttyggaaagtyggtttgggttttgttaattattttgaaggtaaagtatttgtatttttttygtygaggttggttggyggygtygygttggaggggaggaggttygggaggaggaggagaaagagtagygggaggattygggttgggaggggagygtagggttgg

SEQ ID NO: 10019 - DNA, 201 bp, synthetic construct
  misc_feature 1..201: note = Description of Artificial Sequence: Synthetic polynucleotide
  source 1..201: mol_type = other DNA
tygtyggggagtygtaaagtttgayggaagaggttgyggttttygygttttagtygtyggttttygagtygtagtygggygtttttttgaygtagtygygygttttgtyggttttattygtttygygtayggatggtttttaagtggttygtygttaggtyggtaaatygtttttttagttgttgtygggygtygttygyg

SEQ ID NO: 10020 - DNA, 201 bp, synthetic construct
  misc_feature 1..201: note = Description of Artificial Sequence: Synthetic polynucleotide
  source 1..201: mol_type = other DNA
gyggygggaygttatttgygatygggattatgaggagttgttagattygtggggtyggtaaygagagtagtygyggtatttgttgagaggaaagagggagyggttyggygyggttggggygyggtagaggtttgttygattttyggttatgttattgttttgygtgygyggtgagtgygyggattgaggyggggaggyggg

SEQ ID NO: 10021 - DNA, 201 bp, synthetic construct
  misc_feature 1..201: note = Description of Artificial Sequence: Synthetic polynucleotide
  source 1..201: mol_type = other DNA
gygttagatttttttattatatttttttattttaggygattygttttggtttygggtgtttttagtttgygygggtygtttttagttttyggtggatattygtttttagttygtygttttttgttyggttttgygttttttggaatttttgggtttttagttttygtygtttttagaattgygtttgygtaataatggtta

SEQ ID NO: 10022 - DNA, 201 bp, synthetic construct
  misc_feature 1..201: note = Description of Artificial Sequence: Synthetic polynucleotide
  source 1..201: mol_type = other DNA
aattattagagaatttttttaaaaatatagattygatgaggagtggttttttygttttttttttgtgtygagaagggatttyggtygttaataataaagaygtttttygttttttttttttygtyggttygggttygtttttttygygttgyggttttyggtttagygtttttttttygagtygggttgyggygtttttaa

SEQ ID NO: 10023 - DNA, 201 bp, synthetic construct
  misc_feature 1..201: note = Description of Artificial Sequence: Synthetic polynucleotide
  source 1..201: mol_type = other DNA
ggagggtygyggagaygtaggygtttygggtygttygygttgtttttgtttgtttygtgygggagtyggggtttttggttttttggttttttggtttttgyggttygggygaatttagagygtattygtaygtyggtttyggtyggtttttagygttygggttttaygggtygygtttttaygyggygttttttagagatt

SEQ ID NO: 10024 - DNA, 523 bp, synthetic construct
  misc_feature 1..523: note = Description of Artificial Sequence: Synthetic polynucleotide
  source 1..523: mol_type = other DNA
ttgygttaagttttagaattatttagtttygtgtttgtygttyggggttyggtttygtttyggtyggygtttatttggyggtgtygttttyggaagattayggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggygaagyggtttyggygttgtygggttaggggtgtygttatygttattgtgygygtttagagtygtataygygttttgaggtagtgaggggttyggtatttt

SEQ ID NO: 10025 - DNA, 201 bp, synthetic construct
  misc_feature 1..201: note = Description of Artificial Sequence: Synthetic polynucleotide
  source 1..201: mol_type = other DNA
yggttygtattttttygtygttagttttagttttaaattyggyggtttagygggygtattatggtattggagtagygyggggagygygttyggagtttygyggttygttgygtttygttygggatttygttgygtygygygtttttttygyggttygyggggtygtttttgtatttttattttttttttygtttgtygtyg

SEQ ID NO: 10026 - DNA, 201 bp, synthetic construct
  misc_feature 1..201: note = Description of Artificial Sequence: Synthetic polynucleotide
  source 1..201: mol_type = other DNA
gttttygtttaagtgtggtttttttgggtttatattttattaggttagtaaggagggggatagyggggggyggggtaggtgttgggatttygggtaggtgyggggaaggtagggggyggggggggaaggggttgggygatgtaggtgttgggggtygggatagttgygggggtaggtaggtatygggaaggygggagggyg

SEQ ID NO: 10027 - DNA, 201 bp, synthetic construct
  misc_feature 1..201: note = Description of Artificial Sequence: Synthetic polynucleotide
  source 1..201: mol_type = other DNA
ygtagattttgggtttyggttttgttatttagggggattttttttaaygatgggatyggtgttyggagtggagtatggggagtgygttttygggagtyggygttggtyggatatgtgataattgtgggtygttggaggttygtttgygttgggatagggtttggattttaygtgygtygtttgtgtttygttagatygggg

SEQ ID NO: 10028 - DNA, 201 bp, synthetic construct
  misc_feature 1..201: note = Description of Artificial Sequence: Synthetic polynucleotide
  source 1..201: mol_type = other DNA
gggtyggtttygyggtygatttggggtatygygtyggggtgaggtttggygaggaggygaaggttgtaggygtgaggtgaaggtygtaggtyggtygggtygattttygttatgtaaatatyggtgagggggggggagggaygggggataagatggyggyggttyggygtttgttgtaggggaygatagagggggttgtyg

SEQ ID NO: 10029 - DNA, 201 bp, synthetic construct
  misc_feature 1..201: note = Description of Artificial Sequence: Synthetic polynucleotide
  source 1..201: mol_type = other DNA
ttttygygtttttttygygttttatatttatygttyggyggagggggtttagttygtagtygtygtygttatygtygygtttyggtttyggtgtaggtagyggtygtygtygtygagatagttgygygggygagtatttttaygtagtaagttygtttttttttygtttgtgygygygtgtgtgtttttygttygtyggyg

SEQ ID NO: 10030 - DNA, 201 bp, synthetic construct
  misc_feature 1..201: note = Description of Artificial Sequence: Synthetic polynucleotide
  source 1..201: mol_type = other DNA
gygggggttttttaygtggyggaggtttttyggtttgggggttaygggttyggaggaatttgtttggaagttttttattayggtagagttttttggagttygtttygtgttygataaggggagttttagatttgatttttttagtagtttygyggggyggggtygagaaggggygggygggyggaggaygttggygggaga

SEQ ID NO: 10031 - DNA, 201 bp, synthetic construct
  misc_feature 1..201: note = Description of Artificial Sequence: Synthetic polynucleotide
  source 1..201: mol_type = other DNA
aatgtgattatagttaatatatgatttttttagygttttagttagtgttttttttgatttttgttttttggagaggaggatggaagggaggggttyggtaygttgttggtattttgttgtgttttgtagttttttttygggatatttgggtttatatagttttttagtttatataattggtgtagattttttgtgtggaga

SEQ ID NO: 10032 - DNA, 301 bp, synthetic construct
  misc_feature 1..301: note = Description of Artificial Sequence: Synthetic polynucleotide
  source 1..301: mol_type = other DNA
tttttttttaatttttggyggygggyggttggggaagtagttttgtggtttttyggygggtgaggtygagatagagattaatttttaggyggygttttggygttgagttygygttgaataagattttttygtagttttgygtttygygtygggtgaaggggygtgtttttgtaggygttyggggttyggtttggagttggyggtyggtaygtygtttttggygttttttgttaattaagagaaatayggttaaatgagtgygttgggatagaaatttatagttaattaaggttttattygt

SEQ ID NO: 10033 - DNA, 223 bp, synthetic construct
  misc_feature 1..223: note = Description of Artificial Sequence: Synthetic polynucleotide
  source 1..223: mol_type = other DNA
gygggggyggyggyggtygtgagtttygatgaggttygagygttttyggtygygyggtagygttttyggttygatggagatttygtygtgggatttagttygtaaygattygttgtygtttaygttgatttyggtygtgtttttttaygtgaagtttggttttatygtygtttatatygtgttttaygygttgtttttygtgtttatttaygtgtagttttgg

SEQ ID NO: 10034 - DNA, 720 bp, synthetic construct
  misc_feature 1..720: note = Description of Artificial Sequence: Synthetic polynucleotide
  source 1..720: mol_type = other DNA
gatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttg

SEQ ID NO: 10035 - DNA, 1683 bp, synthetic construct
  misc_feature 1..1683: note = Description of Artificial Sequence: Synthetic polynucleotide
  source 1..1683: mol_type = other DNA
tagtggtagtgttgagtttaggaataygygyggagttygyggygattttygyggtygtttagttttygyggyggatttyggygygtaggagttattgggtygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggygatggtggaagttttgggttggagggttgggagtttattgagtttygtttaatttgatttatttttttttygtttttygttttttgtattttttttyggt

SEQ ID NO: 10036 - DNA, 233 bp, synthetic construct
  misc_feature 1..233: note = Description of Artificial Sequence: Synthetic polynucleotide
  source 1..233: mol_type = other DNA
tttygttygggtygttyggttyggttgtgttttgttyggttagggygggygggttygtttttttttyggtyggygttttttttttggtttttttttttttygygtygttygttttygtttttttygttttttyggygtyggygtagttttygtgaattygggygtattatttygggtgtttyggtttggggatygttgtygtttyggtygttgtttttttaatttttttgttt

SEQ ID NO: 10037 - DNA, 213 bp, synthetic construct
  misc_feature 1..213: note = Description of Artificial Sequence: Synthetic polynucleotide
  source 1..213: mol_type = other DNA
gattgygygtgygtagagtaygtyggygyggtttygggattttygygataattgtattgagataaagtgtggtaattygagttggttggtgatttattttyggygaggggttygygtgtgggttaygtygtygtttttatygggaaagyggggattagtggggggggtttagttgtagggtagtgggaggatgttgtttgttttgggggaagg

SEQ ID NO: 10038 - DNA, 236 bp, synthetic construct
  misc_feature 1..236: note = Description of Artificial Sequence: Synthetic polynucleotide
  source 1..236: mol_type = other DNA
ggtagygtygtttgygtygygtttagtaygaagagttygttttagtttaggygtagtagygttatttggtyggttatyggtagttyggggaagaagggygygtggygygtttattttayggtgttgaagagtagtygygtygttagttygtataygttgtygatgtttagtatygygttygtygygtygttttttgygtygaagygttyggtygtygtagggtagggtttagygyg

SEQ ID NO: 10039 - DNA, 233 bp, synthetic construct
  misc_feature 1..233: note = Description of Artificial Sequence: Synthetic polynucleotide
  source 1..233: mol_type = other DNA
gagggtggggttttaaaygttatttaattagygaygttgggttgggaattgtttaattaggtaygtagtttgagyggagaggayggttttygggatgtggygggatttgttygtttttttgtttttggttgtygttggaatttygggtttygtttttattgttttgtgttttttgtttttagaggtttagtttttggttttgtgatttgtaggtattgggaatttatagttaa

SEQ ID NO: 10040 - DNA, 737 bp, synthetic construct
  misc_feature 1..737: note = Description of Artificial Sequence: Synthetic polynucleotide
  source 1..737: mol_type = other DNA
aatgaygtygtaaataatagtattaattattatygttygtagttttygygtatagaggttttaggttttyggttttaygtggatygatttygttyggtagygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtygaagaaggaattggagggtygggttgggaaggtttgaagygggtatagtttttaggttggggagggtygaggggagaattyggagtttgagtygggygag

SEQ ID NO: 10041 - DNA, 308 bp, synthetic construct
  misc_feature 1..308: note = Description of Artificial Sequence: Synthetic polynucleotide
  source 1..308: mol_type = other DNA
tttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgt

SEQ ID NO: 10042 - DNA, 1100 bp, synthetic construct
  misc_feature 1..1100: note = Description of Artificial Sequence: Synthetic polynucleotide
  source 1..1100: mol_type = other DNA
ttggttttaygtagygtttgtagattgtgagttygtagggtagygttatyggtttatgtagtagtygtyggtagygygggtagtygagtaggtygyggggygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygygtyggtatygyggtatttgtttttttttagaggtttggtygtttttataatttgtggtttygtttaagtaagaatttaggaaaagttattaaaygtatta

SEQ ID NO: 10043 - DNA, 214 bp, synthetic construct
  misc_feature 1..214: note = Description of Artificial Sequence: Synthetic polynucleotide
  source 1..214: mol_type = other DNA
ggygagagtaaaaaaaaaaaaaaaaaaaaaaaaaaaaattttaattgtaaatattatttggaggtgggygagggygyggygtgygygyggyggygggtggygggyggygygggygtttttgyggggattttyggttttttagygygttttagtggaygttttgtttttygttggtttttygtgttygttataatttgtaatatattattttttt

SEQ ID NO: 10044 - DNA, 582 bp, synthetic construct
  misc_feature 1..582: note = Description of Artificial Sequence: Synthetic polynucleotide
  source 1..582: mol_type = other DNA
ttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagtt

SEQ ID NO: 10045 - DNA, 203 bp, synthetic construct
  misc_feature 1..203: note = Description of Artificial Sequence: Synthetic polynucleotide
  source 1..203: mol_type = other DNA
ggygatattygygttagttttygggayggttgggttygggttggtygtygattttygattttttattagatgtttggtagagttyggygygttyggagttygygttttttagagggaaggggtygygygtygtygyggyggttttgaggttgayggtygggaggtgaaaggtyggagtgyggggttaggaygttttttggagg

SEQ ID NO: 10046 - DNA, 823 bp, synthetic construct
  misc_feature 1..823: note = Description of Artificial Sequence: Synthetic polynucleotide
  source 1..823: mol_type = other DNA
ygagttattygtatttttttttaggagttatagttaggttagaagagtgyggagggayggggttygggaagagtagggaatttttagagttygtagttaaygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggygttggttatgggygagggtatttgtgagaagygtygggaygtygagtatggygttagttyggagtaggttgtaggtaaygyggtttggaataagtagttg

SEQ ID NO: 10047 - DNA, 293 bp, synthetic construct
  misc_feature 1..293: note = Description of Artificial Sequence: Synthetic polynucleotide
  source 1..293: mol_type = other DNA
tygygyggtttttataatgtagggatttttttgagtggtggtygttttygttttagttttyggttattygtagttttatatygggttattggtttattatygagatagttagygagtttaggyggtttttgtagygttgggagaggaatgtgygygaaattaattagagygaaattagtyggaggagtyggtygaggtgtaggtgtaggygtagtttygtttagaattttttygttatatttaagggagttggaagttygggagggtgttgttttttttttttaggaatagag

SEQ ID NO: 10048 - DNA, 262 bp, synthetic construct
  misc_feature 1..262: note = Description of Artificial Sequence: Synthetic polynucleotide
  source 1..262: mol_type = other DNA
yggaygygttgattggttttaggggaagygggaggygagaataatggtttttttttttygttaaaagggagyggttgtygggttyggggatagggaygygygtgtagggygtagagttgggtygagtygtygtyggygttaygygagtttygtagtygtygygttygggtaatgggtygggggtattgagggtygtyggggtygagygyggaggggggatygagttagtgtygtgttttygggtygygttaatatgtttygc

SEQ ID NO: 10049 - DNA, 240 bp, synthetic construct
  misc_feature 1..240: note = Description of Artificial Sequence: Synthetic polynucleotide
  source 1..240: mol_type = other DNA
tygttgyggggtggagggattygygttttttagtttttygggttygggtygyggggatygtgygygygtttttttttygggtaaggtygggyggygggygygtygyggtttttggggttttygtttttttgttygttatygtttgygggagtttttggtttggaggggttyggggygygttggygattgygggttyggygataggggyggttggtggygggaggatagtgggaggaaggt

SEQ ID NO: 10050 - DNA, 1240 bp, synthetic construct
  misc_feature 1..1240: note = Description of Artificial Sequence: Synthetic polynucleotide
  source 1..1240: mol_type = other DNA
agygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtc

SEQ ID NO: 10051 - DNA, 222 bp, synthetic construct
  misc_feature 1..222: note = Description of Artificial Sequence: Synthetic polynucleotide
  source 1..222: mol_type = other DNA
gggygatttgttgttttygagtgtttttgggttgygttttttttttttatttgggyggtygygttaagygtagaggtygygggygtttyggggttagaggygttttyggttygggttatggygttyggygtygggggygygaggagyggtttatttagttagattttttatttygttatygttattagatattattatygttgtgtagtgtgggtttttatt

SEQ ID NO: 10052 - DNA, 714 bp, synthetic construct
  misc_feature 1..714: note = Description of Artificial Sequence: Synthetic polynucleotide
  source 1..714: mol_type = other DNA
tttagggaaagtttttgaaagtataattyggaaaatttagtaatttttaaaaaaaaatggtttttygttgttataagttttttttttaagatttagggttygtagtagaatattttgatttaaaataaaaatattatgataaaaatattttaggaggtagtyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtygtgtttgtgttaggttttttaygttgtgttttagggttttagtgttyggygygtygggggttgtatygttagttatttggggtaggaaaaaggaattata

SEQ ID NO: 10053 - DNA, 1216 bp, synthetic construct
  misc_feature 1..1216: note = Description of Artificial Sequence: Synthetic polynucleotide
  source 1..1216: mol_type = other DNA
aagttttagaaaygttttyggaaagttttttttaatgggaagygatttygtygttgagttaagygttygaattttttttttygyggtagggatatyggttygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyggtygygtygyggtaggaggtgtgggaggtagygaggggaagtygaggtaaatttggtggygtgggagattttayggggtttggggaattttagggtaag

SEQ ID NO: 10054 - DNA, 207 bp, synthetic construct
  misc_feature 1..207: note = Description of Artificial Sequence: Synthetic polynucleotide
  source 1..207: mol_type = other DNA
agtttttygtaaatttygtttttttygtttggtayggtttttttgtatygttgtgtttygtttttaggtttttgttygttaagaatgtttgtttygggggygygttygttggttaggaatttgtyggtagttttygggaatttttgaggatgyggaggtgggttygagagttgyggtttygatgtyggggtgggagttaggtaggtc

SEQ ID NO: 10055 - DNA, 253 bp, synthetic construct
  misc_feature 1..253: note = Description of Artificial Sequence: Synthetic polynucleotide
  source 1..253: mol_type = other DNA
aygtttagggataaattgggagtygtgattgttaggtygygyggaggttgttttggtygtttttgyggttaggtgaaggygtagaggtagggaggtygggygagygtaggygggyggagagtagattaygyggaagaggtygagagagaaagyggggtattyggtygggggggttatttataagggaygttgggtaygaaggaggttggggygaagatgagtttaggggttgggttgagagygttgygtagtc

SEQ ID NO: 10056 - DNA, 209 bp, synthetic construct
  misc_feature 1..209: note = Description of Artificial Sequence: Synthetic polynucleotide
  source 1..209: mol_type = other DNA
ggayggtttgtgagggatgygtygtttattgtttygygtygtttgatygttttygtttygattygyggtgygttatagtygggttygyggtygttttygtygygttgtygttyggtygtygygttygyggggtygygttyggtayggttatgtggatttttayggaggaggagaaatayggygtaggtaggtgaggtttaggtttggtc

SEQ ID NO: 10057 - DNA, 225 bp, synthetic construct
  misc_feature 1..225: note = Description of Artificial Sequence: Synthetic polynucleotide
  source 1..225: mol_type = other DNA
ygttyggtttygtttygtaggttgtaggyggttttggagggggygttttygtygagygygygtttygygtygtygtttyggattttttttyggygtygygygggtaggttygattaggyggtygygggtttyggttttyggttagttttttagggttygyggttygtttygtttygygygttygtttygttgygtaattygatttaagttggaagtygatygtag

SEQ ID NO: 10058 - DNA, 1133 bp, synthetic construct
  misc_feature 1..1133: note = Description of Artificial Sequence: Synthetic polynucleotide
  source 1..1133: mol_type = other DNA
aaggagagttggaagggttygtgtagtaggatagygggyggaagyggggygggygagygyggggtygtyggtyggtagtyggagtagttgtygyggygttygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygygttttgtttygtaggtgagyggttgygtttttttattgtttttttttttttygygtttygtyggygttgaaaagttatttatttgygtygtttttttttt

SEQ ID NO: 10059 - DNA, 478 bp, synthetic construct
  misc_feature 1..478: note = Description of Artificial Sequence: Synthetic polynucleotide
  source 1..478: mol_type = other DNA
yggttygggaggyggaaggtygyggatttgttygatagaagagtagatgaggggagatygaggaygttygggttyggggagtttaygaggaggttaggatygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttygttygggttttttaagttgttagtygygttygttttygggtttttygttttttttttygygygtttttttttttagyggtygtyggatttttttagttta

SEQ ID NO: 10060 - DNA, 201 bp, synthetic construct
  misc_feature 1..201: note = Description of Artificial Sequence: Synthetic polynucleotide
  source 1..201: mol_type = other DNA
tygtaygyggagtttataagttgtttgtgtygttattttttyggttttggtatygttagtattttttaggaattttttaaattygttttayggtgtagaayggtaattgtatygagtttttgtgttaattagtattttygtaatatygttagtyggttttttttttgttataatatattaaaaygtgttaaaatatattaa

SEQ ID NO: 10061 - DNA, 208 bp, synthetic construct
  misc_feature 1..208: note = Description of Artificial Sequence: Synthetic polynucleotide
  source 1..208: mol_type = other DNA
gatgagygtygtgtagtatttttggttygygttgtttgttygtgtyggttataggttgtaggttagtagggygagygyggygagtygggtagggttygttygtttygygtagtttatygttttttyggtagtygtygttgttygyggatygggtttyggggtyggygtttagaggyggggygggygyggttygggyggyggygggagc

SEQ ID NO: 10062 - DNA, 210 bp, synthetic construct
  misc_feature 1..210: note = Description of Artificial Sequence: Synthetic polynucleotide
  source 1..210: mol_type = other DNA
atttygtataygtgtataaggtgttgaaataggtttatttygatatyggtattttttttaaagttatggggattatgaatttttttgttaaygatattttygagygtatygtyggygaggtttttygtttggygtattataataagygttygattattatttttagggagatttagayggtygtgygtttgttgtttttyggggagttgg

SEQ ID NO: 10063 - DNA, 229 bp, synthetic construct
  misc_feature 1..229: note = Description of Artificial Sequence: Synthetic polynucleotide
  source 1..229: mol_type = other DNA
tggtttatttgagtttaggggtttgagattaggatgattaatatggtgaaattttgtttttattaaaaaatataaaaattagtygggttatggtggttgaygtttgtaattttagttatttaggaggtygaggtaggagaattatttgaatttaggagyggaygttgtagygatyggagatygtattatygtattttagttygggygagagggagattttgttttaaaa

SEQ ID NO: 10064 - DNA, 209 bp, synthetic construct
  misc_feature 1..209: note = Description of Artificial Sequence: Synthetic polynucleotide
  source 1..209: mol_type = other DNA
aggygggggagagagatgaygttggyggaygtggttagygygggggtygggyggtgygttgtaggttatttgtyggygttttgagatttaggagttttygygttttygygtgggttttatagggtyggtttatagttttaatatagtagttgaatttttttygttgygtttttttttttttggaggggaatgttagaagagagagagag

SEQ ID NO: 10065 - DNA, 255 bp, synthetic construct
  misc_feature 1..255: note = Description of Artificial Sequence: Synthetic polynucleotide
  source 1..255: mol_type = other DNA
gaaggggtttggagttttttttttggggtattgtgttgggattttgaggattggggattyggagggagggtaggygtgtttttaattygttgygtyggaayggygtttgatgagyggygggttyggataygaggggayggggtygatttgtgggyggggttttggygtygtattaaaatygygtggggyggaggtyggtagaggtygygtagygggtttagggtagggagtggttttgattygttgyggaataat

SEQ ID NO: 10066 - DNA, 297 bp, synthetic construct
  misc_feature 1..297: note = Description of Artificial Sequence: Synthetic polynucleotide
  source 1..297: mol_type = other DNA
aggtttygtttattygaygtaatttgttygtttttttttatttttygaagggtggagtttgaggtttygtttttaagyggttttttttyggagtgtttggyggttagtagggyggggtaggaggttgggagagggaygggtgygggggtgggggagaggaagggagyggttaygtgtgaggggyggttygaggttaygtgayggagygtyggagyggagggagtyggggttgggagtttttttgagggaagaggagtggagtaggggggaygyggyggyggygttgataatggtgag

SEQ ID NO: 10067 - DNA, 232 bp, synthetic construct
  misc_feature 1..232: note = Description of Artificial Sequence: Synthetic polynucleotide
  source 1..232: mol_type = other DNA
gtgagttggttggaaagagggggyggagtgygyggagttagagtygttatygttgtygtagttgtygttattgyggygtttgggttgagtyggagggaggygggaggaygygtaggggyggtygtygtygtygttaggttatyggggygaaaatgyggtygttgtyggaggttygttaatttttyggggtggaagaggaggaggaggaggaggaaggggtttggagygatta

SEQ ID NO: 10068 - DNA, 247 bp, synthetic construct
  misc_feature 1..247: note = Description of Artificial Sequence: Synthetic polynucleotide
  source 1..247: mol_type = other DNA
tygygttygtagtygygtttttgttttttygattttygtatttttatttggttyggttttttygtttttttttyggtttttttttttaggatatttgtgtygttttattttttttattatataygtattttttattttaattttttygtttttttgttttttttttttygtyggtttttttttttygttgttgtttygagagttygatgtgggagggaaggygygggggaggggaggtygygaaggg

SEQ ID NO: 10069 - DNA, 292 bp, synthetic construct
  misc_feature 1..292: note = Description of Artificial Sequence: Synthetic polynucleotide
  source 1..292: mol_type = other DNA
gtttttygagttttttgyggygatttygatttattttygygggtgyggggygyggattygttyggtttagtttttgttttttaggygtttttttttttygygatttgtttyggtygtattygttttygttttagtaygygaygttgttyggygygatttttgttttttyggtttagttttatygttgttttygatttaattttagttgaaygttygtagttttagttttattttyggtttagttttagygtttttagttttattttyggttttagttttagttttagygttt

SEQ ID NO: 10070 - DNA, 201 bp, synthetic construct
  misc_feature 1..201: note = Description of Artificial Sequence: Synthetic polynucleotide
  source 1..201: mol_type = other DNA
gtagttyggttaayggaygggttagttggttttttttaggggtagttttgttttttttttygtttygttttttttttttttattatatygggttgtaattygagtygtygagttattgtttttttttyggatttttttyggaggttttgyggttygggttttygygttttgttgttttatgtagttttgagttttatagta

SEQ ID NO: 10071 - DNA, 201 bp, synthetic construct
  misc_feature 1..201: note = Description of Artificial Sequence: Synthetic polynucleotide
  source 1..201: mol_type = other DNA
ggttaygygtgtttttggygygagtgtgyggggttaggtygggagggygtgygyggatygggygtgtttaygygyggtagggaggggttaygagggtgygygygtttttggygygagtgggaagtgtggggattyggygggttyggtgtgaggggygtgtttttggggygagagtggggagtgagtgtgaggagtaagggt

SEQ ID NO: 10072 - DNA, 201 bp, synthetic construct
  misc_feature 1..201: note = Description of Artificial Sequence: Synthetic polynucleotide
  source 1..201: mol_type = other DNA
gggygyggtygggtaggttggggggtaggtaggggtygttttygyggggygggaatttygygtttttttttttygagttttattttttatggtaaagyggygtggggyggyggggyggagggagtygagggggyggggagggyggaygggyggaggggaygggaggtttagyggtttygggtttygttggttygggygtyg

SEQ ID NO: 10073 - DNA, 201 bp, synthetic construct
  misc_feature 1..201: note = Description of Artificial Sequence: Synthetic polynucleotide
  source 1..201: mol_type = other DNA
attttttttttttatttttttttttttttttttattgttttttttatttttttttttttttygtttttttttttggtttttttttttttygttygggattyggggggaggygygttgggtggttyggtagtygggggygggyggtagtttgtaggygtaattggtatgtaygtygttgtagttgagatygtttaataaagt

SEQ ID NO: 10074 - DNA, 201 bp, synthetic construct
  misc_feature 1..201: note = Description of Artificial Sequence: Synthetic polynucleotide
  source 1..201: mol_type = other DNA
tygttttygttaaaggtttttttaaggggtygttttagggtttygtttygtgtttygtttyggygtttatttyggygttygtttttttttttttttgttgyggtttyggtaggggttgttgyggygatttaggttgttgyggttttagttttattagttgttgttgttttttaaggagaygtygtygatagyggagtagtg

SEQ ID NO: 10075 - DNA, 201 bp, synthetic construct
  misc_feature 1..201: note = Description of Artificial Sequence: Synthetic polynucleotide
  source 1..201: mol_type = other DNA
gtgyggtyggggygttgttyggtagtgyggtgtttaygggattgataggtaggtaggtygygggttgggattyggatattaaagtaaaagtatygttgggygtyggaggagtygyggggtttttattttttttttgattgatttttaaattttaatttgtatttttttygtygtttygttttttttttttygatttygttt

SEQ ID NO: 10076 - DNA, 201 bp, synthetic construct
  misc_feature 1..201: note = Description of Artificial Sequence: Synthetic polynucleotide
  source 1..201: mol_type = other DNA
tatygygtygtgygttygygttyggtygttaggtgttttagtagttygatygtygagatgtttagttygtyggggtttygggygttatggttttgygtygygttgtgygtttttyggagggtyggyggygttttttagttyggttyggggtttatygtttgttyggttttttgttattgttaggaggayggtattatgttg

SEQ ID NO: 10077 - DNA, 241 bp, synthetic construct
  misc_feature 1..241: note = Description of Artificial Sequence: Synthetic polynucleotide
  source 1..241: mol_type = other DNA
ttgygygttttggyggtaggaggyggggtygggggyggggygtgagttggtyggggyggggtttatggaggggygggatygyggygttttataagtattgyggagygaggygygygttyggttagagagygagygygtaayggyggygayggyggygattttatygygtattttgttaggttttyggygtttagygttttaygygttttygygttttygygttttygygttttttttttyg

SEQ ID NO: 10078 - DNA, 201 bp, synthetic construct
  misc_feature 1..201: note = Description of Artificial Sequence: Synthetic polynucleotide
  source 1..201: mol_type = other DNA
ggyggtaggyggygyggygggttgggygyggyggtggttaggtyggtgyggttgtagtttatgtatagygtgttagggttgttttgttygggtagtyggtygtagygtatgyggtygggttaggygaagtygtattggygtatgagyggygygtagtyggttttggygygttygtatatygagyggtagggyggtagyggt

SEQ ID NO: 10079 - DNA, 201 bp, synthetic construct
  misc_feature 1..201: note = Description of Artificial Sequence: Synthetic polynucleotide
  source 1..201: mol_type = other DNA
aagtggggtgaaaatgattttagtgaatagtttagttttttgggatagtggtttggtatttttgaygtgggagtggygtttgttttgatttaatttggatyggtttagggataatatttttttyggagtagtygttttgtttygtttygagtagtttagttgygttttgtatgatygaattggatattttttatttttttt

SEQ ID NO: 10080 - DNA, 201 bp, synthetic construct
  misc_feature 1..201: note = Description of Artificial Sequence: Synthetic polynucleotide
  source 1..201: mol_type = other DNA
ttygygtttgtttygtattayggagtygggtttttagagtagtaaggttattaggtggyggtgttggygtagtaggyggagygtygggtgygyggggtygygtttttggttttygaaggtgatgaagatgggtttgygggtgagttttagtagtyggtataggttttttttgyggggygggatygttaggggggtgggtgt

SEQ ID NO: 10081 - DNA, 201 bp, synthetic construct
  misc_feature 1..201: note = Description of Artificial Sequence: Synthetic polynucleotide
  source 1..201: mol_type = other DNA
ayggttgggttttaggagatattyggaggggttygygggttyggttyggttttttygttggggggttattagtyggtyggtagygagatatttagaggttygtttttttatygygttgttatagtaayggtttggtyggttgygtttygggtygttygttttatttygygggttygttttgagttagtgattttagggatt

SEQ ID NO: 10082 - DNA, 201 bp, synthetic construct
  misc_feature 1..201: note = Description of Artificial Sequence: Synthetic polynucleotide
  source 1..201: mol_type = other DNA
tttagatggttttaattattggaggaaaaaagyggtttttttggtatgygtgaaaagtyggagttgggagagtttgggaaaagttgtttgtatygttygtyggtttttaaataaatygatgagttttttttttttttttagttttygggtttygggggagttttataaaatttaaatgaaatttaaagaagttatttttgg

SEQ ID NO: 10083 - DNA, 201 bp, synthetic construct
  misc_feature 1..201: note = Description of Artificial Sequence: Synthetic polynucleotide
  source 1..201: mol_type = other DNA
ttataaagtattagtggtgttttttygaggaatttaagatttttyggtyggttgttaagtygtyggaattttagtaggagaggaaggtttatttttttatygtatggygatgttygggagattggagaagtttaggtaggtttggaagttaattttyggtatatagtagttttygggaatgtagagttttagagtaagatt

SEQ ID NO: 10084 - DNA, 201 bp, synthetic construct
  misc_feature 1..201: note = Description of Artificial Sequence: Synthetic polynucleotide
  source 1..201: mol_type = other DNA
tagtagagayggggttttaatatgttgtttagggtggtttygaatttttgagtttaggtaattygtttattttatttttttaaagtattgggattataggygtgagttatygygttyggtttgatagtttttttagaatgaagtttgtttyggaaaaaagagttttggttagtgttttttttggggattagyggaaagtat

SEQ ID NO: 10085 - DNA, 201 bp, synthetic construct
  misc_feature 1..201: note = Description of Artificial Sequence: Synthetic polynucleotide
  source 1..201: mol_type = other DNA
aggggagttgaggggyggagttatyggggygygttttygyggttgygttttttttygtyggggagygygggtaygtaattyggagggtgttgggtyggttyggagtaygygagtagygggaggagggatyggggaatgattgayggaggygggtygtagaggtygttgtgtttygtyggttygtattyggtyggagtgtgc

SEQ ID NO: 10086 - DNA, 201 bp, synthetic construct
  misc_feature 1..201: note = Description of Artificial Sequence: Synthetic polynucleotide
  source 1..201: mol_type = other DNA
ggttttygttttttttgtaggyggattygttygtttttaggtyggattygygttygggatagggattyggtygagtygagtygtygygttagygttgygtygtyggtyggtgygtttagyggatyggagttgygygyggaatygtgttgtttygtttygttttattygtgagggtgagtaygyggyggyggtgygyggggg

SEQ ID NO: 10087 - DNA, 201 bp, synthetic construct
  misc_feature 1..201: note = Description of Artificial Sequence: Synthetic polynucleotide
  source 1..201: mol_type = other DNA
yggggagggaggttttyggaatttygagagagtattygtgtttygygggtttygtgtttygttttygggtttttttttttttaaygtaggggatttagttyggggtagtgtygggtattggygttggygtttygtttagttttgygattttttttygtttygttttttttygtttygtttygttttttttygtttygtttt

SEQ ID NO: 10088 - DNA, 239 bp, synthetic construct
  misc_feature 1..239: note = Description of Artificial Sequence: Synthetic polynucleotide
  source 1..239: mol_type = other DNA
agagggygagygagagagagatatatatatataygtataygtataygtaggttatatgaatgggaggyggtagttaattttaygaggtyggygagtygygyggygtattggygttgggagtagggtygtatttyggygygggggggygttaygtaggtgatgggygttttttygggggttaygygyggtygtttttttattttagtttyggtttttttgtttttttttttttttttttt

SEQ ID NO: 10089 - DNA, 201 bp, synthetic construct
  misc_feature 1..201: note = Description of Artificial Sequence: Synthetic polynucleotide
  source 1..201: mol_type = other DNA
tttttygtttttatttatttttttttattttttttttttttttttygttagtttygtatttattttttttatttygtaatttttttttgtttttatttatyggggttatggtygtagaagaggtattgtagayggtggattattataagattgagatagagaggttaattaaggagtttayggagattatttaygagaaga

SEQ ID NO: 10090 - DNA, 201 bp, synthetic construct
  misc_feature 1..201: note = Description of Artificial Sequence: Synthetic polynucleotide
  source 1..201: mol_type = other DNA
ttgtyggggagaatatgtattaggtggttgatggttttgtggatgtggtggtttgtattttggtgttgtgttttgtgaagaattaggagyggatttttygygaggtgtgtagagtgttgagatyggtgagtgaaagggtgtgaggaggattagttagtagtagttattattatagagggtaggtttgttaattttaggtgg

SEQ ID NO: 10091 - DNA, 201 bp, synthetic construct
  misc_feature 1..201: note = Description of Artificial Sequence: Synthetic polynucleotide
  source 1..201: mol_type = other DNA
gaggyggaatttaayggaagtgaagaaaagattaaygggaaagaaggaygagtaygyggtttygggatagatttttaaagtttttttttgygttttttggyggtyggagggggagtagygyggataygtttttyggttaatygttggttattaggttggagtggggtttttttttgttgttttttatgagattattgtttt

SEQ ID NO: 10092 - DNA, 201 bp, synthetic construct
  misc_feature 1..201: note = Description of Artificial Sequence: Synthetic polynucleotide
  source 1..201: mol_type = other DNA
gygattaygggtttyggygaagatgygtygtttgagygttygygyggttttygttyggggygggygtgatttttgttgaayggagattttttttttttttygatttyggayggygtaggtyggygttaggatagtttttatygatagygtttttttttattyggagagaggtatygatttttaaggagggtttygttaggt

SEQ ID NO: 10093 - DNA, 201 bp, synthetic construct
  misc_feature 1..201: note = Description of Artificial Sequence: Synthetic polynucleotide
  source 1..201: mol_type = other DNA
tygttttygtygttyggggtaggygygtygatggygtttttgaggtgaygtygtttatatygggttttttygggggyggaggaaatatttatgaatttttyggtagttttttttgtygggygttaggtaagtagyggtttygggygyggyggggygtygygggaayggtgtatattggtygaaatttattgttttttaaga

SEQ ID NO: 10094 - DNA, 201 bp, synthetic construct
  misc_feature 1..201: note = Description of Artificial Sequence: Synthetic polynucleotide
  source 1..201: mol_type = other DNA
ttygttatttggggygtttggggggttttggggygggggaggygggggttttgtttaatttygttattgttattatyggttaggtygyggtttggtaattygtgaataggaggtagggttgtagggygtgagggatgatgataaggaagtyggaggagtagyggyggtagyggagagtttattttggatgtaaatggtagg

SEQ ID NO: 10095 - DNA, 201 bp, synthetic construct
  misc_feature 1..201: note = Description of Artificial Sequence: Synthetic polynucleotide
  source 1..201: mol_type = other DNA
atttygygttttgygttttaattaggattgtttygygygtttttgagtttygggtttyggttyggatttgtagttttttaggtggttgggaaggtaggtgygtygttgttttyggygygyggygtttygygaggtttttagttttygttttggtggattttygttgggtgggagtygggagtggaggyggtygttttaggg

SEQ ID NO: 10096 - DNA, 201 bp, synthetic construct
  misc_feature 1..201: note = Description of Artificial Sequence: Synthetic polynucleotide
  source 1..201: mol_type = other DNA
ygattyggtygtgagygtgtttygttgtagttygttgttygttaggttygggtggtagygtaggatgtttttttggtttgyggagaagtatagatatyggygggagygygttaatygygttygtttygtatygygtattygagggggygygtaggtygygttyggtttttttgtttygtttygtttygttyggttttaaag

SEQ ID NO: 10097 - DNA, 201 bp, synthetic construct
  misc_feature 1..201: note = Description of Artificial Sequence: Synthetic polynucleotide
  source 1..201: mol_type = other DNA
yggtttgggaaggtttyggtttttyggttgyggttttagttyggayggygtygygtaattttgttatttttttggtttagtttyggttataggaggatttygygggtaaygygyggagtttttggtatttttyggyggtgttttttgttgtttgttyggggatygatttygtatgtttttaggttgatttgtttaagttyg

SEQ ID NO: 10098 - DNA, 201 bp, synthetic construct
  misc_feature 1..201: note = Description of Artificial Sequence: Synthetic polynucleotide
  source 1..201: mol_type = other DNA
gtaatttyggyggagtyggygtttttgggtatttttggttttygygtttyggtygtayggtgattattygggaggggatttygggygtttygtaatttttyggttttygtgggttttygggtygtttygtttttygtygtygygtatttttygygtttttyggttttyggtgtyggttttygtttygygtagtttygagtt

SEQ ID NO: 10099 - DNA, 201 bp, synthetic construct
  misc_feature 1..201: note = Description of Artificial Sequence: Synthetic polynucleotide
  source 1..201: mol_type = other DNA
aggaagttygaggtyggggygttattttaagggttttttygtttttttttygagggtagagaggygttygygttyggaygtattgygggaatatttggagygtyggyggagttyggttgttttygygggagggagttygaygygtatttttgggattyggattyggygttygygtttygggayggatttttgtttyggttg

SEQ ID NO: 10100 - DNA, 201 bp, synthetic construct
  misc_feature 1..201: note = Description of Artificial Sequence: Synthetic polynucleotide
  source 1..201: mol_type = other DNA
tygtttgtaggttgtttygggtygagtyggagygaygttgtygygtatttgggtagttttygggggtygygttgtgttayggtyggggtygttgygattgyggygtttgtatttgttaygtgattgagtygggtatgtttttygggtttttgtgtgagtgttatgagtgggtgtgygagatttaygaygggagtatttgtg

SEQ ID NO: 10101 - DNA, 201 bp, synthetic construct
  misc_feature 1..201: note = Description of Artificial Sequence: Synthetic polynucleotide
  source 1..201: mol_type = other DNA
taygtttggggyggtygggggyggggtttggttggaattgaygygtggagtttyggtggagggggyggggtttggttgggtygttgtttatagyggttttyggggtttggaggttayggggttyggaggttayggggttyggaggttayggggttggttgtgtggggggtttaggggygtagagtggttaagtagyggttt

SEQ ID NO: 10102 - DNA, 201 bp, synthetic construct
  misc_feature 1..201: note = Description of Artificial Sequence: Synthetic polynucleotide
  source 1..201: mol_type = other DNA
ggttttgtagttttgtagygttyggggyggtgtaggagtttyggggtgtygyggygttygttyggttgtatygttggtttttyggttygggttttaggttyggygttttttatttttaggtygygygygtttygttttttygaygatttttagtttygggttttygttatttaygagttttygttttyggtgagttgttgt

SEQ ID NO: 10103 - DNA, 201 bp, synthetic construct
  misc_feature 1..201: note = Description of Artificial Sequence: Synthetic polynucleotide
  source 1..201: mol_type = other DNA
gygttttygggggttgygtygtgtygtttgttgtgygygygtagaggtyggatagttyggttgygggaagggattygagygtagggtttgtttygygtttyggaaagtgtttagtttgyggagtyggaggttgagttggggtagatyggygttagaygggggtttgggtgagataygagttgggggtgyggtttgtagaat

SEQ ID NO: 10104 - DNA, 201 bp, synthetic construct
  misc_feature 1..201: note = Description of Artificial Sequence: Synthetic polynucleotide
  source 1..201: mol_type = other DNA
ttttttttattattttttygtttttttattttttttttttttttgttttgtaggattgagtagttaggygygagygaaaataaatagttggggttgygagygttttygtttyggtttygagagtaygtyggtttagttttttatttggggygttygtttgtttattatgaggaagattygygttaatgttatygttatttt

SEQ ID NO: 10105 - DNA, 201 bp, synthetic construct
  misc_feature 1..201: note = Description of Artificial Sequence: Synthetic polynucleotide
  source 1..201: mol_type = other DNA
gttygtgtygttgttgttggttttagygttygggttttyggtgagtgyggttttgtttyggttttyggaggaatttgtaggggagtygggggyggggaygygygggttygtaggtaaygtttttaggaaaggggygatgttagggaagttgggttgggaggaggygagttygtatygttgagtttttttagaaagggttgg

SEQ ID NO: 10106 - DNA, 201 bp, synthetic construct
  misc_feature 1..201: note = Description of Artificial Sequence: Synthetic polynucleotide
  source 1..201: mol_type = other DNA
ygttgggygtygttygtyggtttaggygygygaatttggygtttttagtgaattattygyggttygggygttygggttygggatyggtttttttttttttygttgagtygyggtygagttggttttttgtattttatttagygtygtygggaygygattatatygagatggtatygagttttttttaaaggtttyggtttg

SEQ ID NO: 10107 - DNA, 201 bp, synthetic construct
  misc_feature 1..201: note = Description of Artificial Sequence: Synthetic polynucleotide
  source 1..201: mol_type = other DNA
gttttagtttttgggtyggaagtttttttttttttttygtygtagtttttttttagttttttttttttygtygatgygggaaatttttttygtttygtttygttttttttttttagttgtattttygttyggttttttygtttagtttttaatttaggtttygtttttttttatttatttttygttttgggtygggttttc

SEQ ID NO: 10108 - DNA, 201 bp, synthetic construct
  misc_feature 1..201: note = Description of Artificial Sequence: Synthetic polynucleotide
  source 1..201: mol_type = other DNA
gatggygaygyggatttgtatygtygttttgggttygggtygagttttttygtyggattgggttatggttygygggattgyggygtygtyggggtttttaygtygtaaggtttagttagtyggtyggtagygattgygaygagggggygggggyggtgygagygygtttgtygttyggtttaggggagggataggggtygc

SEQ ID NO: 10109 - DNA, 201 bp, synthetic construct
  misc_feature 1..201: note = Description of Artificial Sequence: Synthetic polynucleotide
  source 1..201: mol_type = other DNA
gtttgtttygtygttygggttttgtggttggttattygygagttygtttygttttttttgtttyggttygttyggttygtttyggggttttygtygtaatygagyggagtttagygattygtygggtttatattagyggtygtttttttygaagygtttttyggtagygttygggttttygygtttyggaatatttatgaa

SEQ ID NO: 10110 - DNA, 241 bp, synthetic construct
  misc_feature 1..241: note = Description of Artificial Sequence: Synthetic polynucleotide
  source 1..241: mol_type = other DNA
ygygttggttyggtttttagttttttyggtygtygtttttygttygtygygtygyggygttaggagggyggggtyggggygygygtygttttttagtaagygggygggyggygttyggtttgagggagyggggyggttttygtyggygtygygygygttgtgtgtgagyggggtygygygygygygyggtaggygagtgagggaaygaggagyggtygggtgtgagtgtgtgggagtgaga

SEQ ID NO: 10111 - DNA, 201 bp, synthetic construct
  misc_feature 1..201: note = Description of Artificial Sequence: Synthetic polynucleotide
  source 1..201: mol_type = other DNA
ggtgttaagygtggggygygggttygyggygggagttgttygygaaatttagtgttgaagtaggygyggaygtgttyggtgtttggygygtggtagtaggygttyggtgtttyggtyggygaagattatggygtttatggtgaagattatggtgggyggttagttgaagaattttattgggagtttgggaggyggygagga

SEQ ID NO: 10112 - DNA, 201 bp, synthetic construct
  misc_feature 1..201: note = Description of Artificial Sequence: Synthetic polynucleotide
  source 1..201: mol_type = other DNA
gygygggayggagttttatgaaagttggaagaagtgattataaatygggattygattttygtagttttggygttygtttttttaygtaggttygggatgtyggttttagtttttagatgtygggaagayggygtyggttagtttaaggaagagtttttaggaggttggggagtaagggtgtygggttttttatgtygggtt

SEQ ID NO: 10113 - DNA, 201 bp, synthetic construct
  misc_feature 1..201: note = Description of Artificial Sequence: Synthetic polynucleotide
  source 1..201: mol_type = other DNA
ttttgttggttagagtygggtaygggtygggygggyggyggggatygtgatygyggttgygtgygttygygttygggygtttttgtgyggggttttggtaygtyggygggggygattygggtgtyggttygtgygggygataygygygtttttgyggggttgygyggggttyggagyggttgggggttttttgtygggygc

SEQ ID NO: 10114 - DNA, 201 bp, synthetic construct
  misc_feature 1..201: note = Description of Artificial Sequence: Synthetic polynucleotide
  source 1..201: mol_type = other DNA
tagatttygtyggtyggygygttattygygttagtattatggatagyggtygttttagtygygygtttagggttaggttygggttggtttttatygyggayggttgyggggtyggggtagtttygtaattttaaatttyggtagttttygtttagtagggaggggtttygggggygaagagtgggggagaagtygggaagg

SEQ ID NO: 10115 - DNA, 201 bp, synthetic construct
  misc_feature 1..201: note = Description of Artificial Sequence: Synthetic polynucleotide
  source 1..201: mol_type = other DNA
gtgtgagtttygggggttygggtyggyggttttgttagtygggtygtgyggttgygggggtggggyggyggygtygttgttatattagtttygggagyggygagagggaggttggggtgggggygygaggggggyggygygaggggggtygattttgygggtaggtgatattatatttygaaggttttagtgygygggygg

SEQ ID NO: 10116 - DNA, 201 bp, synthetic construct
  misc_feature 1..201: note = Description of Artificial Sequence: Synthetic polynucleotide
  source 1..201: mol_type = other DNA
gtygygttatggtgagtygggyggggtaggtygygygttygggtygggygggggygtyggggttygggggygggaagggggaggttaggaygaggaggggygygygyggyggyggggtygggtyggggtttgygggygggggaggggyggttyggygggygyggttygggggagggttygttttaggggtygygttygygg

SEQ ID NO: 10117 - DNA, 201 bp, synthetic construct
  misc_feature 1..201: note = Description of Artificial Sequence: Synthetic polynucleotide
  source 1..201: mol_type = other DNA
taatygggtattttygygygtataygttygtgtttaygtgtgtaygtttatatttttgtatatatttaggygygygttggtatatttattyggagaatttygtatatataygtattygtaaataygygggttttttgygttattaggaagtagtygttagaatygtygggtgttttttaattatttttgggagatttggtt

SEQ ID NO: 10118 - DNA, 201 bp, synthetic construct
  misc_feature 1..201: note = Description of Artificial Sequence: Synthetic polynucleotide
  source 1..201: mol_type = other DNA
ataygatatggttaagygtygtygttygaatyggtygtygtygatatttygtttyggttyggggttgaggaggaagtygagaaggaggaggaggaggyggyggyggagggygggggaagaggayggtygtttygggtttygtttgagttygtagggtaggaygagggagyggygyggtgagagaggyggatgaaggygagg

SEQ ID NO: 10119 - DNA, 201 bp, synthetic construct
  misc_feature 1..201: note = Description of Artificial Sequence: Synthetic polynucleotide
  source 1..201: mol_type = other DNA
ygygtatagyggyggygagtgggtygtgtaygyggatgyggggtgggagtgggggygtaygygygggygtgggygagygggtttyggtagtgtatatatayggtaggggygggygatagatgtagtgygtgygtyggagtttaagygtataaayggaaagagygggygyggtgygtaggggygggygtttagygggtttgg

SEQ ID NO: 10120 - DNA, 201 bp, synthetic construct
  misc_feature 1..201: note = Description of Artificial Sequence: Synthetic polynucleotide
  source 1..201: mol_type = other DNA
ttttaggggagttaagtagttygtttgaagttttttatttggaaatgaygtgtttaattyggygtttttgtagtttyggtygtttttttttgtttaatttygygtttttttagtttyggtygtttttttygtygtttttttttygyggtygtttatttttgagatttttggttttattgagaygtttagttttattyggta

SEQ ID NO: 10121 - DNA, 219 bp, synthetic construct
  misc_feature 1..219: note = Description of Artificial Sequence: Synthetic polynucleotide
  source 1..219: mol_type = other DNA
tttagggagggggcgggaggttttttttgtttagtttcgagtcggtggtgtagcgttcgttttcggtcgcgggcgtagattggcggtcgttttcgggttacgtggtgcgcgcggcgggcgcgttcgaggagtttgcggttgtttttggtttatagcgtttcgggcgaggagagcgggcggacgtcgggggttgggtcggtgcgggcggcgaggtaggcg

SEQ ID NO: 10122 - DNA, 315 bp, synthetic construct
  misc_feature 1..315: note = Description of Artificial Sequence: Synthetic polynucleotide
  source 1..315: mol_type = other DNA
cgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgtt

SEQ ID NO: 10123 - DNA, 201 bp, synthetic construct
  misc_feature 1..201: note = Description of Artificial Sequence: Synthetic polynucleotide
  source 1..201: mol_type = other DNA
gtattcggtttagggttggagttggttgtagggttggttcgcggcgatttgggtagggtggcggttgttttttttttttttatttcgtttcgaggcgtagcgcgcggtagagcggttcggtgttcggcgggcgggcggttcgggcgggtttgcggtcgggatgaggacggcgttttcgttgtagagcgttggggcggcgcg

SEQ ID NO: 10124 - DNA, 201 bp, synthetic construct
  misc_feature 1..201: note = Description of Artificial Sequence: Synthetic polynucleotide
  source 1..201: mol_type = other DNA
aataatagggacgttgagaataataattacgattagtacggcgaaggcgtttttttcgcgggttagaggtcggcgttttagtttcgtagaattcggcgttcggttagcgttttttggtagtttttttcggtagttttaggtttttaagatttgtaggttcgtttcgaagtttttcgttcgttttttacggtcgtttcgagt

SEQ ID NO: 10125 - DNA, 201 bp, synthetic construct
  misc_feature 1..201: note = Description of Artificial Sequence: Synthetic polynucleotide
  source 1..201: mol_type = other DNA
cgcgtatttttttcgttcgtttgttcgcggttttttttttgttttcggagcgttagtcgttttatttcgtgatcggtttttcgttttgtttcgtaggattcgttcggacgggattacgtcgtcgtcgtcgtcgtcgtcgttcggagtcgcgtttcgggttttgtttgagtcgagtcgcgcgcggggtcgtagttatcgtcg

SEQ ID NO: 10126 - DNA, 201 bp, synthetic construct
  misc_feature 1..201: note = Description of Artificial Sequence: Synthetic polynucleotide
  source 1..201: mol_type = other DNA
atagagttgttttttttttttttgggttttgtaagttttcgaattggaggcggaaatgggggaagggttggaagttgtgtgtgaaaaataattattgtaacgggttttttttaggagtttagttcggtttgtattttggtggaattgttgttatcggtttatagcgtttaggtcgagtcggtagggttgggcgggaggttt

SEQ ID NO: 10127 - DNA, 201 bp, synthetic construct
  misc_feature 1..201: note = Description of Artificial Sequence: Synthetic polynucleotide
  source 1..201: mol_type = other DNA
tagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttg

SEQ ID NO: 10128 - DNA, 201 bp, synthetic construct
  misc_feature 1..201: note = Description of Artificial Sequence: Synthetic polynucleotide
  source 1..201: mol_type = other DNA
aataagtagttcgggagatattttttttttttttagttttcgtttttttattttgttattttttagttcgtgattagttgttttttttttttttcgcgggcgtttagggttgagtaaatatttcgggtcgttcgtttcgttattagttggtttcgatcggcgtatcgttggcgattttttaggtaattcggcgttatgaga

SEQ ID NO: 10129 - DNA, 201 bp, synthetic construct
  misc_feature 1..201: note = Description of Artificial Sequence: Synthetic polynucleotide
  source 1..201: mol_type = other DNA
cgtggtttggtcgaggagttaatgggtcgggaggggcgcgcgggggaggagtttaggtgtagagtgtcgattggttagttcgtttttcggtatgtagatacggtgggagttacgtgttaggggtcgggacgattttttgttggaggttaacgcggggcggggaagggggcgcgagcgtttcgtttggttgaagcgggggga

SEQ ID NO: 10130 - DNA, 201 bp, synthetic construct
  misc_feature 1..201: note = Description of Artificial Sequence: Synthetic polynucleotide
  source 1..201: mol_type = other DNA
ggaggaggggaggcgttgttcgacgcgtttttttaagttttcgcgttttttttcggcggcggttgttcgggggcggtggttcggcgtcgtttttttcgatcgttttttttagggtttttttttcgtgtcgcggttaggttgttcggtcggcggcgcgttggaaatatgaagagacgttgtagttgcggtggcggtggcggt

SEQ ID NO: 10131 - DNA, 201 bp, synthetic construct
  misc_feature 1..201: note = Description of Artificial Sequence: Synthetic polynucleotide
  source 1..201: mol_type = other DNA
tttatttgggacgcgatttataggggcgttgtttcgttttgcgggaagaggaggcggcggtcgtcgtgattggggcgttcggttttattcgtttatagaacgtttttaatattaggggtttgaaagcgaaaatttcgggaaggtattttttgatcgtagattatattttgtagttgatttatatcgtttaggaggtagtga

SEQ ID NO: 10132 - DNA, 201 bp, synthetic construct
  misc_feature 1..201: note = Description of Artificial Sequence: Synthetic polynucleotide
  source 1..201: mol_type = other DNA
ataaaagagtagttttcgcggagcgggtttagagtttgttcggattgttcgatggttttcggttttttgagcgtcgcggttgtcgggttttgtgttcgcgcggggggcgggaaggacggtcggggtttttagtgcgcgtttcgcggagcggcgcgcggcgttcgaattggaaagttgtcgtcggcgtttgtcgtttttacg

SEQ ID NO: 10133 - DNA, 243 bp, synthetic construct
  misc_feature 1..243: note = Description of Artificial Sequence: Synthetic polynucleotide
  source 1..243: mol_type = other DNA
gttaaggttcggatcgttattttagtaatagttttagttatgtgatcggtaatggcggcgttgacgagaggtaggtgagttcggcgttttttatatttatcgcgcgtttttcgggtttcgttcgtattttttacgcgtttttcgttttttcggcgtttttttttttattttttttttttgcgcgcggtttcgggtttttcgtttcgtgttcggtcgattatttttttagtattttttagtttt

SEQ ID NO: 10134 - DNA, 201 bp, synthetic construct
  misc_feature 1..201: note = Description of Artificial Sequence: Synthetic polynucleotide
  source 1..201: mol_type = other DNA
tagttcgtttatttttttttggagaagttcgacgtagcgttcgttattttttttttttcgtgtgtagtttttcggttttaaagtatttatttgtttaattcgatttttattttataagatcgtaatcggttattatttttgtttttcgttaggatatcgaggttagttgtgttattgtttcgaggggttgtaggtgtagag

SEQ ID NO: 10135 - DNA, 201 bp, synthetic construct
  misc_feature 1..201: note = Description of Artificial Sequence: Synthetic polynucleotide
  source 1..201: mol_type = other DNA
tcgtagtatcggttattttattgttaagggtgttttttgtatttgttgcgatattttgggtcgtttttagtttagtttgtatagtatttttggttacgttcgtagtatcggtgattttattgtagatagtgtttttggtatcggttagtacggttttggtcgtgtttatatttatttggacggtttttttggttatattcg

SEQ ID NO: 10136 - DNA, 201 bp, synthetic construct
  misc_feature 1..201: note = Description of Artificial Sequence: Synthetic polynucleotide
  source 1..201: mol_type = other DNA
tttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtttttttcgcggtttttcggtttttgtttgtttttttgatcgtttttaggggcgcggc

SEQ ID NO: 10137 - DNA, 201 bp, synthetic construct
  misc_feature 1..201: note = Description of Artificial Sequence: Synthetic polynucleotide
  source 1..201: mol_type = other DNA
agtcggggtagaaggaggagtttgaaggtttattatggggtggaggttgtttgttcgcgggttcgtttttagagttcggggtttattacgttgttttatgcgtttttgttggtttttgttaaatagttttttttttttgtgttttagttttttggttgtaaaaagggggtgtttatagagtttttttgaggagtcgttata

SEQ ID NO: 10138 - DNA, 201 bp, synthetic construct
  misc_feature 1..201: note = Description of Artificial Sequence: Synthetic polynucleotide
  source 1..201: mol_type = other DNA
ttggtttttatttggtttgcgagaaattaaattttgggtataagttatgaagtcgataagttcgggagatatagtgttagaattataaggtgagattagtcgttcggttaagttattttttcgttagtaggtgaggttcgtgaatagttaagttttttttggtacggcggaatcgtagtggacgcgtggaggggtttcgta

SEQ ID NO: 10139 - DNA, 201 bp, synthetic construct
  misc_feature 1..201: note = Description of Artificial Sequence: Synthetic polynucleotide
  source 1..201: mol_type = other DNA
aattttttatttattaacgtcggcgtcgttatgggtttagggggttgggtgaggtcgtgagagtcggcgaggaagtcggttttgcgggttcggtcgatttcgggtttcggttttgggttgcgagggattttagttttcgtcgtcgtgtaaaatgtatataaggttcgcggcgtcgtttttgcgcgtcgtgaggatataggg

SEQ ID NO: 10140 - DNA, 201 bp, synthetic construct
  misc_feature 1..201: note = Description of Artificial Sequence: Synthetic polynucleotide
  source 1..201: mol_type = other DNA
gatagaaggggagagtggttaggaaggaggggaggatggatatagggcgtttgtagaattggtgggtagatggacggagggacgggtcgtgtagtgtagtcggcggggttagggttaggtcgagggcgcgaggtggtagtcggttcggggaggcggaggttgagcgagcggtggtgtttgtggagttgtcggttgcggtgg

SEQ ID NO: 10141 - DNA, 201 bp, synthetic construct
  misc_feature 1..201: note = Description of Artificial Sequence: Synthetic polynucleotide
  source 1..201: mol_type = other DNA
ggggttgggacgtttcggcggagtaggcggcggcggtggcgagttggggagttttaggttcggcgttgtcggaggggttcgagtcgagtcgtttgcgtttcggtcgggtagcgtcgggttcgtttttcgcggggttacgttttgttaaattttgttgcggcggttagcgtagcgggttcgtaagcgggcgggaggggcgtc

SEQ ID NO: 10142 - DNA, 201 bp, synthetic construct
  misc_feature 1..201: note = Description of Artificial Sequence: Synthetic polynucleotide
  source 1..201: mol_type = other DNA
ttattggtgagtttggtagggtatagagaggatggtattattagttggagggggataggttttaattatgagtttaggatgtagagagcggtagggattatcggagttttttcggttttggtgttttggttttttttgtatacggtttttatatgacgtttagtaagtcggattttaatttgtttatttattttttatttt

SEQ ID NO: 10143 - DNA, 201 bp, synthetic construct
  misc_feature 1..201: note = Description of Artificial Sequence: Synthetic polynucleotide
  source 1..201: mol_type = other DNA
gaggttaaggcgggtagattattcgaggttaggagttagagattagttcggttaatagggcgaaatttcgttttttttaaaaatataaaaattagttaggcgtggcggcgttcgttcgtaattttaggtatttggtaggtcgaggtaggagaattacgggagttcggggtagggaggttgtagtgattcgagattacggta

SEQ ID NO: 10144 - DNA, 233 bp, synthetic construct
  misc_feature 1..233: note = Description of Artificial Sequence: Synthetic polynucleotide
  source 1..233: mol_type = other DNA
ggagagagagagagagagagagagacggagtcggagagggagggagcgagagaaagcgagagtttttcgttatttttcgtcgtttttagaatttatcgggcgtttgttcggcggttttagaaggtcgggttgcgttgtgggttgcggggagtcggaggttttttgattggttttttgacgttttcggattaattgtgttgttgtataggcgtggtttttataggtcgagtgtt

SEQ ID NO: 10145 - DNA, 201 bp, synthetic construct
  misc_feature 1..201: note = Description of Artificial Sequence: Synthetic polynucleotide
  source 1..201: mol_type = other DNA
cgcggtatagttatttttttcgtcgaggcggtattttaattttgtgtttttttaggatcgcgggttgtaggtattcggttttcgaagcggaggtcggagtcgcgcggagaagttaacggtaatgacgttttttgtcgatttttaggaggggataggttgagggtttggacgaggtcggaagcgtttttattgtagtttcgg

SEQ ID NO: 10146 - DNA, 201 bp, synthetic construct
  misc_feature 1..201: note = Description of Artificial Sequence: Synthetic polynucleotide
  source 1..201: mol_type = other DNA
ttttgagaagtagtagtagttggtttgtttgttgtttcgttttcgtgtatggttgtttagcgttggttttagtgtttagcgttttcgtttagtattttttcggttttttttttttatttttcgttttcgagttgcggggagttttagtttgggatttttgttttatgtttttgggtttttgttttggttggttcgtttttt

SEQ ID NO: 10147 - DNA, 201 bp, synthetic construct
  misc_feature 1..201: note = Description of Artificial Sequence: Synthetic polynucleotide
  source 1..201: mol_type = other DNA
ggtttcgtcgggtcggtcgttgcgagtttcgtttcggtttcggttatcgtcggggaggacgacgacgacgtggtgggggacgtgttggtattgttggtcgcgtttttggtttcggggtcgcgggcgtcgcgcgtggaggtcgtttttttttgtcgtttgcgtcgggacgcgttggtggagcggcgcgcgttgtacgagttt

SEQ ID NO: 10148 - DNA, 201 bp, synthetic construct
  misc_feature 1..201: note = Description of Artificial Sequence: Synthetic polynucleotide
  source 1..201: mol_type = other DNA
ttttttttagtatattttatgtaaaagttagtaaaaatattttttttataagtttaaataaatgtttaaaaatatgtaagttaggaagttatttttaatacgtatattttttttatatgtagaagtaatggtgagaattttttatattttttgtagtagattttcggtttcggggttgggtttttagtaagtttatttttg

SEQ ID NO: 10149 - DNA, 201 bp, synthetic construct
  misc_feature 1..201: note = Description of Artificial Sequence: Synthetic polynucleotide
  source 1..201: mol_type = other DNA
ttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgtttt

SEQ ID NO: 10150 - DNA, 201 bp, synthetic construct
  misc_feature 1..201: note = Description of Artificial Sequence: Synthetic polynucleotide
  source 1..201: mol_type = other DNA
gggattgggaacgggatagggacgcgttttaatttatttagcggtggagttggggggcggcgcggttacgtgggatggcgggtagtttaggggattcgggcgacggggtttggcgggtagggttgttttagtcgtttttataaagtcggttttttcgatttttttttttttttgtagtttttttttttttttttgggggtt

SEQ ID NO: 10151 - DNA, 201 bp, synthetic construct
  misc_feature 1..201: note = Description of Artificial Sequence: Synthetic polynucleotide
  source 1..201: mol_type = other DNA
tagttatttatttgttttttacgttttatttattagcgcgtacggtttcggtaattttattcggagcggggcgtcgtcgtcgtttttgtcgtagttcggtcgggtcgttgggcgtaggggatttcgcgtcgtcgttgtcgttgtcgtcgtcgtcgtcgtcgttgtcgttgttgtatttttcggcgagcgttgttgtttttt

SEQ ID NO: 10152 - DNA, 201 bp, synthetic construct
  misc_feature 1..201: note = Description of Artificial Sequence: Synthetic polynucleotide
  source 1..201: mol_type = other DNA
tttgggggacgtcggacgttatgttgtggaaaataatcgataatgttaagtacgaagaggattgcgaggtgagttggggtttcggggtgtagtttcgtttcgtcgaggatagttcgggaggtaggggttattggatcgaggtcggggacgagggtataggagttttggtttttcggtgggacgggatttattttttcggat

SEQ ID NO: 10153 - DNA, 201 bp, synthetic construct
  misc_feature 1..201: note = Description of Artificial Sequence: Synthetic polynucleotide
  source 1..201: mol_type = other DNA
gggagggaagaaggaggcggcgagcgggaagaggaagaagacgtaggtagcgttaggcgagtttaggggcgtcgggagcgcggagttcgggttacggattcgcgggagtttattgcgttttcgggttttggagggttgtttttgttcgtaggttcgggcgttttcgttaggaggcgatagcgttatgtttttttaggtttt

SEQ ID NO: 10154 - DNA, 201 bp, synthetic construct
  misc_feature 1..201: note = Description of Artificial Sequence: Synthetic polynucleotide
  source 1..201: mol_type = other DNA
tttagtcggtttttcgtatgattggattatatgagggatttaagttcggttagttgttatttttcggattatatgcgtgtttagggatcgttttttaattcggtatggggatttggaaaaaaagattagggtagagggattggggtcgggttcggtgatcgtttttcggtaattaaaggatagtaaaggacggtttttgat

SEQ ID NO: 10155 - DNA, 410 bp, synthetic construct
  misc_feature 1..410: note = Description of Artificial Sequence: Synthetic polynucleotide
  source 1..410: mol_type = other DNA
cgtatgcgtttaggtcggttcgtaggtttttttcgttttagtcggtagttagttcgttcgcgttggggttatcgcgagtcggttcgtagcggggttatcgcgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcgcggattggaggttttcggttggaaaagttttttggcggttaattggggaggattggaagaaatttaggatggagttagtattgttggtttaatatgttt

SEQ ID NO: 10156 - DNA, 201 bp, synthetic construct
  misc_feature 1..201: note = Description of Artificial Sequence: Synthetic polynucleotide
  source 1..201: mol_type = other DNA
aagtttttgggaaagattcgttttattttcggaagttagagggcgttagttgtcgggttgaaaaggggtgtggggaggggaagtagttttatttcgggttcggagtttgtaggagagagaagtggggagtaagaagtgaattttaggggtttatagggttttcgtagatgtttaggtcggttaggaatgtatttttggttt

SEQ ID NO: 10157 - DNA, 201 bp, synthetic construct
  misc_feature 1..201: note = Description of Artificial Sequence: Synthetic polynucleotide
  source 1..201: mol_type = other DNA
tttattacgtcggggcgattcgttgtttgagcgagtacgtttcgtatttttttcgcgacgcgcgtatgttgttcggcgtttcggtcggggcgttgtattgcgtcggcgtttttttcggtatttcgttgggtgcgtttggggacgttgttcgggttttacgtgcggagtgggtgttttttaggtcggggagcgggggatttt

SEQ ID NO: 10158 - DNA, 201 bp, synthetic construct
  misc_feature 1..201: note = Description of Artificial Sequence: Synthetic polynucleotide
  source 1..201: mol_type = other DNA
atttttggattaggaaatagtgtgtgtgtatacgagagagagggatagagagaggggggatatgtggagtgtattggaattattataatttttatgaaggcggtatcggagttattggtattatttgtgtaatttttttttatgtttgacgtcgttttaaaataaagagtgagttgagtaaattaattcggtagggtatat

SEQ ID NO: 10159 - DNA, 201 bp, synthetic construct
  misc_feature 1..201: note = Description of Artificial Sequence: Synthetic polynucleotide
  source 1..201: mol_type = other DNA
gcggcggggttgggtttggggttggacgttgatttaggatttcgtttttgttcgttttgcgtcgcgtttttttcgggtcggttttgatcgagtagttttacgcgggttcggggttcgtttattcgataggagcggggggttgtagtttacgagtttacgagttcgtagcgacgtattcggagtgtaatttcgtagagttac

SEQ ID NO: 10160 - DNA, 201 bp, synthetic construct
  misc_feature 1..201: note = Description of Artificial Sequence: Synthetic polynucleotide
  source 1..201: mol_type = other DNA
gtatcgcgcggcggcgtttggcgggtattgttgttcgcggagggacggtgggggggttttagtagttggcgggggtggagggggcgggagagggagtttgcgtcgggttgagtttggaggtgcggggcgggttcggggagcgtttttggggttttttttgttatagtcggggcggttggaatttttttttttttttttttt

SEQ ID NO: 10161 - DNA, 201 bp, synthetic construct
  misc_feature 1..201: note = Description of Artificial Sequence: Synthetic polynucleotide
  source 1..201: mol_type = other DNA
gtcgcgtcgtcgggtttcggggatatttttcgtcgtttttttcgattcgcgtcgtcggggtcgtcgggtcgtagggtacggggtcggcgcggggggggagcggagaggggttggggagttttaggggttcggggttcgttcgcgggggatgggtagggatttcgggtcgcgtggggtgcgggggtcgttcgtattgaggac

SEQ ID NO: 10162 - DNA, 201 bp, synthetic construct
  misc_feature 1..201: note = Description of Artificial Sequence: Synthetic polynucleotide
  source 1..201: mol_type = other DNA
tttttttttaaaaagagttttttagagttgtcgaaattttcgcggggtgaaagttaaatttttggagtcgttgtgtagtcgggtagaggatacggcggcgcgagtcggaaagataagtgtttaggcgaatgggaaaggaaagattttaatttttgtttttattgttagttgaatgtttataaaaattaaagggaatgcggg

SEQ ID NO: 10163 - DNA, 201 bp, synthetic construct
  misc_feature 1..201: note = Description of Artificial Sequence: Synthetic polynucleotide
  source 1..201: mol_type = other DNA
atggtttattgcgtaagtttatatttagttttaggaagcgagttttacgtcgttttagttttgtatttatagtcgttaagcggtttcggaagtcgaatgtcggataggttaaagatagcgtcgttgtttcggtattgtcgttagagggcgcggagtcgtcgtgttggtttgtattttttttgttacgttagtcgaacggtt

SEQ ID NO: 10164 - DNA, 201 bp, synthetic construct
  misc_feature 1..201: note = Description of Artificial Sequence: Synthetic polynucleotide
  source 1..201: mol_type = other DNA
gcggttcggaaatgagcgtttttcggggatagggggttttgcggggcggcgatagttggatttttagcgcgtataaagtttgcgggaggatttattgtagcggtcgttttttttcgtttagcgagggcgggcgtaggggcgggggatgtcgaagggttaggtttgtttaggtcgcgttattttcgttttagacgtttagtt

SEQ ID NO: 10165 - DNA, 201 bp, synthetic construct
  misc_feature 1..201: note = Description of Artificial Sequence: Synthetic polynucleotide
  source 1..201: mol_type = other DNA
tttcgagggtcgcgcgggtttaggcgtttacggtttcgtagcgtcgcgtttttcgcgagaacgtagagattcgggttcgttttgagtcgtcgattgcgggcgggagtcggcgggtaaggcgcgcggtcggtagtcggagcggcgcgtaacgtagttgagtgaggtcgtcggtggaggtacggagtagtaggcgttcggggc

SEQ ID NO: 10166 - DNA, 294 bp, synthetic construct
  misc_feature 1..294: note = Description of Artificial Sequence: Synthetic polynucleotide
  source 1..294: mol_type = other DNA
tttcgcgaaggtttcggttcggtcgggcggggtggggcggtttcggttttattaattagcggtttgttgtggatgtcggcggaggagatgttatttagggcgggaaaaggggcgcggaagaggggcggggcgggttacggcgcgtagggtttttttttttcgtttcggatttaattaattgggtttgagtttttgtcggggagggggcgtcgggcggggtcgcggttgggcggggcgggggatcgggatcggcggcgggggttgcggttttgtagtggaagtatgggcggcgag

SEQ ID NO: 10167 - DNA, 201 bp, synthetic construct
  misc_feature 1..201: note = Description of Artificial Sequence: Synthetic polynucleotide
  source 1..201: mol_type = other DNA
gtgtggaggtttacgtagcgtttttggttggaacggggaagtttgtatttagttttgggagtgggtttgggagagggaggaggagtcgtcgggagtttggcgggagggcggtgttttcgtttgggtttttttttgttgttttagtttcggtagtttttatagtagtttcgaagggtgagaatttgtttttttatggatttg

SEQ ID NO: 10168 - DNA, 201 bp, synthetic construct
  misc_feature 1..201: note = Description of Artificial Sequence: Synthetic polynucleotide
  source 1..201: mol_type = other DNA
ttttttagtttttagagtaagttaattagggatacgttttcgtggtttagttcggaaataatgtttggtgggaatttgtaattttggttgtcggaattttcggggaggattaacgtcggcgtatcgtgcggtcggggcggggcgtcgtttaaatttaggttttgtgatagcgattgtggcggtttggaaagcgtgggtttc

SEQ ID NO: 10169 - DNA, 201 bp, synthetic construct
  misc_feature 1..201: note = Description of Artificial Sequence: Synthetic polynucleotide
  source 1..201: mol_type = other DNA
aattatttttaaaataattttttcggggggtgagaggtaattataattttagcgagtggagggcgcgggggatgggcgtcgggcgggcgggggcggggagcgcggcgcgggtttttaggtggcgagcggaggtgttttcgtcgcggggggaggggcgggggcgtacgcggtcggcggcggggggaggcggcgcgcggggga

SEQ ID NO: 10170 - DNA, 201 bp, synthetic construct
  misc_feature 1..201: note = Description of Artificial Sequence: Synthetic polynucleotide
  source 1..201: mol_type = other DNA
aggttttcgtatttatcgcgtgggtttttgttttggttttatttgttttcgatatttttcgttttcgcgatgtttaatttcggttcgagaaggttggtcgcgatttcgttcggtattcgtcgtttcgatattattattcgttttttcgatttttttcggcgtcgttgtttattcgtttttcgtttcgtttatcggggtcgt

SEQ ID NO: 10171 - DNA, 201 bp, synthetic construct
  misc_feature 1..201: note = Description of Artificial Sequence: Synthetic polynucleotide
  source 1..201: mol_type = other DNA
ggggacgttcgtttttttttcgggtagttttttttatttaggcgggatttgggttttcgttggatttagggtcgttttttcgtaggcggggtcggttcggcgcgtattttgtttcggatgttttggcgtacggtttcgcgtttcgtttttattttggcgtatttggttttgcgtttttttttcgtttggcgtagcgttttt

SEQ ID NO: 10172 - DNA, 201 bp, synthetic construct
  misc_feature 1..201: note = Description of Artificial Sequence: Synthetic polynucleotide
  source 1..201: mol_type = other DNA
tattttttttttgcgcgtttgtttttttttcgtttgtaggatttcgtttttggttcgttttttttttttttgttgggtaggttttttcggagtttattttcggcggcggcggcggtagtcgcggtcgcggtcgttggatttcgagaggcgcggggaatttttttattttttgttttggttttatttgtttttttttttttt

SEQ ID NO: 10173 - DNA, 201 bp, synthetic construct
  misc_feature 1..201: note = Description of Artificial Sequence: Synthetic polynucleotide
  source 1..201: mol_type = other DNA
tagggaattataaaagacggtcggcggcgagtaggttggggtgacggggatttcgtggataacgggtttgaggacgtttagggttttagttttttttaggcgtttttcgtcggggtaacgtagagtagttgtcgtttttttcgcgttttagtagatggtggtgttagttcggtttcgtgttcggtcgtcgttgcgttcgcg

SEQ ID NO: 10174 - DNA, 201 bp, synthetic construct
  misc_feature 1..201: note = Description of Artificial Sequence: Synthetic polynucleotide
  source 1..201: mol_type = other DNA
ttagataggtatggttaaggtagtttgtgatttattttataaaattagagatttttgttttttgtggagtaagatttttcggaggttagagtaggatgatcgttaatttttttttttagagtcggtttagtttgataaagtaggggttatttcggagtttggaggggaagagagtttaggtataaggttatttttgggaaa

SEQ ID NO: 10175 - DNA, 201 bp, synthetic construct
  misc_feature 1..201: note = Description of Artificial Sequence: Synthetic polynucleotide
  source 1..201: mol_type = other DNA
gggcgcgcggcgttttttatttacgttcggtcggggcgcggcgcggcggcgggtattcggacggtcggcggaggtaggtcggttcgggtattagtttgggcggttcgcgggtcggggcggcggcggggtggcggtggcggcggtagtagcgcggagtcggtgggcgtagtcgcgcgttaggtcggcggtcggggtttgggg

SEQ ID NO: 10176 - DNA, 201 bp, synthetic construct
  misc_feature 1..201: note = Description of Artificial Sequence: Synthetic polynucleotide
  source 1..201: mol_type = other DNA
tttgttatagataagttttcgaagtcgttttggtgtaggttatttggttttttagtttttggtgtgtggttagtgtttggtgtttttggaaagttattttcgggtagtttttgatagtgcgattcggcgtttaagtagtttgggattttgcgcggatttgatttttttagatcgtaggtagtttgggaggaggttcggtcg

SEQ ID NO: 10177 - DNA, 463 bp, synthetic construct
  misc_feature 1..463: note = Description of Artificial Sequence: Synthetic polynucleotide
  source 1..463: mol_type = other DNA
acgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgtt

SEQ ID NO: 10178 - DNA, 201 bp, synthetic construct
  misc_feature 1..201: note = Description of Artificial Sequence: Synthetic polynucleotide
  source 1..201: mol_type = other DNA
atcgggagtgtttagcgattttaggttagttcgggggaaagaagcggtcgtcgtcgtcgaggttttttggtttcgggatttcggcgttgtttttttttttcgtatttgttggggtgggttggagtcgtaatcgaatttcggtcgcggcgtttgtaaagtttttttttcgaagtttcgcggttttagtttattggcgttttt

SEQ ID NO: 10179 - DNA, 201 bp, synthetic construct
  misc_feature 1..201: note = Description of Artificial Sequence: Synthetic polynucleotide
  source 1..201: mol_type = other DNA
gttttatagtttcggttagaatttggtgggggacgcggggggggggtgtttgacggggagggggtatagttttttcgggttaatttttatatttttgtttcgtttaggcggggggtgagtcggggtgagtagtcggttttaagttggtcggttttttggaaagggagggttagtaggagaattgtagatttttttagtttt

SEQ ID NO: 10180 - DNA, 201 bp, synthetic construct
  misc_feature 1..201: note = Description of Artificial Sequence: Synthetic polynucleotide
  source 1..201: mol_type = other DNA
gggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcggagcgtttttgtttcgggagtttcgtttt

SEQ ID NO: 10181 - DNA, 201 bp, synthetic construct
  misc_feature 1..201: note = Description of Artificial Sequence: Synthetic polynucleotide
  source 1..201: mol_type = other DNA
gtttttagaggtttagttttgttttttattatatatagttattattttattcgtttttggggttcggttgtttttttcggtgttttttaaatttttttttcgatttgggtgttaagtttatttatttttcggcgtcgttttcggtcgaatagttttttgtttttttttcgtttgggtcggagtttttcgtagtttttttcg

SEQ ID NO: 10182 - DNA, 201 bp, synthetic construct
  misc_feature 1..201: note = Description of Artificial Sequence: Synthetic polynucleotide
  source 1..201: mol_type = other DNA
ggttcggtttggggttgggttggggagcgcggcggttgcggttggggtacggggcggtcgggtgagttggtcggcgttcgttttttttatttagtgagtacggtagatatcggagacgcggggtttattttttcggttttttttcgattaagaaacgttaatttcgttttttattggttgcgtcgcgcgttatgtcgatta

SEQ ID NO: 10183 - DNA, 201 bp, synthetic construct
  misc_feature 1..201: note = Description of Artificial Sequence: Synthetic polynucleotide
  source 1..201: mol_type = other DNA
atcgagtttaaaagtcgtcggcggtatattttagcggttttttttttttcgggttgggattcgtttttgtaagaaacgttatgtttttttttttagatatcgtttcgggagttttagatgtaaaattagaggttttttatttggtattattgatttttgtgttaataaaatgttagtttttaagggaaaatttaaaaaaag

SEQ ID NO: 10184 - DNA, 201 bp, synthetic construct
  misc_feature 1..201: note = Description of Artificial Sequence: Synthetic polynucleotide
  source 1..201: mol_type = other DNA
gtcgcgcgggacggggtagggatttcgagaatatcggggatttgcgggtcggtggtttcgggtaggttatttttgacgcgggtgcgaggtttttcgcgggcgtgtacggttgggtcggagtcgcgtcgggggtcgggatacgtttggggttagcgttggcgtcgtcgttcgggtggggtgggtcgggttcgggtttagttt

SEQ ID NO: 10185 - DNA, 201 bp, synthetic construct
  misc_feature 1..201: note = Description of Artificial Sequence: Synthetic polynucleotide
  source 1..201: mol_type = other DNA
ggcggcgcgcggtagagttgggtttttcgttaggtggtcgggggtgtgtttttagggtattttattcgttattttcgcgtttttagtttcggcggtcgcgcggatttcgtttttgttgatttcggcgtacgttttcgcgtcgcgcgtagtttttcgtttttcgtcgatttcgtcgcgtcgtcggtagttttttttagtttt

SEQ ID NO: 10186 - DNA, 201 bp, synthetic construct
  misc_feature 1..201: note = Description of Artificial Sequence: Synthetic polynucleotide
  source 1..201: mol_type = other DNA
ttttttttttgttgttttaaaatatttttcgacgttagtaaaatataatgcgtttcggtcgtcgtaaatagtcgggagggagagtatatattcggcgcggcgcggtcgtcggttcggtttttatttttttttcgtttttagaaaatgttataaaagcgggtagggcgcggggagggcggttgcgcgttcggcggtcggggt

SEQ ID NO: 10187 - DNA, 201 bp, synthetic construct
  misc_feature 1..201: note = Description of Artificial Sequence: Synthetic polynucleotide
  source 1..201: mol_type = other DNA
agttaggaaatgcggggtttggtggggtgaggagtacggggttttttttttattttcgcggggattttgttatcggtttagtgtggaggttttatcgtttcgttcggattcgtggggtttcgatagtgtggtttttgcgaggattttttttatttttttcgttttggggttgttgcgggagggcgttcgggtagtattagg

SEQ ID NO: 10188 - DNA, 258 bp, synthetic construct
  misc_feature 1..258: note = Description of Artificial Sequence: Synthetic polynucleotide
  source 1..258: mol_type = other DNA
gcggcggtagcggcggtttggtttttttagagggttagagttagggatatgcgggcgttcgggatttcgcgtttcgcgcggttcggcgtttgagcgttttcgtttttcgtttcggagttgtcggcggtatgattcgatacgtcggggcgttcgcgcgcggggattttacggggtaagttcgggcggtcgtttttttttttttcgcgatttttacggttcgcgttttggtcgttttattttattttttgttttagagag

SEQ ID NO: 10189 - DNA, 201 bp, synthetic construct
  misc_feature 1..201: note = Description of Artificial Sequence: Synthetic polynucleotide
  source 1..201: mol_type = other DNA
tcgacggttaaggaaagtttattagtttttcgtatcgtgggcgacgggttaagattcggttttaaacggttagatttagtttttagtcggttgtcgttttcgttttacgtaggcgcgtttcggggttttttttttttttatcgcgcgttcgcggggttcgacgggggcggagcgattttcggaaggggcgtggcgatcggg

SEQ ID NO: 10190 - DNA, 201 bp, synthetic construct
  misc_feature 1..201: note = Description of Artificial Sequence: Synthetic polynucleotide
  source 1..201: mol_type = other DNA
agggggacggttagacgggatgtcggaagttaagggacgtagaggtcggcgggtggcggcgatggagaggatagattcggtttttagaggaggtcgtgagcgcggggtttgcgtcggtcggaggagggattcggggggttgtaatatggttgttcgggcgtcgttttttttttgttaagttagggttttggggagttgttg

SEQ ID NO: 10191 - DNA, 201 bp, synthetic construct
  misc_feature 1..201: note = Description of Artificial Sequence: Synthetic polynucleotide
  source 1..201: mol_type = other DNA
ttcgtcgcgtttcggtcgggatggatttatacgttcgatgagtttcgcgtcggcggttgcgagcgtcgagtttttttttgttgcggttttagtcgtttttcgcgcgttcggtttcgcggattaggatttttgggtttttcggttgagggcgcggtcgtttcggagaggtcgagcggggacgggttcgagatggcgcgggga

SEQ ID NO: 10192 - DNA, 201 bp, synthetic construct
  misc_feature 1..201: note = Description of Artificial Sequence: Synthetic polynucleotide
  source 1..201: mol_type = other DNA
tagttaggatagtataaaatttttttatcgtttattttttgtaaaaaatcgtggttttcggcggattttggagataggaggtgtaaagggcgtttatacgcggttcgggttcgcggtcgagagttggggggatttggagcggggtcgggtcgtaagaagattttgattttgtttcggcgttggggcgcgtgttaagggttc

SEQ ID NO: 10193 - DNA, 201 bp, synthetic construct
  misc_feature 1..201: note = Description of Artificial Sequence: Synthetic polynucleotide
  source 1..201: mol_type = other DNA
tgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgg

SEQ ID NO: 10194 - DNA, 201 bp, synthetic construct
  misc_feature 1..201: note = Description of Artificial Sequence: Synthetic polynucleotide
  source 1..201: mol_type = other DNA
cgcgggtaaggaaagcgcgtaggttttgtagatttttttatttcggttttttggttcggttcgttttttcgtttcggggcggcggttttttgttttgtagcgagcgttcgtaggagggacgttaggatttcggacgttatttttgaggtttttttgtatttgggtttttgatagtcgggaataggtaggaggtggggcgag

SEQ ID NO: 10195 - DNA, 201 bp, synthetic construct
  misc_feature 1..201: note = Description of Artificial Sequence: Synthetic polynucleotide
  source 1..201: mol_type = other DNA
gtgggaggtcggtagcgcgggcgtcgcgttttcggaggagttcgcgttttttgaggagcgcgcgtgttcggaagagttcgcggcgtcgtttttcgaatcgcgcgtttggtttgaggatttcgcgtttttcgaggagttcggggagttcgcgttcgtattttcggggttcggggcggtgtacggggagtcggatttggtgtt

SEQ ID NO: 10196 - DNA, 201 bp, synthetic construct
  misc_feature 1..201: note = Description of Artificial Sequence: Synthetic polynucleotide
  source 1..201: mol_type = other DNA
agtgcggatttcggtcgcgtgcggttttgatcgcgtcgttttatttttggcggggttacgtacggacgttatggttggcgtcgcggagtcgggcgatgcgcgcggattttttcggggttttgattgtttttgagttttttttgcggggggcgtgcgcggttcgtttttcgcggcgttacgcggttttttttcggtcgggga

SEQ ID NO: 10197 - DNA, 201 bp, synthetic construct
  misc_feature 1..201: note = Description of Artificial Sequence: Synthetic polynucleotide
  source 1..201: mol_type = other DNA
gtttgcggagggtgggattttatagtttgtttatttgtttaggttgagatttcgtgttttagttttggatgttttacgggtttttcgtttcgggtagcggcgtacgggaggagaagattttcggtttgtagttagatttttttttgagattttttttagtttaggtttagagttttgggatttttttcgattttttttagt

SEQ ID NO: 10198 - DNA, 201 bp, synthetic construct
  misc_feature 1..201: note = Description of Artificial Sequence: Synthetic polynucleotide
  source 1..201: mol_type = other DNA
tcggttttttttttcgcggggggtttcgtttcgcgtttcgttttttcgggttgtagtcggtagtttacgtttagggagggtggagggaggaggagaggcgcggagaggagggaggggagaggggagggaggaaggcgagagaaagggagttgtttttatttcggattttttagagtttgtttggagcgcgtatttagcggt

SEQ ID NO: 10199 - DNA, 203 bp, synthetic construct
  misc_feature 1..203: note = Description of Artificial Sequence: Synthetic polynucleotide
  source 1..203: mol_type = other DNA
gcgagcggttacggggtggggagtaaggggcgcgcgggcggtaggtatggaacggacgcggcgtatttcgtttatcgcgggacgttcggacggcggtcggcgcgcgcggttcgtttcgagttcgagagggcggggagataatgtttgttcggcggggtagtttaggtcgtacgttttcgttcgcggatacgggtcgtttttat

SEQ ID NO: 10200 - DNA, 201 bp, synthetic construct
  misc_feature 1..201: note = Description of Artificial Sequence: Synthetic polynucleotide
  source 1..201: mol_type = other DNA
tcgtggagtcgcgttaggttacggggtttcggttagacgggagcgttagtttttttttttgtttcgatgtttttaaatttaggtttagttttttttttttcgattcgatgatatttttgggttttagaatgttgttgggggcgggagatcggagaagaagtaggtgtacggggaggtgggtgttttgttttttgcgaggag

SEQ ID NO: 10201 - DNA, 201 bp, synthetic construct
  misc_feature 1..201: note = Description of Artificial Sequence: Synthetic polynucleotide
  source 1..201: mol_type = other DNA
tttgggggggcgggtcggatttgaaggttataggtttttttttgcgtttattttttttgtaatttttatagtttttttcgtcgatttttttatgttttttcgtttttttgttcggcgttttttttcggtcgcgggttaattggttgtgatagttggagttttgggtagttgagcggtgttattgtaaattaggtaggcgtt

SEQ ID NO: 10202 - DNA, 201 bp, synthetic construct
  misc_feature 1..201: note = Description of Artificial Sequence: Synthetic polynucleotide
  source 1..201: mol_type = other DNA
ttggaagggcgggggcggtgatagcggtaggggcgggattcggaggcggggcgtttgtttacgtcgtttagtagcggagggaggcgcggttttagtttcgcgtttaggagtcgtataggcgttcggggtcgtagtaggagtttttttagggcgtttagcgttgtatttacgagtcgcgcgtcgttttcgtttagtgcgttt

SEQ ID NO: 10203 - DNA, 201 bp, synthetic construct
  misc_feature 1..201: note = Description of Artificial Sequence: Synthetic polynucleotide
  source 1..201: mol_type = other DNA
tcgtatttcgttcgtttgttttttatcggttaggttttgtcgggtcgtcgcggtttcggcgttttattttttttcgggttagcggggggttgggagggggcgaggaggaagggggtttttttttttttttttcggagggggtcgtagcggcggtttcggtttttttttttttttatattttttttcgtttttttttatttg

SEQ ID NO: 10204 - DNA, 201 bp, synthetic construct
  misc_feature 1..201: note = Description of Artificial Sequence: Synthetic polynucleotide
  source 1..201: mol_type = other DNA
tcggagggagggggtaaaggaagaaaaagaaagcgcgttcggaaagtcggtttgggttttgttaattattttgaaggtaaagtatttgtatttttttcgtcgaggttggttggcggcgtcgcgttggaggggaggaggttcgggaggaggaggagaaagagtagcgggaggattcgggttgggaggggagcgtagggttgg

SEQ ID NO: 10205 - DNA, 201 bp, synthetic construct
  misc_feature 1..201: note = Description of Artificial Sequence: Synthetic polynucleotide
  source 1..201: mol_type = other DNA
tcgtcggggagtcgtaaagtttgacggaagaggttgcggttttcgcgttttagtcgtcggttttcgagtcgtagtcgggcgtttttttgacgtagtcgcgcgttttgtcggttttattcgtttcgcgtacggatggtttttaagtggttcgtcgttaggtcggtaaatcgtttttttagttgttgtcgggcgtcgttcgcg

SEQ ID NO: 10206 - DNA, 201 bp, synthetic construct
  misc_feature 1..201: note = Description of Artificial Sequence: Synthetic polynucleotide
  source 1..201: mol_type = other DNA
gcggcgggacgttatttgcgatcgggattatgaggagttgttagattcgtggggtcggtaacgagagtagtcgcggtatttgttgagaggaaagagggagcggttcggcgcggttggggcgcggtagaggtttgttcgattttcggttatgttattgttttgcgtgcgcggtgagtgcgcggattgaggcggggaggcggg

SEQ ID NO: 10207 - DNA, 201 bp, synthetic construct
  misc_feature 1..201: note = Description of Artificial Sequence: Synthetic polynucleotide
  source 1..201: mol_type = other DNA
gcgttagatttttttattatatttttttattttaggcgattcgttttggtttcgggtgtttttagtttgcgcgggtcgtttttagttttcggtggatattcgtttttagttcgtcgttttttgttcggttttgcgttttttggaatttttgggtttttagttttcgtcgtttttagaattgcgtttgcgtaataatggtta

SEQ ID NO: 10208 - DNA, 201 bp, synthetic construct
  misc_feature 1..201: note = Description of Artificial Sequence: Synthetic polynucleotide
  source 1..201: mol_type = other DNA
aattattagagaatttttttaaaaatatagattcgatgaggagtggttttttcgttttttttttgtgtcgagaagggatttcggtcgttaataataaagacgtttttcgttttttttttttcgtcggttcgggttcgtttttttcgcgttgcggttttcggtttagcgtttttttttcgagtcgggttgcggcgtttttaa

SEQ ID NO: 10209 - DNA, 201 bp, synthetic construct
  misc_feature 1..201: note = Description of Artificial Sequence: Synthetic polynucleotide
  source 1..201: mol_type = other DNA
ggagggtcgcggagacgtaggcgtttcgggtcgttcgcgttgtttttgtttgtttcgtgcgggagtcggggtttttggttttttggttttttggtttttgcggttcgggcgaatttagagcgtattcgtacgtcggtttcggtcggtttttagcgttcgggttttacgggtcgcgtttttacgcggcgttttttagagatt

SEQ ID NO: 10210 - DNA, 523 bp, synthetic construct
  misc_feature 1..523: note = Description of Artificial Sequence: Synthetic polynucleotide
  source 1..523: mol_type = other DNA
ttgcgttaagttttagaattatttagtttcgtgtttgtcgttcggggttcggtttcgtttcggtcggcgtttatttggcggtgtcgttttcggaagattacggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcgaagcggtttcggcgttgtcgggttaggggtgtcgttatcgttattgtgcgcgtttagagtcgtatacgcgttttgaggtagtgaggggttcggtatttt

SEQ ID NO: 10211 - DNA, 201 bp, synthetic construct
  misc_feature 1..201: note = Description of Artificial Sequence: Synthetic polynucleotide
  source 1..201: mol_type = other DNA
cggttcgtattttttcgtcgttagttttagttttaaattcggcggtttagcgggcgtattatggtattggagtagcgcggggagcgcgttcggagtttcgcggttcgttgcgtttcgttcgggatttcgttgcgtcgcgcgtttttttcgcggttcgcggggtcgtttttgtatttttattttttttttcgtttgtcgtcg

SEQ ID NO: 10212 - DNA, 201 bp, synthetic construct
  misc_feature 1..201: note = Description of Artificial Sequence: Synthetic polynucleotide
  source 1..201: mol_type = other DNA
gttttcgtttaagtgtggtttttttgggtttatattttattaggttagtaaggagggggatagcggggggcggggtaggtgttgggatttcgggtaggtgcggggaaggtagggggcggggggggaaggggttgggcgatgtaggtgttgggggtcgggatagttgcgggggtaggtaggtatcgggaaggcgggagggcg

SEQ ID NO: 10213 - DNA, 201 bp, synthetic construct
  misc_feature 1..201: note = Description of Artificial Sequence: Synthetic polynucleotide
  source 1..201: mol_type = other DNA
cgtagattttgggtttcggttttgttatttagggggattttttttaacgatgggatcggtgttcggagtggagtatggggagtgcgttttcgggagtcggcgttggtcggatatgtgataattgtgggtcgttggaggttcgtttgcgttgggatagggtttggattttacgtgcgtcgtttgtgtttcgttagatcgggg

SEQ ID NO: 10214 - DNA, 201 bp, synthetic construct
  misc_feature 1..201: note = Description of Artificial Sequence: Synthetic polynucleotide
  source 1..201: mol_type = other DNA
gggtcggtttcgcggtcgatttggggtatcgcgtcggggtgaggtttggcgaggaggcgaaggttgtaggcgtgaggtgaaggtcgtaggtcggtcgggtcgattttcgttatgtaaatatcggtgagggggggggagggacgggggataagatggcggcggttcggcgtttgttgtaggggacgatagagggggttgtcg

SEQ ID NO: 10215 - DNA, 201 bp, synthetic construct
  misc_feature 1..201: note = Description of Artificial Sequence: Synthetic polynucleotide
  source 1..201: mol_type = other DNA
ttttcgcgtttttttcgcgttttatatttatcgttcggcggagggggtttagttcgtagtcgtcgtcgttatcgtcgcgtttcggtttcggtgtaggtagcggtcgtcgtcgtcgagatagttgcgcgggcgagtatttttacgtagtaagttcgtttttttttcgtttgtgcgcgcgtgtgtgtttttcgttcgtcggcg

SEQ ID NO: 10216 - DNA, 201 bp, synthetic construct
  misc_feature 1..201: note = Description of Artificial Sequence: Synthetic polynucleotide
  source 1..201: mol_type = other DNA
gcgggggttttttacgtggcggaggtttttcggtttgggggttacgggttcggaggaatttgtttggaagttttttattacggtagagttttttggagttcgtttcgtgttcgataaggggagttttagatttgatttttttagtagtttcgcggggcggggtcgagaaggggcgggcgggcggaggacgttggcgggaga

SEQ ID NO: 10217 - DNA, 201 bp, synthetic construct
  misc_feature 1..201: note = Description of Artificial Sequence: Synthetic polynucleotide
  source 1..201: mol_type = other DNA
aatgtgattatagttaatatatgatttttttagcgttttagttagtgttttttttgatttttgttttttggagaggaggatggaagggaggggttcggtacgttgttggtattttgttgtgttttgtagttttttttcgggatatttgggtttatatagttttttagtttatataattggtgtagattttttgtgtggaga

SEQ ID NO: 10218 - DNA, 301 bp, synthetic construct
  misc_feature 1..301: note = Description of Artificial Sequence: Synthetic polynucleotide
  source 1..301: mol_type = other DNA
tttttttttaatttttggcggcgggcggttggggaagtagttttgtggtttttcggcgggtgaggtcgagatagagattaatttttaggcggcgttttggcgttgagttcgcgttgaataagattttttcgtagttttgcgtttcgcgtcgggtgaaggggcgtgtttttgtaggcgttcggggttcggtttggagttggcggtcggtacgtcgtttttggcgttttttgttaattaagagaaatacggttaaatgagtgcgttgggatagaaatttatagttaattaaggttttattcgt

SEQ ID NO: 10219 - DNA, 223 bp, synthetic construct
  misc_feature 1..223: note = Description of Artificial Sequence: Synthetic polynucleotide
  source 1..223: mol_type = other DNA
gcgggggcggcggcggtcgtgagtttcgatgaggttcgagcgttttcggtcgcgcggtagcgttttcggttcgatggagatttcgtcgtgggatttagttcgtaacgattcgttgtcgtttacgttgatttcggtcgtgtttttttacgtgaagtttggttttatcgtcgtttatatcgtgttttacgcgttgtttttcgtgtttatttacgtgtagttttgg

SEQ ID NO: 10220 - DNA, 720 bp, synthetic construct
  misc_feature 1..720: note = Description of Artificial Sequence: Synthetic polynucleotide
  source 1..720: mol_type = other DNA
gatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttg

SEQ ID NO: 10221 - DNA, 1683 bp, synthetic construct
  misc_feature 1..1683: note = Description of Artificial Sequence: Synthetic polynucleotide
  source 1..1683: mol_type = other DNA
tagtggtagtgttgagtttaggaatacgcgcggagttcgcggcgattttcgcggtcgtttagttttcgcggcggatttcggcgcgtaggagttattgggtcgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcgatggtggaagttttgggttggagggttgggagtttattgagtttcgtttaatttgatttatttttttttcgtttttcgttttttgtattttttttcggt

SEQ ID NO: 10222 - DNA, 233 bp, synthetic construct
  misc_feature 1..233: note = Description of Artificial Sequence: Synthetic polynucleotide
  source 1..233: mol_type = other DNA
tttcgttcgggtcgttcggttcggttgtgttttgttcggttagggcgggcgggttcgtttttttttcggtcggcgttttttttttggtttttttttttttcgcgtcgttcgttttcgtttttttcgttttttcggcgtcggcgtagttttcgtgaattcgggcgtattatttcgggtgtttcggtttggggatcgttgtcgtttcggtcgttgtttttttaatttttttgttt

SEQ ID NO: 10223 - DNA, 213 bp, synthetic construct
  misc_feature 1..213: note = Description of Artificial Sequence: Synthetic polynucleotide
  source 1..213: mol_type = other DNA
gattgcgcgtgcgtagagtacgtcggcgcggtttcgggattttcgcgataattgtattgagataaagtgtggtaattcgagttggttggtgatttattttcggcgaggggttcgcgtgtgggttacgtcgtcgtttttatcgggaaagcggggattagtggggggggtttagttgtagggtagtgggaggatgttgtttgttttgggggaagg

SEQ ID NO: 10224 - DNA, 236 bp, synthetic construct
  misc_feature 1..236: note = Description of Artificial Sequence: Synthetic polynucleotide
  source 1..236: mol_type = other DNA
ggtagcgtcgtttgcgtcgcgtttagtacgaagagttcgttttagtttaggcgtagtagcgttatttggtcggttatcggtagttcggggaagaagggcgcgtggcgcgtttattttacggtgttgaagagtagtcgcgtcgttagttcgtatacgttgtcgatgtttagtatcgcgttcgtcgcgtcgttttttgcgtcgaagcgttcggtcgtcgtagggtagggtttagcgcg

SEQ ID NO: 10225 - DNA, 233 bp, synthetic construct
  misc_feature 1..233: note = Description of Artificial Sequence: Synthetic polynucleotide
  source 1..233: mol_type = other DNA
gagggtggggttttaaacgttatttaattagcgacgttgggttgggaattgtttaattaggtacgtagtttgagcggagaggacggttttcgggatgtggcgggatttgttcgtttttttgtttttggttgtcgttggaatttcgggtttcgtttttattgttttgtgttttttgtttttagaggtttagtttttggttttgtgatttgtaggtattgggaatttatagttaa

SEQ ID NO: 10226 - DNA, 737 bp, synthetic construct
  misc_feature 1..737: note = Description of Artificial Sequence: Synthetic polynucleotide
  source 1..737: mol_type = other DNA
aatgacgtcgtaaataatagtattaattattatcgttcgtagttttcgcgtatagaggttttaggttttcggttttacgtggatcgatttcgttcggtagcgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcgaagaaggaattggagggtcgggttgggaaggtttgaagcgggtatagtttttaggttggggagggtcgaggggagaattcggagtttgagtcgggcgag

SEQ ID NO: 10227 - DNA, 308 bp, synthetic construct
  misc_feature 1..308: note = Description of Artificial Sequence: Synthetic polynucleotide
  source 1..308: mol_type = other DNA
tttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgt

SEQ ID NO: 10228 - DNA, 1100 bp, synthetic construct
  misc_feature 1..1100: note = Description of Artificial Sequence: Synthetic polynucleotide
  source 1..1100: mol_type = other DNA
ttggttttacgtagcgtttgtagattgtgagttcgtagggtagcgttatcggtttatgtagtagtcgtcggtagcgcgggtagtcgagtaggtcgcggggcgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcgtcggtatcgcggtatttgtttttttttagaggtttggtcgtttttataatttgtggtttcgtttaagtaagaatttaggaaaagttattaaacgtatta

SEQ ID NO: 10229 - DNA, 214 bp, synthetic construct
  misc_feature 1..214: note = Description of Artificial Sequence: Synthetic polynucleotide
  source 1..214: mol_type = other DNA
ggcgagagtaaaaaaaaaaaaaaaaaaaaaaaaaaaaattttaattgtaaatattatttggaggtgggcgagggcgcggcgtgcgcgcggcggcgggtggcgggcggcgcgggcgtttttgcggggattttcggttttttagcgcgttttagtggacgttttgtttttcgttggtttttcgtgttcgttataatttgtaatatattattttttt

SEQ ID NO: 10230 - DNA, 582 bp, synthetic construct
  misc_feature 1..582: note = Description of Artificial Sequence: Synthetic polynucleotide
  source 1..582: mol_type = other DNA
ttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagtt

SEQ ID NO: 10231 - DNA, 203 bp, synthetic construct
  misc_feature 1..203: note = Description of Artificial Sequence: Synthetic polynucleotide
  source 1..203: mol_type = other DNA
ggcgatattcgcgttagttttcgggacggttgggttcgggttggtcgtcgattttcgattttttattagatgtttggtagagttcggcgcgttcggagttcgcgttttttagagggaaggggtcgcgcgtcgtcgcggcggttttgaggttgacggtcgggaggtgaaaggtcggagtgcggggttaggacgttttttggagg

SEQ ID NO: 10232 - DNA, 823 bp, synthetic construct
  misc_feature 1..823: note = Description of Artificial Sequence: Synthetic polynucleotide
  source 1..823: mol_type = other DNA
cgagttattcgtatttttttttaggagttatagttaggttagaagagtgcggagggacggggttcgggaagagtagggaatttttagagttcgtagttaacgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcgttggttatgggcgagggtatttgtgagaagcgtcgggacgtcgagtatggcgttagttcggagtaggttgtaggtaacgcggtttggaataagtagttg

SEQ ID NO: 10233 - DNA, 293 bp, synthetic construct
  misc_feature 1..293: note = Description of Artificial Sequence: Synthetic polynucleotide
  source 1..293: mol_type = other DNA
tcgcgcggtttttataatgtagggatttttttgagtggtggtcgttttcgttttagttttcggttattcgtagttttatatcgggttattggtttattatcgagatagttagcgagtttaggcggtttttgtagcgttgggagaggaatgtgcgcgaaattaattagagcgaaattagtcggaggagtcggtcgaggtgtaggtgtaggcgtagtttcgtttagaattttttcgttatatttaagggagttggaagttcgggagggtgttgttttttttttttaggaatagag

SEQ ID NO: 10234 - DNA, 262 bp, synthetic construct
  misc_feature 1..262: note = Description of Artificial Sequence: Synthetic polynucleotide
  source 1..262: mol_type = other DNA
cggacgcgttgattggttttaggggaagcgggaggcgagaataatggtttttttttttcgttaaaagggagcggttgtcgggttcggggatagggacgcgcgtgtagggcgtagagttgggtcgagtcgtcgtcggcgttacgcgagtttcgtagtcgtcgcgttcgggtaatgggtcgggggtattgagggtcgtcggggtcgagcgcggaggggggatcgagttagtgtcgtgttttcgggtcgcgttaatatgtttcgc

SEQ ID NO: 10235 - DNA, 240 bp, synthetic construct
  misc_feature 1..240: note = Description of Artificial Sequence: Synthetic polynucleotide
  source 1..240: mol_type = other DNA
tcgttgcggggtggagggattcgcgttttttagtttttcgggttcgggtcgcggggatcgtgcgcgcgtttttttttcgggtaaggtcgggcggcgggcgcgtcgcggtttttggggttttcgtttttttgttcgttatcgtttgcgggagtttttggtttggaggggttcggggcgcgttggcgattgcgggttcggcgataggggcggttggtggcgggaggatagtgggaggaaggt

SEQ ID NO: 10236 - DNA, 1240 bp, synthetic construct
  misc_feature 1..1240: note = Description of Artificial Sequence: Synthetic polynucleotide
  source 1..1240: mol_type = other DNA
agcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtc

SEQ ID NO: 10237 - DNA, 222 bp, synthetic construct
  misc_feature 1..222: note = Description of Artificial Sequence: Synthetic polynucleotide
  source 1..222: mol_type = other DNA
gggcgatttgttgttttcgagtgtttttgggttgcgttttttttttttatttgggcggtcgcgttaagcgtagaggtcgcgggcgtttcggggttagaggcgttttcggttcgggttatggcgttcggcgtcgggggcgcgaggagcggtttatttagttagattttttatttcgttatcgttattagatattattatcgttgtgtagtgtgggtttttatt

SEQ ID NO: 10238 - DNA, 714 bp, synthetic construct
  misc_feature 1..714: note = Description of Artificial Sequence: Synthetic polynucleotide
  source 1..714: mol_type = other DNA
tttagggaaagtttttgaaagtataattcggaaaatttagtaatttttaaaaaaaaatggtttttcgttgttataagttttttttttaagatttagggttcgtagtagaatattttgatttaaaataaaaatattatgataaaaatattttaggaggtagtcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcgtgtttgtgttaggttttttacgttgtgttttagggttttagtgttcggcgcgtcgggggttgtatcgttagttatttggggtaggaaaaaggaattata

SEQ ID NO: 10239 - DNA, 1216 bp, synthetic construct
  misc_feature 1..1216: note = Description of Artificial Sequence: Synthetic polynucleotide
  source 1..1216: mol_type = other DNA
aagttttagaaacgttttcggaaagttttttttaatgggaagcgatttcgtcgttgagttaagcgttcgaattttttttttcgcggtagggatatcggttcgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcggtcgcgtcgcggtaggaggtgtgggaggtagcgaggggaagtcgaggtaaatttggtggcgtgggagattttacggggtttggggaattttagggtaag

SEQ ID NO: 10240 - DNA, 207 bp, synthetic construct
  misc_feature 1..207: note = Description of Artificial Sequence: Synthetic polynucleotide
  source 1..207: mol_type = other DNA
agtttttcgtaaatttcgtttttttcgtttggtacggtttttttgtatcgttgtgtttcgtttttaggtttttgttcgttaagaatgtttgtttcgggggcgcgttcgttggttaggaatttgtcggtagttttcgggaatttttgaggatgcggaggtgggttcgagagttgcggtttcgatgtcggggtgggagttaggtaggtc

SEQ ID NO: 10241 - DNA, 253 bp, synthetic construct
  misc_feature 1..253: note = Description of Artificial Sequence: Synthetic polynucleotide
  source 1..253: mol_type = other DNA
acgtttagggataaattgggagtcgtgattgttaggtcgcgcggaggttgttttggtcgtttttgcggttaggtgaaggcgtagaggtagggaggtcgggcgagcgtaggcgggcggagagtagattacgcggaagaggtcgagagagaaagcggggtattcggtcgggggggttatttataagggacgttgggtacgaaggaggttggggcgaagatgagtttaggggttgggttgagagcgttgcgtagtc

SEQ ID NO: 10242 - DNA, 209 bp, synthetic construct
  misc_feature 1..209: note = Description of Artificial Sequence: Synthetic polynucleotide
  source 1..209: mol_type = other DNA
ggacggtttgtgagggatgcgtcgtttattgtttcgcgtcgtttgatcgttttcgtttcgattcgcggtgcgttatagtcgggttcgcggtcgttttcgtcgcgttgtcgttcggtcgtcgcgttcgcggggtcgcgttcggtacggttatgtggatttttacggaggaggagaaatacggcgtaggtaggtgaggtttaggtttggtc

SEQ ID NO: 10243 - DNA, 225 bp, synthetic construct
  misc_feature 1..225: note = Description of Artificial Sequence: Synthetic polynucleotide
  source 1..225: mol_type = other DNA
cgttcggtttcgtttcgtaggttgtaggcggttttggagggggcgttttcgtcgagcgcgcgtttcgcgtcgtcgtttcggattttttttcggcgtcgcgcgggtaggttcgattaggcggtcgcgggtttcggttttcggttagttttttagggttcgcggttcgtttcgtttcgcgcgttcgtttcgttgcgtaattcgatttaagttggaagtcgatcgtag

SEQ ID NO: 10244 - DNA, 1133 bp, synthetic construct
  misc_feature 1..1133: note = Description of Artificial Sequence: Synthetic polynucleotide
  source 1..1133: mol_type = other DNA
aaggagagttggaagggttcgtgtagtaggatagcgggcggaagcggggcgggcgagcgcggggtcgtcggtcggtagtcggagtagttgtcgcggcgttcgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcgttttgtttcgtaggtgagcggttgcgtttttttattgtttttttttttttcgcgtttcgtcggcgttgaaaagttatttatttgcgtcgtttttttttt

SEQ ID NO: 10245 - DNA, 478 bp, synthetic construct
  misc_feature 1..478: note = Description of Artificial Sequence: Synthetic polynucleotide
  source 1..478: mol_type = other DNA
cggttcgggaggcggaaggtcgcggatttgttcgatagaagagtagatgaggggagatcgaggacgttcgggttcggggagtttacgaggaggttaggatcgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcgttcgggttttttaagttgttagtcgcgttcgttttcgggtttttcgttttttttttcgcgcgtttttttttttagcggtcgtcggatttttttagttta

SEQ ID NO: 10246 - DNA, 201 bp, synthetic construct
  misc_feature 1..201: note = Description of Artificial Sequence: Synthetic polynucleotide
  source 1..201: mol_type = other DNA
tcgtacgcggagtttataagttgtttgtgtcgttattttttcggttttggtatcgttagtattttttaggaattttttaaattcgttttacggtgtagaacggtaattgtatcgagtttttgtgttaattagtattttcgtaatatcgttagtcggttttttttttgttataatatattaaaacgtgttaaaatatattaa

SEQ ID NO: 10247 - DNA, 208 bp, synthetic construct
  misc_feature 1..208: note = Description of Artificial Sequence: Synthetic polynucleotide
  source 1..208: mol_type = other DNA
gatgagcgtcgtgtagtatttttggttcgcgttgtttgttcgtgtcggttataggttgtaggttagtagggcgagcgcggcgagtcgggtagggttcgttcgtttcgcgtagtttatcgttttttcggtagtcgtcgttgttcgcggatcgggtttcggggtcggcgtttagaggcggggcgggcgcggttcgggcggcggcgggagc

SEQ ID NO: 10248 - DNA, 210 bp, synthetic construct
  misc_feature 1..210: note = Description of Artificial Sequence: Synthetic polynucleotide
  source 1..210: mol_type = other DNA
atttcgtatacgtgtataaggtgttgaaataggtttatttcgatatcggtattttttttaaagttatggggattatgaatttttttgttaacgatattttcgagcgtatcgtcggcgaggtttttcgtttggcgtattataataagcgttcgattattatttttagggagatttagacggtcgtgcgtttgttgtttttcggggagttgg

SEQ ID NO: 10249 - DNA, 229 bp, synthetic construct
  misc_feature 1..229: note = Description of Artificial Sequence: Synthetic polynucleotide
  source 1..229: mol_type = other DNA
tggtttatttgagtttaggggtttgagattaggatgattaatatggtgaaattttgtttttattaaaaaatataaaaattagtcgggttatggtggttgacgtttgtaattttagttatttaggaggtcgaggtaggagaattatttgaatttaggagcggacgttgtagcgatcggagatcgtattatcgtattttagttcgggcgagagggagattttgttttaaaa

SEQ ID NO: 10250 - DNA, 209 bp, synthetic construct
  misc_feature 1..209: note = Description of Artificial Sequence: Synthetic polynucleotide
  source 1..209: mol_type = other DNA
aggcgggggagagagatgacgttggcggacgtggttagcgcgggggtcgggcggtgcgttgtaggttatttgtcggcgttttgagatttaggagttttcgcgttttcgcgtgggttttatagggtcggtttatagttttaatatagtagttgaatttttttcgttgcgtttttttttttttggaggggaatgttagaagagagagagag

SEQ ID NO: 10251 - DNA, 255 bp, synthetic construct
  misc_feature 1..255: note = Description of Artificial Sequence: Synthetic polynucleotide
  source 1..255: mol_type = other DNA
gaaggggtttggagttttttttttggggtattgtgttgggattttgaggattggggattcggagggagggtaggcgtgtttttaattcgttgcgtcggaacggcgtttgatgagcggcgggttcggatacgaggggacggggtcgatttgtgggcggggttttggcgtcgtattaaaatcgcgtggggcggaggtcggtagaggtcgcgtagcgggtttagggtagggagtggttttgattcgttgcggaataat

SEQ ID NO: 10252 - DNA, 297 bp, synthetic construct
  misc_feature 1..297: note = Description of Artificial Sequence: Synthetic polynucleotide
  source 1..297: mol_type = other DNA
aggtttcgtttattcgacgtaatttgttcgtttttttttatttttcgaagggtggagtttgaggtttcgtttttaagcggttttttttcggagtgtttggcggttagtagggcggggtaggaggttgggagagggacgggtgcgggggtgggggagaggaagggagcggttacgtgtgaggggcggttcgaggttacgtgacggagcgtcggagcggagggagtcggggttgggagtttttttgagggaagaggagtggagtaggggggacgcggcggcggcgttgataatggtgag

SEQ ID NO: 10253 - DNA, 232 bp, synthetic construct
  misc_feature 1..232: note = Description of Artificial Sequence: Synthetic polynucleotide
  source 1..232: mol_type = other DNA
gtgagttggttggaaagagggggcggagtgcgcggagttagagtcgttatcgttgtcgtagttgtcgttattgcggcgtttgggttgagtcggagggaggcgggaggacgcgtaggggcggtcgtcgtcgtcgttaggttatcggggcgaaaatgcggtcgttgtcggaggttcgttaatttttcggggtggaagaggaggaggaggaggaggaaggggtttggagcgatta

SEQ ID NO: 10254 - DNA, 247 bp, synthetic construct
  misc_feature 1..247: note = Description of Artificial Sequence: Synthetic polynucleotide
  source 1..247: mol_type = other DNA
tcgcgttcgtagtcgcgtttttgttttttcgattttcgtatttttatttggttcggttttttcgtttttttttcggtttttttttttaggatatttgtgtcgttttattttttttattatatacgtattttttattttaattttttcgtttttttgttttttttttttcgtcggtttttttttttcgttgttgtttcgagagttcgatgtgggagggaaggcgcgggggaggggaggtcgcgaaggg

SEQ ID NO: 10255 - DNA, 292 bp, synthetic construct
  misc_feature 1..292: note = Description of Artificial Sequence: Synthetic polynucleotide
  source 1..292: mol_type = other DNA
gtttttcgagttttttgcggcgatttcgatttattttcgcgggtgcggggcgcggattcgttcggtttagtttttgttttttaggcgtttttttttttcgcgatttgtttcggtcgtattcgttttcgttttagtacgcgacgttgttcggcgcgatttttgttttttcggtttagttttatcgttgttttcgatttaattttagttgaacgttcgtagttttagttttattttcggtttagttttagcgtttttagttttattttcggttttagttttagttttagcgttt

SEQ ID NO: 10256 - DNA, 201 bp, synthetic construct
  misc_feature 1..201: note = Description of Artificial Sequence: Synthetic polynucleotide
  source 1..201: mol_type = other DNA
gtagttcggttaacggacgggttagttggttttttttaggggtagttttgttttttttttcgtttcgttttttttttttttattatatcgggttgtaattcgagtcgtcgagttattgtttttttttcggatttttttcggaggttttgcggttcgggttttcgcgttttgttgttttatgtagttttgagttttatagta

SEQ ID NO: 10257 - DNA, 201 bp, synthetic construct
  misc_feature 1..201: note = Description of Artificial Sequence: Synthetic polynucleotide
  source 1..201: mol_type = other DNA
ggttacgcgtgtttttggcgcgagtgtgcggggttaggtcgggagggcgtgcgcggatcgggcgtgtttacgcgcggtagggaggggttacgagggtgcgcgcgtttttggcgcgagtgggaagtgtggggattcggcgggttcggtgtgaggggcgtgtttttggggcgagagtggggagtgagtgtgaggagtaagggt

SEQ ID NO: 10258 - DNA, 201 bp, synthetic construct
  misc_feature 1..201: note = Description of Artificial Sequence: Synthetic polynucleotide
  source 1..201: mol_type = other DNA
gggcgcggtcgggtaggttggggggtaggtaggggtcgttttcgcggggcgggaatttcgcgtttttttttttcgagttttattttttatggtaaagcggcgtggggcggcggggcggagggagtcgagggggcggggagggcggacgggcggaggggacgggaggtttagcggtttcgggtttcgttggttcgggcgtcg

SEQ ID NO: 10259 - DNA, 201 bp, synthetic construct
  misc_feature 1..201: note = Description of Artificial Sequence: Synthetic polynucleotide
  source 1..201: mol_type = other DNA
attttttttttttatttttttttttttttttttattgttttttttatttttttttttttttcgtttttttttttggtttttttttttttcgttcgggattcggggggaggcgcgttgggtggttcggtagtcgggggcgggcggtagtttgtaggcgtaattggtatgtacgtcgttgtagttgagatcgtttaataaagt

SEQ ID NO: 10260 - DNA, 201 bp, synthetic construct
  misc_feature 1..201: note = Description of Artificial Sequence: Synthetic polynucleotide
  source 1..201: mol_type = other DNA
tcgttttcgttaaaggtttttttaaggggtcgttttagggtttcgtttcgtgtttcgtttcggcgtttatttcggcgttcgtttttttttttttttgttgcggtttcggtaggggttgttgcggcgatttaggttgttgcggttttagttttattagttgttgttgttttttaaggagacgtcgtcgatagcggagtagtg

SEQ ID NO: 10261 - DNA, 201 bp, synthetic construct
  misc_feature 1..201: note = Description of Artificial Sequence: Synthetic polynucleotide
  source 1..201: mol_type = other DNA
gtgcggtcggggcgttgttcggtagtgcggtgtttacgggattgataggtaggtaggtcgcgggttgggattcggatattaaagtaaaagtatcgttgggcgtcggaggagtcgcggggtttttattttttttttgattgatttttaaattttaatttgtatttttttcgtcgtttcgttttttttttttcgatttcgttt

SEQ ID NO: 10262 - DNA, 201 bp, synthetic construct
  misc_feature 1..201: note = Description of Artificial Sequence: Synthetic polynucleotide
  source 1..201: mol_type = other DNA
tatcgcgtcgtgcgttcgcgttcggtcgttaggtgttttagtagttcgatcgtcgagatgtttagttcgtcggggtttcgggcgttatggttttgcgtcgcgttgtgcgtttttcggagggtcggcggcgttttttagttcggttcggggtttatcgtttgttcggttttttgttattgttaggaggacggtattatgttg

SEQ ID NO: 10263 - DNA, 241 bp, synthetic construct
  misc_feature 1..241: note = Description of Artificial Sequence: Synthetic polynucleotide
  source 1..241: mol_type = other DNA
ttgcgcgttttggcggtaggaggcggggtcgggggcggggcgtgagttggtcggggcggggtttatggaggggcgggatcgcggcgttttataagtattgcggagcgaggcgcgcgttcggttagagagcgagcgcgtaacggcggcgacggcggcgattttatcgcgtattttgttaggttttcggcgtttagcgttttacgcgttttcgcgttttcgcgttttcgcgttttttttttcg

SEQ ID NO: 10264 - DNA, 201 bp, synthetic construct
  misc_feature 1..201: note = Description of Artificial Sequence: Synthetic polynucleotide
  source 1..201: mol_type = other DNA
ggcggtaggcggcgcggcgggttgggcgcggcggtggttaggtcggtgcggttgtagtttatgtatagcgtgttagggttgttttgttcgggtagtcggtcgtagcgtatgcggtcgggttaggcgaagtcgtattggcgtatgagcggcgcgtagtcggttttggcgcgttcgtatatcgagcggtagggcggtagcggt

SEQ ID NO: 10265 - DNA, 201 bp, synthetic construct
  misc_feature 1..201: note = Description of Artificial Sequence: Synthetic polynucleotide
  source 1..201: mol_type = other DNA
aagtggggtgaaaatgattttagtgaatagtttagttttttgggatagtggtttggtatttttgacgtgggagtggcgtttgttttgatttaatttggatcggtttagggataatatttttttcggagtagtcgttttgtttcgtttcgagtagtttagttgcgttttgtatgatcgaattggatattttttatttttttt

SEQ ID NO: 10266 - DNA, 201 bp, synthetic construct
  misc_feature 1..201: note = Description of Artificial Sequence: Synthetic polynucleotide
  source 1..201: mol_type = other DNA
ttcgcgtttgtttcgtattacggagtcgggtttttagagtagtaaggttattaggtggcggtgttggcgtagtaggcggagcgtcgggtgcgcggggtcgcgtttttggttttcgaaggtgatgaagatgggtttgcgggtgagttttagtagtcggtataggttttttttgcggggcgggatcgttaggggggtgggtgt

SEQ ID NO: 10267 - DNA, 201 bp, synthetic construct
  misc_feature 1..201: note = Description of Artificial Sequence: Synthetic polynucleotide
  source 1..201: mol_type = other DNA
acggttgggttttaggagatattcggaggggttcgcgggttcggttcggttttttcgttggggggttattagtcggtcggtagcgagatatttagaggttcgtttttttatcgcgttgttatagtaacggtttggtcggttgcgtttcgggtcgttcgttttatttcgcgggttcgttttgagttagtgattttagggatt

SEQ ID NO: 10268 - DNA, 201 bp, synthetic construct
  misc_feature 1..201: note = Description of Artificial Sequence: Synthetic polynucleotide
  source 1..201: mol_type = other DNA
tttagatggttttaattattggaggaaaaaagcggtttttttggtatgcgtgaaaagtcggagttgggagagtttgggaaaagttgtttgtatcgttcgtcggtttttaaataaatcgatgagttttttttttttttttagttttcgggtttcgggggagttttataaaatttaaatgaaatttaaagaagttatttttgg

SEQ ID NO: 10269 - DNA, 201 bp, synthetic construct
  misc_feature 1..201: note = Description of Artificial Sequence: Synthetic polynucleotide
  source 1..201: mol_type = other DNA
ttataaagtattagtggtgttttttcgaggaatttaagatttttcggtcggttgttaagtcgtcggaattttagtaggagaggaaggtttatttttttatcgtatggcgatgttcgggagattggagaagtttaggtaggtttggaagttaattttcggtatatagtagttttcgggaatgtagagttttagagtaagatt

SEQ ID NO: 10270 - DNA, 201 bp, synthetic construct
  misc_feature 1..201: note = Description of Artificial Sequence: Synthetic polynucleotide
  source 1..201: mol_type = other DNA
tagtagagacggggttttaatatgttgtttagggtggtttcgaatttttgagtttaggtaattcgtttattttatttttttaaagtattgggattataggcgtgagttatcgcgttcggtttgatagtttttttagaatgaagtttgtttcggaaaaaagagttttggttagtgttttttttggggattagcggaaagtat

SEQ ID NO: 10271 - DNA, 201 bp, synthetic construct
  misc_feature 1..201: note = Description of Artificial Sequence: Synthetic polynucleotide
  source 1..201: mol_type = other DNA
aggggagttgaggggcggagttatcggggcgcgttttcgcggttgcgttttttttcgtcggggagcgcgggtacgtaattcggagggtgttgggtcggttcggagtacgcgagtagcgggaggagggatcggggaatgattgacggaggcgggtcgtagaggtcgttgtgtttcgtcggttcgtattcggtcggagtgtgc

SEQ ID NO: 10272 - DNA, 201 bp, synthetic construct
  misc_feature 1..201: note = Description of Artificial Sequence: Synthetic polynucleotide
  source 1..201: mol_type = other DNA
ggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcggggg

SEQ ID NO: 10273 - DNA, 201 bp, synthetic construct
  misc_feature 1..201: note = Description of Artificial Sequence: Synthetic polynucleotide
  source 1..201: mol_type = other DNA
cggggagggaggttttcggaatttcgagagagtattcgtgtttcgcgggtttcgtgtttcgttttcgggtttttttttttttaacgtaggggatttagttcggggtagtgtcgggtattggcgttggcgtttcgtttagttttgcgattttttttcgtttcgttttttttcgtttcgtttcgttttttttcgtttcgtttt

SEQ ID NO: 10274 - DNA, 239 bp, synthetic construct
  misc_feature 1..239: note = Description of Artificial Sequence: Synthetic polynucleotide
  source 1..239: mol_type = other DNA
agagggcgagcgagagagagatatatatatatacgtatacgtatacgtaggttatatgaatgggaggcggtagttaattttacgaggtcggcgagtcgcgcggcgtattggcgttgggagtagggtcgtatttcggcgcgggggggcgttacgtaggtgatgggcgttttttcgggggttacgcgcggtcgtttttttattttagtttcggtttttttgtttttttttttttttttttt

SEQ ID NO: 10275 - DNA, 201 bp, synthetic construct
  misc_feature 1..201: note = Description of Artificial Sequence: Synthetic polynucleotide
  source 1..201: mol_type = other DNA
tttttcgtttttatttatttttttttattttttttttttttttttcgttagtttcgtatttattttttttatttcgtaatttttttttgtttttatttatcggggttatggtcgtagaagaggtattgtagacggtggattattataagattgagatagagaggttaattaaggagtttacggagattatttacgagaaga

SEQ ID NO: 10276 - DNA, 201 bp, synthetic construct
  misc_feature 1..201: note = Description of Artificial Sequence: Synthetic polynucleotide
  source 1..201: mol_type = other DNA
ttgtcggggagaatatgtattaggtggttgatggttttgtggatgtggtggtttgtattttggtgttgtgttttgtgaagaattaggagcggatttttcgcgaggtgtgtagagtgttgagatcggtgagtgaaagggtgtgaggaggattagttagtagtagttattattatagagggtaggtttgttaattttaggtgg

SEQ ID NO: 10277 - DNA, 201 bp, synthetic construct
  misc_feature 1..201: note = Description of Artificial Sequence: Synthetic polynucleotide
  source 1..201: mol_type = other DNA
gaggcggaatttaacggaagtgaagaaaagattaacgggaaagaaggacgagtacgcggtttcgggatagatttttaaagtttttttttgcgttttttggcggtcggagggggagtagcgcggatacgtttttcggttaatcgttggttattaggttggagtggggtttttttttgttgttttttatgagattattgtttt

SEQ ID NO: 10278 - DNA, 201 bp, synthetic construct
  misc_feature 1..201: note = Description of Artificial Sequence: Synthetic polynucleotide
  source 1..201: mol_type = other DNA
gcgattacgggtttcggcgaagatgcgtcgtttgagcgttcgcgcggttttcgttcggggcgggcgtgatttttgttgaacggagattttttttttttttcgatttcggacggcgtaggtcggcgttaggatagtttttatcgatagcgtttttttttattcggagagaggtatcgatttttaaggagggtttcgttaggt

SEQ ID NO: 10279 - DNA, 201 bp, synthetic construct
  misc_feature 1..201: note = Description of Artificial Sequence: Synthetic polynucleotide
  source 1..201: mol_type = other DNA
tcgttttcgtcgttcggggtaggcgcgtcgatggcgtttttgaggtgacgtcgtttatatcgggttttttcgggggcggaggaaatatttatgaatttttcggtagttttttttgtcgggcgttaggtaagtagcggtttcgggcgcggcggggcgtcgcgggaacggtgtatattggtcgaaatttattgttttttaaga

SEQ ID NO: 10280 - DNA, 201 bp, synthetic construct
  misc_feature 1..201: note = Description of Artificial Sequence: Synthetic polynucleotide
  source 1..201: mol_type = other DNA
ttcgttatttggggcgtttggggggttttggggcgggggaggcgggggttttgtttaatttcgttattgttattatcggttaggtcgcggtttggtaattcgtgaataggaggtagggttgtagggcgtgagggatgatgataaggaagtcggaggagtagcggcggtagcggagagtttattttggatgtaaatggtagg

SEQ ID NO: 10281 - DNA, 201 bp, synthetic construct
  misc_feature 1..201: note = Description of Artificial Sequence: Synthetic polynucleotide
  source 1..201: mol_type = other DNA
atttcgcgttttgcgttttaattaggattgtttcgcgcgtttttgagtttcgggtttcggttcggatttgtagttttttaggtggttgggaaggtaggtgcgtcgttgttttcggcgcgcggcgtttcgcgaggtttttagttttcgttttggtggattttcgttgggtgggagtcgggagtggaggcggtcgttttaggg

SEQ ID NO: 10282 - DNA, 201 bp, synthetic construct
  misc_feature 1..201: note = Description of Artificial Sequence: Synthetic polynucleotide
  source 1..201: mol_type = other DNA
cgattcggtcgtgagcgtgtttcgttgtagttcgttgttcgttaggttcgggtggtagcgtaggatgtttttttggtttgcggagaagtatagatatcggcgggagcgcgttaatcgcgttcgtttcgtatcgcgtattcgagggggcgcgtaggtcgcgttcggtttttttgtttcgtttcgtttcgttcggttttaaag

SEQ ID NO: 10283 - DNA, 201 bp, synthetic construct
  misc_feature 1..201: note = Description of Artificial Sequence: Synthetic polynucleotide
  source 1..201: mol_type = other DNA
cggtttgggaaggtttcggtttttcggttgcggttttagttcggacggcgtcgcgtaattttgttatttttttggtttagtttcggttataggaggatttcgcgggtaacgcgcggagtttttggtatttttcggcggtgttttttgttgtttgttcggggatcgatttcgtatgtttttaggttgatttgtttaagttcg

SEQ ID NO: 10284 - DNA, 201 bp, synthetic construct
  misc_feature 1..201: note = Description of Artificial Sequence: Synthetic polynucleotide
  source 1..201: mol_type = other DNA
gtaatttcggcggagtcggcgtttttgggtatttttggttttcgcgtttcggtcgtacggtgattattcgggaggggatttcgggcgtttcgtaatttttcggttttcgtgggttttcgggtcgtttcgtttttcgtcgtcgcgtatttttcgcgtttttcggttttcggtgtcggttttcgtttcgcgtagtttcgagtt

SEQ ID NO: 10285 - DNA, 201 bp, synthetic construct
  misc_feature 1..201: note = Description of Artificial Sequence: Synthetic polynucleotide
  source 1..201: mol_type = other DNA
aggaagttcgaggtcggggcgttattttaagggttttttcgtttttttttcgagggtagagaggcgttcgcgttcggacgtattgcgggaatatttggagcgtcggcggagttcggttgttttcgcgggagggagttcgacgcgtatttttgggattcggattcggcgttcgcgtttcgggacggatttttgtttcggttg

SEQ ID NO: 10286 - DNA, 201 bp, synthetic construct
  misc_feature 1..201: note = Description of Artificial Sequence: Synthetic polynucleotide
  source 1..201: mol_type = other DNA
tcgtttgtaggttgtttcgggtcgagtcggagcgacgttgtcgcgtatttgggtagttttcgggggtcgcgttgtgttacggtcggggtcgttgcgattgcggcgtttgtatttgttacgtgattgagtcgggtatgtttttcgggtttttgtgtgagtgttatgagtgggtgtgcgagatttacgacgggagtatttgtg

SEQ ID NO: 10287 - DNA, 201 bp, synthetic construct
  misc_feature 1..201: note = Description of Artificial Sequence: Synthetic polynucleotide
  source 1..201: mol_type = other DNA
tacgtttggggcggtcgggggcggggtttggttggaattgacgcgtggagtttcggtggagggggcggggtttggttgggtcgttgtttatagcggttttcggggtttggaggttacggggttcggaggttacggggttcggaggttacggggttggttgtgtggggggtttaggggcgtagagtggttaagtagcggttt

SEQ ID NO: 10288 - DNA, 201 bp, synthetic construct
  misc_feature 1..201: note = Description of Artificial Sequence: Synthetic polynucleotide
  source 1..201: mol_type = other DNA
ggttttgtagttttgtagcgttcggggcggtgtaggagtttcggggtgtcgcggcgttcgttcggttgtatcgttggtttttcggttcgggttttaggttcggcgttttttatttttaggtcgcgcgcgtttcgttttttcgacgatttttagtttcgggttttcgttatttacgagttttcgttttcggtgagttgttgt

SEQ ID NO: 10289 - DNA, 201 bp, synthetic construct
  misc_feature 1..201: note = Description of Artificial Sequence: Synthetic polynucleotide
  source 1..201: mol_type = other DNA
gcgttttcgggggttgcgtcgtgtcgtttgttgtgcgcgcgtagaggtcggatagttcggttgcgggaagggattcgagcgtagggtttgtttcgcgtttcggaaagtgtttagtttgcggagtcggaggttgagttggggtagatcggcgttagacgggggtttgggtgagatacgagttgggggtgcggtttgtagaat

SEQ ID NO: 10290 - DNA, 201 bp, synthetic construct
  misc_feature 1..201: note = Description of Artificial Sequence: Synthetic polynucleotide
  source 1..201: mol_type = other DNA
ttttttttattattttttcgtttttttattttttttttttttttgttttgtaggattgagtagttaggcgcgagcgaaaataaatagttggggttgcgagcgttttcgtttcggtttcgagagtacgtcggtttagttttttatttggggcgttcgtttgtttattatgaggaagattcgcgttaatgttatcgttatttt

SEQ ID NO: 10291 - DNA, 201 bp, synthetic construct
  misc_feature 1..201: note = Description of Artificial Sequence: Synthetic polynucleotide
  source 1..201: mol_type = other DNA
gttcgtgtcgttgttgttggttttagcgttcgggttttcggtgagtgcggttttgtttcggttttcggaggaatttgtaggggagtcgggggcggggacgcgcgggttcgtaggtaacgtttttaggaaaggggcgatgttagggaagttgggttgggaggaggcgagttcgtatcgttgagtttttttagaaagggttgg

SEQ ID NO: 10292 - DNA, 201 bp, synthetic construct
  misc_feature 1..201: note = Description of Artificial Sequence: Synthetic polynucleotide
  source 1..201: mol_type = other DNA
cgttgggcgtcgttcgtcggtttaggcgcgcgaatttggcgtttttagtgaattattcgcggttcgggcgttcgggttcgggatcggtttttttttttttcgttgagtcgcggtcgagttggttttttgtattttatttagcgtcgtcgggacgcgattatatcgagatggtatcgagttttttttaaaggtttcggtttg

SEQ ID NO: 10293 - DNA, 201 bp, synthetic construct
  misc_feature 1..201: note = Description of Artificial Sequence: Synthetic polynucleotide
  source 1..201: mol_type = other DNA
gttttagtttttgggtcggaagtttttttttttttttcgtcgtagtttttttttagttttttttttttcgtcgatgcgggaaatttttttcgtttcgtttcgttttttttttttagttgtattttcgttcggttttttcgtttagtttttaatttaggtttcgtttttttttatttatttttcgttttgggtcgggttttc

SEQ ID NO: 10294 - DNA, 201 bp, synthetic construct
  misc_feature 1..201: note = Description of Artificial Sequence: Synthetic polynucleotide
  source 1..201: mol_type = other DNA
gatggcgacgcggatttgtatcgtcgttttgggttcgggtcgagttttttcgtcggattgggttatggttcgcgggattgcggcgtcgtcggggtttttacgtcgtaaggtttagttagtcggtcggtagcgattgcgacgagggggcgggggcggtgcgagcgcgtttgtcgttcggtttaggggagggataggggtcgc

SEQ ID NO: 10295 - DNA, 201 bp, synthetic construct
  misc_feature 1..201: note = Description of Artificial Sequence: Synthetic polynucleotide
  source 1..201: mol_type = other DNA
gtttgtttcgtcgttcgggttttgtggttggttattcgcgagttcgtttcgttttttttgtttcggttcgttcggttcgtttcggggttttcgtcgtaatcgagcggagtttagcgattcgtcgggtttatattagcggtcgtttttttcgaagcgtttttcggtagcgttcgggttttcgcgtttcggaatatttatgaa

SEQ ID NO: 10296 - DNA, 241 bp, synthetic construct
  misc_feature 1..241: note = Description of Artificial Sequence: Synthetic polynucleotide
  source 1..241: mol_type = other DNA
cgcgttggttcggtttttagttttttcggtcgtcgtttttcgttcgtcgcgtcgcggcgttaggagggcggggtcggggcgcgcgtcgttttttagtaagcgggcgggcggcgttcggtttgagggagcggggcggttttcgtcggcgtcgcgcgcgttgtgtgtgagcggggtcgcgcgcgcgcgcggtaggcgagtgagggaacgaggagcggtcgggtgtgagtgtgtgggagtgaga

SEQ ID NO: 10297 - DNA, 201 bp, synthetic construct
  misc_feature 1..201: note = Description of Artificial Sequence: Synthetic polynucleotide
  source 1..201: mol_type = other DNA
ggtgttaagcgtggggcgcgggttcgcggcgggagttgttcgcgaaatttagtgttgaagtaggcgcggacgtgttcggtgtttggcgcgtggtagtaggcgttcggtgtttcggtcggcgaagattatggcgtttatggtgaagattatggtgggcggttagttgaagaattttattgggagtttgggaggcggcgagga

SEQ ID NO: 10298 - DNA, 201 bp, synthetic construct
  misc_feature 1..201: note = Description of Artificial Sequence: Synthetic polynucleotide
  source 1..201: mol_type = other DNA
gcgcgggacggagttttatgaaagttggaagaagtgattataaatcgggattcgattttcgtagttttggcgttcgtttttttacgtaggttcgggatgtcggttttagtttttagatgtcgggaagacggcgtcggttagtttaaggaagagtttttaggaggttggggagtaagggtgtcgggttttttatgtcgggtt

SEQ ID NO: 10299 - DNA, 201 bp, synthetic construct
  misc_feature 1..201: note = Description of Artificial Sequence: Synthetic polynucleotide
  source 1..201: mol_type = other DNA
ttttgttggttagagtcgggtacgggtcgggcgggcggcggggatcgtgatcgcggttgcgtgcgttcgcgttcgggcgtttttgtgcggggttttggtacgtcggcgggggcgattcgggtgtcggttcgtgcgggcgatacgcgcgtttttgcggggttgcgcggggttcggagcggttgggggttttttgtcgggcgc

SEQ ID NO: 10300 - DNA, 201 bp, synthetic construct
  misc_feature 1..201: note = Description of Artificial Sequence: Synthetic polynucleotide
  source 1..201: mol_type = other DNA
tagatttcgtcggtcggcgcgttattcgcgttagtattatggatagcggtcgttttagtcgcgcgtttagggttaggttcgggttggtttttatcgcggacggttgcggggtcggggtagtttcgtaattttaaatttcggtagttttcgtttagtagggaggggtttcgggggcgaagagtgggggagaagtcgggaagg

SEQ ID NO: 10301 - DNA, 201 bp, synthetic construct
  misc_feature 1..201: note = Description of Artificial Sequence: Synthetic polynucleotide
  source 1..201: mol_type = other DNA
gtgtgagtttcgggggttcgggtcggcggttttgttagtcgggtcgtgcggttgcgggggtggggcggcggcgtcgttgttatattagtttcgggagcggcgagagggaggttggggtgggggcgcgaggggggcggcgcgaggggggtcgattttgcgggtaggtgatattatatttcgaaggttttagtgcgcgggcgg

SEQ ID NO: 10302 - DNA, 201 bp, synthetic construct
  misc_feature 1..201: note = Description of Artificial Sequence: Synthetic polynucleotide
  source 1..201: mol_type = other DNA
gtcgcgttatggtgagtcgggcggggtaggtcgcgcgttcgggtcgggcgggggcgtcggggttcgggggcgggaagggggaggttaggacgaggaggggcgcgcgcggcggcggggtcgggtcggggtttgcgggcgggggaggggcggttcggcgggcgcggttcgggggagggttcgttttaggggtcgcgttcgcgg

SEQ ID NO: 10303 - DNA, 201 bp, synthetic construct
  misc_feature 1..201: note = Description of Artificial Sequence: Synthetic polynucleotide
  source 1..201: mol_type = other DNA
taatcgggtattttcgcgcgtatacgttcgtgtttacgtgtgtacgtttatatttttgtatatatttaggcgcgcgttggtatatttattcggagaatttcgtatatatacgtattcgtaaatacgcgggttttttgcgttattaggaagtagtcgttagaatcgtcgggtgttttttaattatttttgggagatttggtt

SEQ ID NO: 10304 - DNA, 201 bp, synthetic construct
  misc_feature 1..201: note = Description of Artificial Sequence: Synthetic polynucleotide
  source 1..201: mol_type = other DNA
atacgatatggttaagcgtcgtcgttcgaatcggtcgtcgtcgatatttcgtttcggttcggggttgaggaggaagtcgagaaggaggaggaggaggcggcggcggagggcgggggaagaggacggtcgtttcgggtttcgtttgagttcgtagggtaggacgagggagcggcgcggtgagagaggcggatgaaggcgagg

SEQ ID NO: 10305 - DNA, 201 bp, synthetic construct
  misc_feature 1..201: note = Description of Artificial Sequence: Synthetic polynucleotide
  source 1..201: mol_type = other DNA
cgcgtatagcggcggcgagtgggtcgtgtacgcggatgcggggtgggagtgggggcgtacgcgcgggcgtgggcgagcgggtttcggtagtgtatatatacggtaggggcgggcgatagatgtagtgcgtgcgtcggagtttaagcgtataaacggaaagagcgggcgcggtgcgtaggggcgggcgtttagcgggtttgg

SEQ ID NO: 10306 - DNA, 201 bp, synthetic construct
  misc_feature 1..201: note = Description of Artificial Sequence: Synthetic polynucleotide
  source 1..201: mol_type = other DNA
ttttaggggagttaagtagttcgtttgaagttttttatttggaaatgacgtgtttaattcggcgtttttgtagtttcggtcgtttttttttgtttaatttcgcgtttttttagtttcggtcgtttttttcgtcgtttttttttcgcggtcgtttatttttgagatttttggttttattgagacgtttagttttattcggta

SEQ ID NO: 10307 - DNA, 219 bp, synthetic construct
  misc_feature 1..219: note = Description of Artificial Sequence: Synthetic polynucleotide
  source 1..219: mol_type = other DNA
ygtttgtttygtygttygtatyggtttagttttyggygttygttygtttttttygttyggagygttgtgagttaggagtagtygtaggtttttyggaygygttygtygygygtattaygtggttyggaggyggtygttagtttgygttygygatygggggyggaygttgtattatyggttyggagttgggtaggggaggtttttygttttttttttagg

SEQ ID NO: 10308 - DNA, 315 bp, synthetic construct
  misc_feature 1..315: note = Description of Artificial Sequence: Synthetic polynucleotide
  source 1..315: mol_type = other DNA
gaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyg

SEQ ID NO: 10309 - DNA, 201 bp, synthetic construct
  misc_feature 1..201: note = Description of Artificial Sequence: Synthetic polynucleotide
  source 1..201: mol_type = other DNA
ygygtygttttagygttttgtagyggaggygtygtttttatttygatygtaggttygttygggtygttygttygtygggtatygagtygttttgtygygygttgygtttyggggyggggtgggaggagagggagtagtygttattttgtttaggtygtygygggttagttttgtagttagttttagttttgggtygggtgt

SEQ ID NO: 10310 - DNA, 201 bp, synthetic construct
  misc_feature 1..201: note = Description of Artificial Sequence: Synthetic polynucleotide
  source 1..201: mol_type = other DNA
gttyggagyggtygtgaggggyggayggggggtttyggggygggtttgtaggttttggggatttgaggttgtygggaggggttgttagggggygttggtygggygtygggttttgyggagttggggygtygatttttgattygygagaggggygttttygtygtgttggtygtagttgttatttttagygtttttattatt

SEQ ID NO: 10311 - DNA, 201 bp, synthetic construct
  misc_feature 1..201: note = Description of Artificial Sequence: Synthetic polynucleotide
  source 1..201: mol_type = other DNA
yggyggtgattgyggtttygygygyggttyggtttaggtaggattygaagygyggtttygggyggyggyggyggyggyggyggygtggtttygttygggygggttttgygggataagayggggagtyggttayggggtggggygattggygtttygggagtaggaggagaatygygggtaggygggyggggagggtgygyg

SEQ ID NO: 10312 - DNA, 201 bp, synthetic construct
  misc_feature 1..201: note = Description of Artificial Sequence: Synthetic polynucleotide
  source 1..201: mol_type = other DNA
aagtttttygtttagttttgtyggttyggtttgggygttgtggatyggtaatagtagttttattaggatgtaggtyggattaagtttttggggaaaattygttgtaataattgttttttatatataatttttaattttttttttattttygtttttaattyggagatttgtaaagtttaagaaagggaaaagtaattttat

SEQ ID NO: 10313 - DNA, 201 bp, synthetic construct
  misc_feature 1..201: note = Description of Artificial Sequence: Synthetic polynucleotide
  source 1..201: mol_type = other DNA
tagtatygtttyggtttygygttaggyggygggggaggggaggagggatttttttaggggtgggtttggagggggtgggggyggttttttttttygtttygtygygggtttattgttygggaggggyggggagatagtggggggtagtttygggygggagtggaggyggagatgtygtygtygtagtygtygyggtggttg

SEQ ID NO: 10314 - DNA, 201 bp, synthetic construct
  misc_feature 1..201: note = Description of Artificial Sequence: Synthetic polynucleotide
  source 1..201: mol_type = other DNA
ttttatgaygtygaattgtttgggggatygttagyggtgygtyggtyggagttagttggtggyggggygggyggttyggagtgtttgtttaattttgagygttygygagggggaggggaggtagttggttaygggttagggggtagtaaggtggaggagygggggttgggaaaggggagggtatttttygggttgtttgtt

SEQ ID NO: 10315 - DNA, 201 bp, synthetic construct
  misc_feature 1..201: note = Description of Artificial Sequence: Synthetic polynucleotide
  source 1..201: mol_type = other DNA
ttttttygttttagttagayggggygttygygttttttttttygtttygygttggtttttaataggaagtygtttyggtttttagtaygtgatttttatygtatttgtatatyggagggygaattggttaatyggtattttgtatttgagtttttttttygygygtttttttyggtttattggtttttyggttaggttayg

SEQ ID NO: 10316 - DNA, 201 bp, synthetic construct
  misc_feature 1..201: note = Description of Artificial Sequence: Synthetic polynucleotide
  source 1..201: mol_type = other DNA
gtygttatygttatygtagttgtagygtttttttatatttttagygygtygtyggtygggtagtttggtygyggtayggaggaggggttttggagggggyggtygggggaggygaygtygagttatygttttygggtagtygtygtygggggggagygyggagatttgaaagggygygtygggtaaygttttttttttttt

SEQ ID NO: 10317 - DNA, 201 bp, synthetic construct
  misc_feature 1..201: note = Description of Artificial Sequence: Synthetic polynucleotide
  source 1..201: mol_type = other DNA
ttattgttttttgggyggtgtggattagttgtagagtgtgatttgyggttagggagtgttttttyggagttttygtttttagatttttggtgttaaagaygttttgtgagygggtggggtygggygttttagttayggyggtygtygtttttttttttygtaggaygggatagygtttttgtggatygygttttagatggg

SEQ ID NO: 10318 - DNA, 201 bp, synthetic construct
  misc_feature 1..201: note = Description of Artificial Sequence: Synthetic polynucleotide
  source 1..201: mol_type = other DNA
ygtggaggygataggygtyggygataattttttagttygggygtygygygtygtttygygggaygygtattggggatttyggtygtttttttygtttttygygyggatataaagttyggtagtygyggygtttagagggtygagggttatyggatagttygggtagattttggattygtttygygggagttgtttttttgt

SEQ ID NO: 10319 - DNA, 243 bp, synthetic construct
  misc_feature 1..243: note = Description of Artificial Sequence: Synthetic polynucleotide
  source 1..243: mol_type = other DNA
aaggttggagggtgttagaaagatgatyggtygggtayggagyggggagttyggagtygygygtggggaggggaggtggaggagggggygtygggggagyggggggygygtgaggggtgygagyggggttyggggggygygyggtgggtgtggggggygtygggtttatttatttttygttagygtygttattgtyggttatatgattgaggttgttgttgggatgayggttygggttttagt

SEQ ID NO: 10320 - DNA, 201 bp, synthetic construct
  misc_feature 1..201: note = Description of Artificial Sequence: Synthetic polynucleotide
  source 1..201: mol_type = other DNA
ttttgtatttgtaatttttyggggtagtgatatagttggtttyggtgttttggyggagggtagaagtgatggtyggttgyggttttgtagggtgagaatygggttagataagtgagtgttttagagtyggggagttgtatayggaggggagggagtggygggygttgygtygggtttttttaggaagaggtgagygggttg

SEQ ID NO: 10321 - DNA, 201 bp, synthetic construct
  misc_feature 1..201: note = Description of Artificial Sequence: Synthetic polynucleotide
  source 1..201: mol_type = other DNA
ygaatgtggttaagggggtygtttagatgggtgtagatayggttaagatygtgttgatyggtattaaggatattgtttgtagtggggttatyggtgttgygaaygtggttaagggtgttgtgtaaattgggttgaaaaygatttaaaatatygtaataggtataaagaatatttttggtagtggggtgatyggtgttgyga

SEQ ID NO: 10322 - DNA, 201 bp, synthetic construct
  misc_feature 1..201: note = Description of Artificial Sequence: Synthetic polynucleotide
  source 1..201: mol_type = other DNA
gtygygtttttgggaayggttagggaagtaagtagaagtygggaagtygygaaagaggygagaaagtgygattttttttttagattttyggtttttygtygaaatttttgtyggtyggttaaattttagataatggaagttttaygtttttatttttatttttttttataagttyggtygygggtttttttyggttyggga

SEQ ID NO: 10323 - DNA, 201 bp, synthetic construct
  misc_feature 1..201: note = Description of Artificial Sequence: Synthetic polynucleotide
  source 1..201: mol_type = other DNA
tgtgaygattttttaagggggttttgtgagtattttttttttatagttaggaaattgaggtatagaagggagggattgtttggtaggagttaatagaggygtatagagtagygtgatgagtttygggttttgggggygggttygygagtaggtagtttttattttatggtggatttttaggtttttttttttgtttyggtt

SEQ ID NO: 10324 - DNA, 201 bp, synthetic construct
  misc_feature 1..201: note = Description of Artificial Sequence: Synthetic polynucleotide
  source 1..201: mol_type = other DNA
tayggagtttttttaygygtttattgyggtttygtygtgttaaggggagtttggttgtttaygggttttatttgttagygagaagatagtttggtygggyggttgattttattttgtaattttgatattgtgtttttygggtttgtyggttttatgatttgtgtttaaagtttgatttttygtagattaggtaaaagttaa

SEQ ID NO: 10325 - DNA, 201 bp, synthetic construct
  misc_feature 1..201: note = Description of Artificial Sequence: Synthetic polynucleotide
  source 1..201: mol_type = other DNA
ttttgtgtttttayggygygtagaggyggygtygygaattttgtgtgtattttataygayggyggggattgaggtttttygtagtttagagtyggagttyggggtyggtygagttygtaggatyggttttttygtygatttttayggttttatttagttttttgggtttatggyggygtyggygttggtgagtggagggtt

SEQ ID NO: 10326 - DNA, 201 bp, synthetic construct
  misc_feature 1..201: note = Description of Artificial Sequence: Synthetic polynucleotide
  source 1..201: mol_type = other DNA
ttatygtagtygatagttttataaatattatygttygtttagttttygttttttygggtyggttgttatttygygttttyggtttggttttggtttygtyggttgtattgtayggttygttttttygtttatttgtttattaattttgtagaygttttgtgtttattttttttttttttttggttattttttttttttgtt

SEQ ID NO: 10327 - DNA, 201 bp, synthetic construct
  misc_feature 1..201: note = Description of Artificial Sequence: Synthetic polynucleotide
  source 1..201: mol_type = other DNA
ggygtttttttygttygtttgygggttygttgygttagtygtygtaataaagtttgatagggygtggtttygygggaagygggttyggygttgttyggtyggggygtaggyggttyggttygggttttttyggtagygtygagtttagggttttttaattygttatygtygtygtttgtttygtyggggygttttagtttt

SEQ ID NO: 10328 - DNA, 201 bp, synthetic construct
  misc_feature 1..201: note = Description of Artificial Sequence: Synthetic polynucleotide
  source 1..201: mol_type = other DNA
aaaataaaggatgggtgaataaattgagattyggtttgttgggygttatgtggagatygtgtgtaggaagagttaagatattagagtygggggggtttyggtgatttttgtygttttttgtattttgggtttatggttggggtttgtttttttttagttggtagtgttattttttttgtgttttattaagtttattagtaa

SEQ ID NO: 10329 - DNA, 201 bp, synthetic construct
  misc_feature 1..201: note = Description of Artificial Sequence: Synthetic polynucleotide
  source 1..201: mol_type = other DNA
tgtygtggtttygggttattgtagtttttttgtttygggttttygtggtttttttgtttyggtttgttaagtgtttgggattgygggygggygtygttaygtttgattggtttttgtatttttggaggagayggggtttygttttgttgatygggttggtttttggtttttgatttygagtggtttgttygttttggtttt

SEQ ID NO: 10330 - DNA, 233 bp, synthetic construct
  misc_feature 1..233: note = Description of Artificial Sequence: Synthetic polynucleotide
  source 1..233: mol_type = other DNA
agtattygatttgtgaaaattaygtttatgtagtaatataattggttygaaagygttaaagagttaattaagaggttttyggtttttygtagtttatagygtagttygattttttagagtygtygagtagaygttyggtgaattttagaggyggyggagggtggygaggagttttygttttttttygtttttttttttttygatttygttttttttttttttttttttttttt

SEQ ID NO: 10331 - DNA, 201 bp, synthetic construct
  misc_feature 1..201: note = Description of Artificial Sequence: Synthetic polynucleotide
  source 1..201: mol_type = other DNA
tyggagttgtagtagaagygttttygatttygtttaggtttttagtttatttttttttgaaggtyggtagggggygttattatygttggttttttygygyggtttyggttttygtttygggaatygagtgtttgtagttygygattttggggaggtatagggttagggtatygtttyggyggagaaagtggttgtgtygyg

SEQ ID NO: 10332 - DNA, 201 bp, synthetic construct
  misc_feature 1..201: note = Description of Artificial Sequence: Synthetic polynucleotide
  source 1..201: mol_type = other DNA
gggggaygggttagttagggtaggagtttaaggatatgaggtaaagattttaggttgggatttttygtagttyggaggyggggggtggggagggagggtygggggggtgttgggyggagaygttgggtattggggttagygttgggtagttatgtaygggggyggggtaataggtaggttagttgttgttgttttttagga

SEQ ID NO: 10333 - DNA, 201 bp, synthetic construct
  misc_feature 1..201: note = Description of Artificial Sequence: Synthetic polynucleotide
  source 1..201: mol_type = other DNA
aagttygtgtagygygygtygttttattaaygygtttyggygtaggyggtagaggaaagyggtttttaygygyggygttygyggtttyggggttaggggygyggttagtagtgttagtaygttttttattaygtygtygtygtttttttyggyggtggtygagatyggggygaggttygtagygatyggttyggyggggtt

SEQ ID NO: 10334 - DNA, 201 bp, synthetic construct
  misc_feature 1..201: note = Description of Artificial Sequence: Synthetic polynucleotide
  source 1..201: mol_type = other DNA
taggaatgagtttgttgagggtttagtttyggggtygggagtttgttgtaaaggatatgaaaaatttttattattatttttgtatgtgaaaagaatatgygtgttggaaataattttttaatttatatatttttaaatatttgtttagatttataggagaaatatttttattgatttttgtataaagtgtattggaggaaa

SEQ ID NO: 10335 - DNA, 201 bp, synthetic construct
  misc_feature 1..201: note = Description of Artificial Sequence: Synthetic polynucleotide
  source 1..201: mol_type = other DNA
ggggyggggaggagggyggagggggtgtaaattaagtggtgggaaagagataaaggaagagtgaagagygagayggtgyggatggggaagggggaggggygyggaggggtagtyggtgggtagygygtygaggagttygagtttgaatttgattaagtattgggggttttgtygtgggggtggggygggggtayggtygag

SEQ ID NO: 10336 - DNA, 201 bp, synthetic construct
  misc_feature 1..201: note = Description of Artificial Sequence: Synthetic polynucleotide
  source 1..201: mol_type = other DNA
agtttttaagggaggaggggagagttgtagagaggaggaggggtyggggaggtyggttttataaaggyggttggaataattttgttygttagatttygtygttyggattttttgagttgttygttattttaygtgatygygtygttttttagttttatygttgagtgagttggggygygtttttatttygtttttagtttt

SEQ ID NO: 10337 - DNA, 201 bp, synthetic construct
  misc_feature 1..201: note = Description of Artificial Sequence: Synthetic polynucleotide
  source 1..201: mol_type = other DNA
gaggagtagtagygttygtygggggatgtagtagyggtagyggyggyggyggyggyggtagyggtagyggyggygyggagttttttgygtttagyggttyggtygggttgyggtagaggyggyggyggygtttygtttygggtgaggttgtyggggtygtgygygttggtgagtggggygtggggggtaggtgggtggttg

SEQ ID NO: 10338 - DNA, 201 bp, synthetic construct
  misc_feature 1..201: note = Description of Artificial Sequence: Synthetic polynucleotide
  source 1..201: mol_type = other DNA
gttyggagaagtggatttygttttatygagaggttagggtttttatgttttygttttygatttyggtttagtggtttttgtttttyggattgttttyggyggggyggggttgtatttyggagttttagtttatttygtagtttttttygtatttgatattatyggttattttttataatatggygttyggygttttttaaa

SEQ ID NO: 10339 - DNA, 201 bp, synthetic construct
  misc_feature 1..201: note = Description of Artificial Sequence: Synthetic polynucleotide
  source 1..201: mol_type = other DNA
ggaatttggaggaatatggygttgtygttttttggyggaagygttygggtttgygggtaggggtagttttttagggttyggaggygtagtgaattttygygagttygtagttygagtttygygttttyggygtttttgagttygtttagygttgtttgygtttttttttttttttygttygtygttttttttttttttttt

SEQ ID NO: 10340 - DNA, 201 bp, synthetic construct
  misc_feature 1..201: note = Description of Artificial Sequence: Synthetic polynucleotide
  source 1..201: mol_type = other DNA
gttagggatygttttttattgttttttggttgtygaggagyggttatygggttyggttttagtttttttgttttgatttttttttttaagtttttatgtygagttggagagyggtttttgagtaygtatgtggttygaaaggtggtagttggtygggtttgggttttttatgtgatttagttatgygagggatyggttgaa

SEQ ID NO: 10341 - DNA, 410 bp, synthetic construct
  misc_feature 1..410: note = Description of Artificial Sequence: Synthetic polynucleotide
  source 1..410: mol_type = other DNA
agatatgttgggttagtagtgttggttttattttagattttttttagttttttttagttagtygttaaggggtttttttaatyggaaatttttaattygygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatygyggtgatttygttgyggatyggttygyggtgattttagygygaaygagttggttgtyggttggggygagaaaggtttgyggatyggtttgggygtatgyg

SEQ ID NO: 10342 - DNA, 201 bp, synthetic construct
  misc_feature 1..201: note = Description of Artificial Sequence: Synthetic polynucleotide
  source 1..201: mol_type = other DNA
gagttagagatgtatttttggtyggtttgagtatttgygggaattttgtgagtttttgaggtttattttttgttttttattttttttttttgtaaatttygagttyggggtaaagttgttttttttttttatatttttttttaattygataattaaygttttttagttttygggaatgggayggattttttttaaggattt

SEQ ID NO: 10343 - DNA, 201 bp, synthetic construct
  misc_feature 1..201: note = Description of Artificial Sequence: Synthetic polynucleotide
  source 1..201: mol_type = other DNA
gggatttttygtttttyggtttagggggtatttatttygtaygtggagttygggtagygtttttagaygtatttagygggatatyggagaggaygtygaygtagtgtaaygtttyggtygaagygtygaataatatgygygygtygyggaggaggtgyggggygtgttygtttaggtagygggtygtttygaygtggtaga

SEQ ID NO: 10344 - DNA, 201 bp, synthetic construct
  misc_feature 1..201: note = Description of Artificial Sequence: Synthetic polynucleotide
  source 1..201: mol_type = other DNA
atgtgttttgtygagttgatttgtttagtttattttttattttgaaaygaygttaagtatgaagaagagttgtataaataatgttaataatttyggtgtygtttttatgggggttatggtggttttagtgtattttatatgttttttttttttttgtttttttttttygtgtatatatatattgttttttgatttaagagt

SEQ ID NO: 10345 - DNA, 201 bp, synthetic construct
  misc_feature 1..201: note = Description of Artificial Sequence: Synthetic polynucleotide
  source 1..201: mol_type = other DNA
gtgattttgygaggttatatttygggtgygtygttgygggttygtgggttygtgggttgtagtttttygtttttgtygggtggaygagtttygggttygygtggagttgttyggttaaggtyggttygggaggggygyggygtagggygggtaggggyggggttttaggttaaygtttagttttagatttagtttygtygt

SEQ ID NO: 10346 - DNA, 201 bp, synthetic construct
  misc_feature 1..201: note = Description of Artificial Sequence: Synthetic polynucleotide
  source 1..201: mol_type = other DNA
ggagggagaaagggagagagttttagtygtttyggttgtggtaggaggagttttaagagygtttttygagttygtttygtatttttaggtttagttyggygtaggttttttttttygttttttttattttygttagttgttgaaatttttttatygttttttygygggtaatagtgttygttaggygtygtygygyggtgt

SEQ ID NO: 10347 - DNA, 201 bp, synthetic construct
  misc_feature 1..201: note = Description of Artificial Sequence: Synthetic polynucleotide
  source 1..201: mol_type = other DNA
gtttttaatgygggyggttttygtattttaygyggttyggggtttttgtttatttttygygggygggtttyggatttttggggttttttagttttttttygtttttttttygygtyggtttygtgttttgyggttyggyggtttyggyggygygagtygggggaggyggygaggggtgttttygaggttyggyggygyggt

SEQ ID NO: 10348 - DNA, 201 bp, synthetic construct
  misc_feature 1..201: note = Description of Artificial Sequence: Synthetic polynucleotide
  source 1..201: mol_type = other DNA
ttygtattttttttgatttttatggatatttagttaatagtaggaataaaaattaagatttttttttttttattygtttggatatttattttttyggttygygtygtygtgttttttattyggttatatagygattttaaaagtttagtttttatttygyggagatttygatagttttgggaggttttttttaaaagggaa

SEQ ID NO: 10349 - DNA, 201 bp, synthetic construct
  misc_feature 1..201: note = Description of Artificial Sequence: Synthetic polynucleotide
  source 1..201: mol_type = other DNA
agtygttyggttgaygtgataagggaggtgtaggttaatayggygatttygygttttttggyggtagtgtyggagtagyggygttgtttttgatttattyggtattyggttttygggatygtttggyggttgtgaatgtagagttggggygaygtggggttygttttttgggattgggtgtgagtttgygtagtgagttat

SEQ ID NO: 10350 - DNA, 201 bp, synthetic construct
  misc_feature 1..201: note = Description of Artificial Sequence: Synthetic polynucleotide
  source 1..201: mol_type = other DNA
aattgaaygtttgaaaygaaggtggygyggtttggataaatttgatttttygatatttttygtttttgygttygttttygttaagyggggaggagygatygttataatggattttttygtaggttttgtgygygttgggaatttagttgtygtygtttygtagagttttttgttttyggagggygtttattttygggtygt

SEQ ID NO: 10351 - DNA, 201 bp, synthetic construct
  misc_feature 1..201: note = Description of Artificial Sequence: Synthetic polynucleotide
  source 1..201: mol_type = other DNA
gtttygggygtttgttgtttygtgtttttatygaygattttatttagttgygttaygygtygtttyggttgtyggtygygygttttgttygtyggttttygttygtaatyggyggtttagggyggattygggtttttgygttttygygagaagygyggygttgyggggtygtgggygtttgagttygygyggttttygagg

SEQ ID NO: 10352 - DNA, 294 bp, synthetic construct
  misc_feature 1..294: note = Description of Artificial Sequence: Synthetic polynucleotide
  source 1..294: mol_type = other DNA
ttygtygtttatgtttttattgtaaggtygtagttttygtygtygatttygatttttygtttygtttagtygyggtttygttyggygtttttttttyggtggaagtttaagtttaattaattgagttygaggygggagggaagggttttgygygtygtggttygtttygtttttttttygygttttttttttygttttgggtggtatttttttygtyggtatttataataagtygttgattaatgaggtyggggtygttttatttygttyggtygggtyggggttttygyggga

SEQ ID NO: 10353 - DNA, 201 bp, synthetic construct
  misc_feature 1..201: note = Description of Artificial Sequence: Synthetic polynucleotide
  source 1..201: mol_type = other DNA
taagtttatagaagagtaaatttttatttttygaggttgttgtggaagttatyggggttgggatagtagagaggaatttagaygggaatatygttttttygttagattttyggyggtttttttttttttttttaaatttatttttaaagttaagtgtaggttttttygttttagttagaagygttgygtgagtttttatac

SEQ ID NO: 10354 - DNA, 201 bp, synthetic construct
  misc_feature 1..201: note = Description of Artificial Sequence: Synthetic polynucleotide
  source 1..201: mol_type = other DNA
gaggtttaygttttttagatygttatagtygttgttatagggtttgagtttgggyggygtttygtttyggtygtayggtgygtyggygttaatttttttygaaggtttyggtagttaagattgtaggtttttattaagtattgttttygaattgggttaygagagygtgtttttgattggtttgttttggaggttgggaag

SEQ ID NO: 10355 - DNA, 201 bp, synthetic construct
  misc_feature 1..201: note = Description of Artificial Sequence: Synthetic polynucleotide
  source 1..201: mol_type = other DNA
tttttygygygtygttttttttygtygtyggtygygtgygttttygttttttttttygyggygggagtattttygttygttatttggggattygygtygygtttttygttttygttygttyggygtttatttttygygttttttgttygttggggttataattgttttttatttttyggaggggttattttgggggtggtt

SEQ ID NO: 10356 - DNA, 201 bp, synthetic construct
  misc_feature 1..201: note = Description of Artificial Sequence: Synthetic polynucleotide
  source 1..201: mol_type = other DNA
gyggtttyggtgagyggggygaggggygggtgggtagyggygtygggggaggtygaggaggygaatggtggtgtyggggyggygggtatygggygaggtygyggttagttttttygggtyggagttgggtatygyggggayggggagtgtygggggtaggtgaggttagggtaggagtttaygyggtgggtgygaaggttt

SEQ ID NO: 10357 - DNA, 201 bp, synthetic construct
  misc_feature 1..201: note = Description of Artificial Sequence: Synthetic polynucleotide
  source 1..201: mol_type = other DNA
ggaggygttgygttaggyggaggaggagygtaaggttaagtaygttaagatggaggyggagygygaggtygtgygttagggtattygagataaggtgygygtygggtyggtttygtttgygggaaggyggttttgagtttagyggggatttagatttygtttgggtggaaggggttgttyggaagaggggygggygttttt

SEQ ID NO: 10358 - DNA, 201 bp, synthetic construct
  misc_feature 1..201: note = Description of Artificial Sequence: Synthetic polynucleotide
  source 1..201: mol_type = other DNA
aaagagaaaagaaatagataaaattagggtagggggtaaaaaagtttttygygtttttyggaatttagyggtygyggtygyggttatygtygtygtygtygggggtgggtttyggaagagtttgtttagtagggaaggggaggaygggttaggagygaaattttgtaggygaggaagggatagaygygtaaagaaaaagtg

SEQ ID NO: 10359 - DNA, 201 bp, synthetic construct
  misc_feature 1..201: note = Description of Artificial Sequence: Synthetic polynucleotide
  source 1..201: mol_type = other DNA
ygygggygtagyggyggtygggtaygaggtygggttgatattattatttgttggggygygggaagaayggtagttgttttgygttgtttyggygagggaygtttggaaaaggttgaagttttgggygtttttaagttygttatttayggggttttygttattttagtttgttygtygtyggtygttttttgtgattttttg

SEQ ID NO: 10360 - DNA, 201 bp, synthetic construct
  misc_feature 1..201: note = Description of Artificial Sequence: Synthetic polynucleotide
  source 1..201: mol_type = other DNA
ttttttagggatggttttgtgtttgggttttttttttttttaaatttyggggtggtttttgttttattagattgaatyggttttaaggagaaaagttgaygattattttgttttagttttygggaagttttgttttataaagaataagagtttttggttttgtgaaatgagttataggttgttttgattatgtttatttgg

SEQ ID NO: 10361 - DNA, 201 bp, synthetic construct
  misc_feature 1..201: note = Description of Artificial Sequence: Synthetic polynucleotide
  source 1..201: mol_type = other DNA
ttttaaatttygatygtyggtttggygygyggttgygtttatyggtttygygttgttgtygtygttatygttatttygtygtygtttyggttygygggtygtttaggttagtattygggtyggtttgttttygtyggtygttygggtgttygtygtygygtygygtttyggtygggygtggatggagggygtygygygttt

SEQ ID NO: 10362 - DNA, 201 bp, synthetic construct
  misc_feature 1..201: note = Description of Artificial Sequence: Synthetic polynucleotide
  source 1..201: mol_type = other DNA
yggtyggatttttttttagattgtttgyggtttgaaggggttaggttygygtaaggttttaggttgtttgggygtygggtygtattgttaggagttgttygggagtggttttttaggaatattaggtattgattatatattaggggttgggaaattaggtggtttgtattaaggyggtttyggggatttgtttgtggtaag

SEQ ID NO: 10363 - DNA, 463 bp, synthetic construct
  misc_feature 1..463: note = Description of Artificial Sequence: Synthetic polynucleotide
  source 1..463: mol_type = other DNA
agygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygt

SEQ ID NO: 10364 - DNA, 201 bp, synthetic construct
  misc_feature 1..201: note = Description of Artificial Sequence: Synthetic polynucleotide
  source 1..201: mol_type = other DNA
ggggaygttagtggattggagtygyggagtttygagggaaaaattttgtaggygtygyggtygggattyggttayggttttagtttattttagtaggtgygggaggaagaggtagygtyggagtttygaggttagagagtttyggyggyggyggtygtttttttttttygagttggtttgaagtygttgggtattttyggt

SEQ ID NO: 10365 - DNA, 201 bp, synthetic construct
  misc_feature 1..201: note = Description of Artificial Sequence: Synthetic polynucleotide
  source 1..201: mol_type = other DNA
agggttgggaggatttgtagtttttttgttggttttttttttttaggaagtyggttagtttggagtyggttgtttatttygatttatttttygtttgggyggagtaggaatgtggaagttggttygaaaggattgtgtttttttttygttaaatatttttttttygygttttttattaagttttggtyggggttgtggagc

SEQ ID NO: 10366 - DNA, 201 bp, synthetic construct
  misc_feature 1..201: note = Description of Artificial Sequence: Synthetic polynucleotide
  source 1..201: mol_type = other DNA
agggyggagttttyggggtagaggygtttygyggtaagatygtygaagtgggtttygayggttgggtygttgttttyggggggtygaagggtgygggttygggtttygggggtyggggttttttttttagtattaygaatttgaygtygtygagtttttttattatygttaygttgttgaygaattgtttgaagyggtttt

SEQ ID NO: 10367 - DNA, 201 bp, synthetic construct
  misc_feature 1..201: note = Description of Artificial Sequence: Synthetic polynucleotide
  source 1..201: mol_type = other DNA
yggaggaggttgyggggggtttyggtttaggygaaggaagggtaagaggttgttygatygggggyggygtygggaggtgggtgggtttaatatttaggtygggggaggggtttaagagatatygggaagggtagtygagttttaggggygggtggggtggtagttgtgtgtagtaggggatagggttgggtttttggaagt

SEQ ID NO: 10368 - DNA, 201 bp, synthetic construct
  misc_feature 1..201: note = Description of Artificial Sequence: Synthetic polynucleotide
  source 1..201: mol_type = other DNA
tagtygatatgaygygyggygtagttaatgggaggyggagttggygttttttggtygggggggggtyggaggggtgggtttygygttttyggtgtttgtygtgtttattgaatggagagagygagygtyggttagtttattyggtygtttygtgttttagtygtagtygtygygttttttagtttagttttaagtyggatt

SEQ ID NO: 10369 - DNA, 201 bp, synthetic construct
  misc_feature 1..201: note = Description of Artificial Sequence: Synthetic polynucleotide
  source 1..201: mol_type = other DNA
ttttttttaagtttttttttggggattgatattttattagtatagagattaataatgttagataagagatttttgattttatatttggggttttyggaaygatgtttgggagagaaaatatgaygttttttgtagaggygaattttagttygggaggagggaggtygttgggatgtgtygtyggyggtttttgggttyggt

SEQ ID NO: 10370 - DNA, 201 bp, synthetic construct
  misc_feature 1..201: note = Description of Artificial Sequence: Synthetic polynucleotide
  source 1..201: mol_type = other DNA
agattggattygaattyggtttattttattygagyggygaygttagygttgattttaggygtgtttyggttttyggygyggtttyggtttaatygtgtaygttygyggaaggtttygtattygygttagaagtggtttgttyggggttatyggttygtaagttttyggtgttttygaggtttttgtttygtttygygyggt

SEQ ID NO: 10371 - DNA, 201 bp, synthetic construct
  misc_feature 1..201: note = Description of Artificial Sequence: Synthetic polynucleotide
  source 1..201: mol_type = other DNA
ggggttggggagggttgtyggyggygyggyggggtyggygggaggygggaggttgygygyggygygggagygtgygtyggggttagtaggggyggggttygygyggtygtygggattggaggygygggggtagygggtagggtattttgagggtatattttyggttatttggygggagatttagttttgtygygygtygtt

SEQ ID NO: 10372 - DNA, 201 bp, synthetic construct
  misc_feature 1..201: note = Description of Artificial Sequence: Synthetic polynucleotide
  source 1..201: mol_type = other DNA
gtttyggtygtygggygygtagtygtttttttygygttttgttygtttttatggtattttttaggaaygggaagggggtgggagtygagtyggyggtygygtygygtygaatgtgtgttttttttttyggttgtttayggyggtygaggygtattgtattttgttggygtygaagggtgttttggaatagtagagggagga

SEQ ID NO: 10373 - DNA, 201 bp, synthetic construct
  misc_feature 1..201: note = Description of Artificial Sequence: Synthetic polynucleotide
  source 1..201: mol_type = other DNA
tttagtgttgttygggygttttttygtagtagttttagggygaggaggatggggggggttttygtaggggttatattgtyggagttttayggattygggygggayggtgaggtttttatattgagtyggtggtaaagttttygygaggatgaaggaggaatttygtgttttttattttattaggtttygtattttttggtt

SEQ ID NO: 10374 - DNA, 258 bp, synthetic construct
  misc_feature 1..258: note = Description of Artificial Sequence: Synthetic polynucleotide
  source 1..258: mol_type = other DNA
ttttttgggataagaagtggagtggggyggttaggaygygggtygtggggatygygagggaggagggggyggtygttyggatttatttygtggggttttygygygygggygtttyggygtgtyggattatgtygtyggtagtttygggayggggaayggaggygtttaggygtygggtygygyggaaygyggagtttygggygttygtatgtttttggttttggttttttggaagggttaggtygtygttgtygtygc

SEQ ID NO: 10375 - DNA, 201 bp, synthetic construct
  misc_feature 1..201: note = Description of Artificial Sequence: Synthetic polynucleotide
  source 1..201: mol_type = other DNA
ttyggtygttaygtttttttygagggtygtttygttttygtygggtttygygagygygyggtgggggaggggagggtttyggagygygtttgygtggggygggggyggtagtygattaggggttgggtttggtygtttagggtygggttttggttygtygtttayggtgyggagggttggtgggttttttttggtygtygg

SEQ ID NO: 10376 - DNA, 201 bp, synthetic construct
  misc_feature 1..201: note = Description of Artificial Sequence: Synthetic polynucleotide
  source 1..201: mol_type = other DNA
tagtagttttttagagttttggtttggtagggaggggayggygttygagtagttatattgtagtttttygggtttttttttyggtyggygtaggtttygygtttaygattttttttgggagtyggatttgttttttttatygtygttattygtyggtttttgygttttttggttttygatatttygtttggtygttttttt

SEQ ID NO: 10377 - DNA, 201 bp, synthetic construct
  misc_feature 1..201: note = Description of Artificial Sequence: Synthetic polynucleotide
  source 1..201: mol_type = other DNA
ttttygygttatttygggttygttttygttyggttttttyggagyggtygygtttttagtyggggagtttaggggttttggttygyggagtygggygygyggggggyggttggggtygtagtagggggaggttyggygttygtagtygtyggygyggggtttatygggygtgtgggtttatttyggtyggggygygayggg

SEQ ID NO: 10378 - DNA, 201 bp, synthetic construct
  misc_feature 1..201: note = Description of Artificial Sequence: Synthetic polynucleotide
  source 1..201: mol_type = other DNA
gggtttttagtaygygttttagygtyggagtagggttagggtttttttgygattyggtttygttttagatttttttagttttyggtygyggattygggtygygtgtgagygttttttgtattttttatttttagggttygtygagagttaygattttttatagaaaatgagygataaagagattttgtattgttttgattg

SEQ ID NO: 10379 - DNA, 201 bp, synthetic construct
  misc_feature 1..201: note = Description of Artificial Sequence: Synthetic polynucleotide
  source 1..201: mol_type = other DNA
tygggtttagggygtygtttgtagttgygygyggtygtttttagatggaatttttttattaaygtaaggttyggtyggagtagttattygggagttgggyggygaggggttatttttttttatttyggygggtgtaggatyggggggtttgggtagtaattagtggggaggagygttggattgtgtaygtygagttyggta

SEQ ID NO: 10380 - DNA, 201 bp, synthetic construct
  misc_feature 1..201: note = Description of Artificial Sequence: Synthetic polynucleotide
  source 1..201: mol_type = other DNA
ttygttttattttttgtttgttttyggttgttagagatttaggtgtagagagattttagaggtggygttyggggttttggygttttttttgyggaygttygttgtagagtaggaagtygtygtttyggggyggaggggygagtygggttagggggtyggggtggagaggtttgtagggtttgygygttttttttattygyg

SEQ ID NO: 10381 - DNA, 201 bp, synthetic construct
  misc_feature 1..201: note = Description of Artificial Sequence: Synthetic polynucleotide
  source 1..201: mol_type = other DNA
agtattaggttyggtttttygtatatygtttygaatttygggggtaygggygygggtttttygggtttttygggggaygyggggtttttaagttaaaygygyggttygggggayggygtygygggttttttygggtaygygygttttttaggggaygygagttttttyggggaygyggygttygygttgtyggttttttat

SEQ ID NO: 10382 - DNA, 201 bp, synthetic construct
  misc_feature 1..201: note = Description of Artificial Sequence: Synthetic polynucleotide
  source 1..201: mol_type = other DNA
ttttyggtygaggaggggtygygtggygtygyggggggygggtygygtaygtttttygtagggaggatttagggatagttagggtttygggagagttygygygtatygttyggtttygyggygttagttatggygttygtgygtggtttygttagggatggggygaygyggttagagtygtaygygatygaaattygtatt

SEQ ID NO: 10383 - DNA, 201 bp, synthetic construct
  misc_feature 1..201: note = Description of Artificial Sequence: Synthetic polynucleotide
  source 1..201: mol_type = other DNA
gttagaaaggatygagaaaaattttaaagttttaagtttgagttagggagggttttagagggaggtttgattgtagatygggagtttttttttttygtgygtygttgttygggaygagaaattygtggggtatttaggattaggataygaggttttagtttgggtaggtggataagttgtggggttttatttttygtaggc

SEQ ID NO: 10384 - DNA, 201 bp, synthetic construct
  misc_feature 1..201: note = Description of Artificial Sequence: Synthetic polynucleotide
  source 1..201: mol_type = other DNA
gtygttgagtaygygttttaggtaggttttgggaagttygggatggaagtagttttttttttttygtttttttttttttttttttttttttttttttttygygtttttttttttttttttgttttttttggaygtgggttgtyggttgtagttyggagggayggggygygggayggagtttttygygggaggaggggtygg

SEQ ID NO: 10385 - DNA, 203 bp, synthetic construct
  misc_feature 1..203: note = Description of Artificial Sequence: Synthetic polynucleotide
  source 1..203: mol_type = other DNA
gtaggagyggttygtgttygygggygggagygtgyggtttggattgtttygtyggataggtattgttttttygttttttygggttygaggygggtygygygygtyggtygtygttygggygtttygyggtgggygagatgygtygygttygttttatgtttgtygttygygygttttttgttttttatttygtagtygttygt

SEQ ID NO: 10386 - DNA, 201 bp, synthetic construct
  misc_feature 1..201: note = Description of Artificial Sequence: Synthetic polynucleotide
  source 1..201: mol_type = other DNA
tttttygtagagggtaggatatttattttttygtgtatttgtttttttttyggtttttygtttttagtagtattttaggatttaggggtgttatygggtyggggagggaggggttgagtttgggtttggggatatygggatagggggaggggttggygttttygtttggtygggatttygtggtttagygyggttttayga

SEQ ID NO: 10387 - DNA, 201 bp, synthetic construct
  misc_feature 1..201: note = Description of Artificial Sequence: Synthetic polynucleotide
  source 1..201: mol_type = other DNA
agygtttgtttaatttgtagtgatatygtttagttgtttagggttttagttgttatagttaattagttygyggtyggggaggagygtygggtaggggggygggggggtatgaaggggtyggygggggaggttgtgggggttgtaggaggggtaggygtaggaggaggtttgtggtttttaggttyggttygtttttttagg

SEQ ID NO: 10388 - DNA, 201 bp, synthetic construct
  misc_feature 1..201: note = Description of Artificial Sequence: Synthetic polynucleotide
  source 1..201: mol_type = other DNA
gggygtattgggygaaggygaygygyggttygtgggtgtagygttgggygttttgaggaggtttttgttgyggtttygggygtttgtgyggtttttgagygyggagttgggatygygttttttttygttattggaygaygtgagtaaaygtttygttttygggtttygtttttgtygttgttatygttttygtttttttag

SEQ ID NO: 10389 - DNA, 201 bp, synthetic construct
  misc_feature 1..201: note = Description of Artificial Sequence: Synthetic polynucleotide
  source 1..201: mol_type = other DNA
taggtagaggggggygggagggggtgtgagggagaggaggagtyggagtygtygttgyggtttttttyggggaggggagaggagaatttttttttttttygtttttttttagtttttygttggttygggagggggtggggygtygaggtygyggygattyggtagggtttggtyggtgaagagtaggygggyggggtgygg

SEQ ID NO: 10390 - DNA, 201 bp, synthetic construct
  misc_feature 1..201: note = Description of Artificial Sequence: Synthetic polynucleotide
  source 1..201: mol_type = other DNA
ttaattttgygttttttttttagttygagttttttygttgtttttttttttttttttttygagtttttttttttttggygyggygtygttagttagtttyggyggggagagtgtaggtattttgtttttagaataattagtaggatttaagtyggtttttygagygygttttttttttttttttttgtttttttttttygg

SEQ ID NO: 10391 - DNA, 201 bp, synthetic construct
  misc_feature 1..201: note = Description of Artificial Sequence: Synthetic polynucleotide
  source 1..201: mol_type = other DNA
ygyggayggygttygatagtagttggaggagyggtttgtygatttggyggygagttatttggaggttattygtgygygggaygagtgggatyggtagaaygygyggttgygttaggagaaygttyggttgyggttygagaatyggyggttgaagygygagaatygtagtttttttygttaggttttgyggtttttyggyga

SEQ ID NO: 10392 - DNA, 201 bp, synthetic construct
  misc_feature 1..201: note = Description of Artificial Sequence: Synthetic polynucleotide
  source 1..201: mol_type = other DNA
ttygttttttygttttagttygygtatttatygygtaygtagagtagtgatatggtygaggatygggtaagtttttgtygygttttagtygygtyggatygttttttttttttttttagtaggtgtygygattgttttygttatyggttttaygggtttggtagttttttatggtttyggtygtaggtagygtttygtygt

SEQ ID NO: 10393 - DNA, 201 bp, synthetic construct
  misc_feature 1..201: note = Description of Artificial Sequence: Synthetic polynucleotide
  source 1..201: mol_type = other DNA
tggttattgttgygtaggygtagttttgggagyggygggagttggaagtttaggagttttagggggygtagggtygggtagaaggyggygagttgggggyggatatttatyggggattggaagyggttygygtaggttggggatattyggggttagggygggtygtttggggtgggagagtatagtgaggaagtttgaygt

SEQ ID NO: 10394 - DNA, 201 bp, synthetic construct
  misc_feature 1..201: note = Description of Artificial Sequence: Synthetic polynucleotide
  source 1..201: mol_type = other DNA
ttggggaygtygtagttyggttyggggagggggygttaggtygggagtygtagygygggagggaygagttygggtyggyggggggaggggagygggaagygtttttgttgttggygatygggattttttttyggtataggggaaaggyggggaagttattttttatygggtttgtgtttttgagaggattttttgatggtt

SEQ ID NO: 10395 - DNA, 201 bp, synthetic construct
  misc_feature 1..201: note = Description of Artificial Sequence: Synthetic polynucleotide
  source 1..201: mol_type = other DNA
ggtttttgggaggygtygygtgggggygyggttygtggagttygggygttagggatyggtyggggtyggygtaygggtgygttttgggttygttygggtygtgggagttagggagttagggagttagggatttyggttttygtayggggtagataggggtagygygggygattyggagygtttgygttttygyggtttttt

SEQ ID NO: 10396 - DNA, 523 bp, synthetic construct
  misc_feature 1..523: note = Description of Artificial Sequence: Synthetic polynucleotide
  source 1..523: mol_type = other DNA
agagtatygggttttttattgttttagagygygtgtgyggttttgggygygtatagtgayggtgayggtatttttggttyggtagygtygaggtygtttygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtygtggtttttygggggyggtatygttaggtgagygtyggtyggggygaggtygggtttygggyggtaggtayggggttaggtggttttgaaatttggygtag

SEQ ID NO: 10397 - DNA, 201 bp, synthetic construct
  misc_feature 1..201: note = Description of Artificial Sequence: Synthetic polynucleotide
  source 1..201: mol_type = other DNA
yggyggtaggygggggagggggtgggggtgtaggggyggtttygygggtygyggggggggygygyggygtagyggggtttygggyggggygtagygggtygyggggtttygggygygtttttygygttattttagtgttatggtgygttygttgagtygtygggtttagagttggggttggyggyggagggataygggtyg

SEQ ID NO: 10398 - DNA, 201 bp, synthetic construct
  misc_feature 1..201: note = Description of Artificial Sequence: Synthetic polynucleotide
  source 1..201: mol_type = other DNA
ygttttttygttttttyggtatttgtttattttygtaattgtttyggtttttaatatttgtatygtttaatttttttttttttygttttttgtttttttygtatttgttyggagttttagtatttgtttygtttttygttatttttttttttgttggtttgatggggtgtgggtttaagggagttatatttgggyggaggt

SEQ ID NO: 10399 - DNA, 201 bp, synthetic construct
  misc_feature 1..201: note = Description of Artificial Sequence: Synthetic polynucleotide
  source 1..201: mol_type = other DNA
tttyggtttgayggaatataggygaygtaygtgaagtttaggttttattttagygtaggygggtttttagygatttatagttgttatatattyggttagygtygattttygaaggygtattttttatattttatttygagtatyggttttatygttagggaaggtttttttggatagtaaggtyggggtttaggatttgyg

SEQ ID NO: 10400 - DNA, 201 bp, synthetic construct
  misc_feature 1..201: note = Description of Artificial Sequence: Synthetic polynucleotide
  source 1..201: mol_type = other DNA
yggtaattttttttatygttttttgtagtaggygtygagtygtygttattttgtttttygttttttttttttttttatygatatttatatagygaaaatyggttyggtyggtttgyggtttttattttaygtttgtagttttygttttttygttaggttttatttyggygyggtgttttaggtyggtygyggagtygattc

SEQ ID NO: 10401 - DNA, 201 bp, synthetic construct
  misc_feature 1..201: note = Description of Artificial Sequence: Synthetic polynucleotide
  source 1..201: mol_type = other DNA
ygtyggygggygggaggtatataygygygtataagyggaaagaaagygggtttattgygtggggatgttygttygygtagttgtttyggyggyggyggtygttgtttgtatygaggtygaggygyggyggtggyggyggyggttgyggattgagtttttttygtygggyggtggatgtagggygygggaggggygygaggg

SEQ ID NO: 10402 - DNA, 201 bp, synthetic construct
  misc_feature 1..201: note = Description of Artificial Sequence: Synthetic polynucleotide
  source 1..201: mol_type = other DNA
tttttygttagygtttttygttygttygttttttttyggtttygtttygyggggttgttggagaaattaagtttggggttttttttgtygagtayggggygagttttagaaggttttgtygtgatggaaaatttttaggtaaattttttygggttygtggtttttaggtygggaagttttygttaygtgaagggttttygt

SEQ ID NO: 10403 - DNA, 201 bp, synthetic construct
  misc_feature 1..201: note = Description of Artificial Sequence: Synthetic polynucleotide
  source 1..201: mol_type = other DNA
tttttatatagaaaatttgtattagttatgtaagttaaaaagttgtgtgaatttaggtgtttyggaaaggggttgtaggatatagtaaaatgttagtagygtgtyggattttttttttttatttttttttttaaagaatagaggttaggaaaaatattggttgggaygttagaagggttatgtgttaattataattatatt

SEQ ID NO: 10404 - DNA, 301 bp, synthetic construct
  misc_feature 1..301: note = Description of Artificial Sequence: Synthetic polynucleotide
  source 1..301: mol_type = other DNA
gyggatggggttttgattagttgtggatttttgttttagygtatttatttaatygtgttttttttggttggtagagggygttaaaggygaygtgtyggtygttagttttaggtygagtttygagygtttgtaggaataygtttttttattyggygygggaygtagagttgygagagaattttgtttagygyggatttaaygttagggygtygtttagaggttggtttttgtttyggttttattygtygggagattatagagttgtttttttagtygttygtygttagaaattggaaaaaaa

SEQ ID NO: 10405 - DNA, 223 bp, synthetic construct
  misc_feature 1..223: note = Description of Artificial Sequence: Synthetic polynucleotide
  source 1..223: mol_type = other DNA
ttagagttgtaygtagatgaataygaagagtagygygtagaatayggtgtagaygayggtgaggttaagttttaygtaggggggtayggtyggggttagygtgggyggtagygagtygttgygggttgggttttayggyggggtttttatygggtygggggygttgtygygyggtyggggaygttygggttttatyggggtttayggtygtygtygttttygc

SEQ ID NO: 10406 - DNA, 720 bp, synthetic construct
  misc_feature 1..720: note = Description of Artificial Sequence: Synthetic polynucleotide
  source 1..720: mol_type = other DNA
tagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgtt

SEQ ID NO: 10407 - DNA, 1683 bp, synthetic construct
  misc_feature 1..1683: note = Description of Artificial Sequence: Synthetic polynucleotide
  source 1..1683: mol_type = other DNA
atygagggagggtgtaaaaggyggggggyggagggggggtagattagattaggygaaatttaataagtttttagttttttagtttaaagtttttattatygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyggtttagtggtttttgygygtyggagttygtygygaagattgagyggtygyggggatygtygygggtttygygygtatttttgggtttaatattgttatta

SEQ ID NO: 10408 - DNA, 233 bp, synthetic construct
  misc_feature 1..233: note = Description of Artificial Sequence: Synthetic polynucleotide
  source 1..233: mol_type = other DNA
aaataaaaagattaaaggagtagyggtyggggyggtagyggtttttaggtygggatattyggggtggtgygttygggtttgygggggttgygtyggygtyggggaggyggggggagygggagygggygaygyggggaaggggggagttagggggagggygtyggtyggaggaggggyggattygttygttttagtygagtagagtatagtygagtygagyggttygggygggg

SEQ ID NO: 10409 - DNA, 213 bp, synthetic construct
  misc_feature 1..213: note = Description of Artificial Sequence: Synthetic polynucleotide
  source 1..213: mol_type = other DNA
tttttttttaaagtaaatagtatttttttattattttgtagttgggttttttttattggttttygttttttyggtggagayggygaygtggtttataygygagtttttygtygaggatgaattattagttagttygagttgttatattttattttagtatagttatygygagagtttyggggtygygtyggygtgttttaygtaygygtagtt

SEQ ID NO: 10410 - DNA, 236 bp, synthetic construct
  misc_feature 1..236: note = Description of Artificial Sequence: Synthetic polynucleotide
  source 1..236: mol_type = other DNA
ygygttgagttttattttgyggyggtyggaygtttyggygtagggggyggygyggygggygyggtgttgggtatygataaygtgtgygagttggyggygyggttgttttttagtatygtggagtgggygygttaygygtttttttttttygagttgtyggtggtygattaggtggygttgttgygtttgagttggagygagtttttygtgttgaaygyggygtaggyggygttgtt

SEQ ID NO: 10411 - DNA, 233 bp, synthetic construct
  misc_feature 1..233: note = Description of Artificial Sequence: Synthetic polynucleotide
  source 1..233: mol_type = other DNA
ttagttgtggatttttaatatttgtaggttataggattagaggttgggtttttaggagtagaggatatagagtagtgaagaygagattyggagttttagyggtagttaaagataaagaagyggataaatttygttatatttyggaagtygtttttttygtttaagttgygtgtttgattggatagtttttagtttagygtygttgattggataaygtttaaaattttattttt

SEQ ID NO: 10412 - DNA, 737 bp, synthetic construct
  misc_feature 1..737: note = Description of Artificial Sequence: Synthetic polynucleotide
  source 1..737: mol_type = other DNA
ttygttygatttaggtttygagtttttttttygattttttttagtttaaaggttgtattygttttaggtttttttagttyggttttttagtttttttttyggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygygttgtygggygaggtyggtttaygtggagtygggagtttgaggtttttgtaygygggagttgyggaygatggtggttagtgttattgtttaygaygttatt

SEQ ID NO: 10413 - DNA, 308 bp, synthetic construct
  misc_feature 1..308: note = Description of Artificial Sequence: Synthetic polynucleotide
  source 1..308: mol_type = other DNA
atagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtgga

SEQ ID NO: 10414 - DNA, 1100 bp, synthetic construct
  misc_feature 1..1100: note = Description of Artificial Sequence: Synthetic polynucleotide
  source 1..1100: mol_type = other DNA
tgatgygtttggtgattttttttgggtttttgtttaagyggagttataggttgtgggggyggttaggtttttggggaagagtaggtgtygyggtgtyggygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygygtttygygatttgttyggttgttygygttgtyggyggttgttgtataagtyggtgaygttgttttgygggtttatagtttgtaagygttgygtggagttag

SEQ ID NO: 10415 - DNA, 214 bp, synthetic construct
  misc_feature 1..214: note = Description of Artificial Sequence: Synthetic polynucleotide
  source 1..214: mol_type = other DNA
gaagaaataatatattgtagattgtaaygagtayggggagttagygaaaggtagggygtttattagggygygttgagagatygggaattttygtaagggygttygygtygttygttattygtygtygygygtaygtygygttttygtttatttttaaataatatttatagttagggtttttttttttttttttttttttttttttgttttygtt

SEQ ID NO: 10416 - DNA, 582 bp, synthetic construct
  misc_feature 1..582: note = Description of Artificial Sequence: Synthetic polynucleotide
  source 1..582: mol_type = other DNA
agtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagag

SEQ ID NO: 10417 - DNA, 203 bp, synthetic construct
  misc_feature 1..203: note = Description of Artificial Sequence: Synthetic polynucleotide
  source 1..203: mol_type = other DNA
tttttaggaggygttttgatttygtatttyggttttttatttttygatygttagttttagggtygtygyggygaygygygattttttttttttgaggggygygggtttyggaygygtygggttttgttaggtatttagtggagggtyggaggtyggygattagttygagtttagtygtttygggagttggygygagtgtygtt

SEQ ID NO: 10418 - DNA, 823 bp, synthetic construct
  misc_feature 1..823: note = Description of Artificial Sequence: Synthetic polynucleotide
  source 1..823: mol_type = other DNA
taattatttgttttagatygygttatttgtaatttgtttygggttggygttatattyggygtttyggygttttttataagtgttttygtttatgattagygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygygttggttgygggttttgggggttttttgtttttttygggtttygttttttygtatttttttggtttgattatgatttttgaaggagaatayggataattyg

SEQ ID NO: 10419 - DNA, 293 bp, synthetic construct
  misc_feature 1..293: note = Description of Artificial Sequence: Synthetic polynucleotide
  source 1..293: mol_type = other DNA
ttttgtttttaagggagagggatagtattttttygggtttttagtttttttgggtgtggygggagagttttgggygaggttgygtttatatttgtatttyggtyggttttttyggttgatttygttttggttgatttygygtatattttttttttagygttgtaaggatygtttgaattygttggttatttyggtgatgaattagtggttyggtgtgaagttgygggtgatygagggttgggaygaggayggttattatttagaggagtttttgtattatgagggtygygygg

SEQ ID NO: 10420 - DNA, 262 bp, synthetic construct
  misc_feature 1..262: note = Description of Artificial Sequence: Synthetic polynucleotide
  source 1..262: mol_type = other DNA
gyggggtatgttggygyggttygagggtayggtattggttyggtttttttttygygttyggtttyggyggtttttagtgttttyggtttattgttygggygyggyggttgygggattygygtggygtyggygayggttyggtttagttttgygttttgtaygygygtttttgttttygggttyggtagtygtttttttttaayggggggagggggttattgttttygtttttygttttttttggagttaattagygygttyg

SEQ ID NO: 10421 - DNA, 240 bp, synthetic construct
  misc_feature 1..240: note = Description of Artificial Sequence: Synthetic polynucleotide
  source 1..240: mol_type = other DNA
gttttttttttattgttttttygttattagtygtttttgtygtygagttygtagtygttagygygtttygagtttttttaggttagaggttttygtaggygatggyggataagagggyggggattttagaagtygyggygygttygtygttyggttttgttygggagggggaygygygtayggttttygyggttygggttygagaagttggggggygygggtttttttatttygtagygg

SEQ ID NO: 10422 - DNA, 1240 bp, synthetic construct
  misc_feature 1..1240: note = Description of Artificial Sequence: Synthetic polynucleotide
  source 1..1240: mol_type = other DNA
ggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygtt

SEQ ID NO: 10423 - DNA, 222 bp, synthetic construct
  misc_feature 1..222: note = Description of Artificial Sequence: Synthetic polynucleotide
  source 1..222: mol_type = other DNA
aataaaaatttatattatatagygatggtggtgtttggtggyggtggyggggtggggggtttgattagatgagtygtttttygygttttyggygtygggygttatggttygagtygaaggygtttttggtttyggagygttygyggtttttgygtttggygyggtygtttaagtaggagaagaaggygtagtttaggaatattyggaagtagtaggtygttt

SEQ ID NO: 10424 - DNA, 714 bp, synthetic construct
  misc_feature 1..714: note = Description of Artificial Sequence: Synthetic polynucleotide
  source 1..714: mol_type = other DNA
tgtgattttttttttttgttttaagtggttggygatatagttttyggygygtygggtattgaggttttggagtatagygtggggggtttggtatagataygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtyggttgttttttggagtatttttgttatagtatttttattttgggttagggtattttgttgyggattttgagttttaggaaggaggtttataatagyggaaagttatttttttttaagaattgttgagtttttyggattgtatttttaaagattttttttgaa

SEQ ID NO: 10425 - DNA, 1216 bp, synthetic construct
  misc_feature 1..1216: note = Description of Artificial Sequence: Synthetic polynucleotide
  source 1..1216: mol_type = other DNA
tttattttgaggttttttagatttygtagggttttttaygttattaagtttgtttygattttttttygttgttttttatattttttgtygyggygyggtyggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttygggtyggtgtttttgtygygggaaggaggattyggaygtttaatttagyggygaagtygttttttattggaggaggtttttygaaaaygtttttgaaattt

SEQ ID NO: 10426 - DNA, 207 bp, synthetic construct
  misc_feature 1..207: note = Description of Artificial Sequence: Synthetic polynucleotide
  source 1..207: mol_type = other DNA
ggtttgtttagtttttatttyggtatygaagtygtagttttygggtttattttygtatttttaggggttttygggggttgtygataggtttttgattagygagygygttttyggggtaagtatttttggygggtagaaatttgggagyggagtatagyggtgtaagggaatygtgttaggygggaagggyggaatttgyggggaatt

SEQ ID NO: 10427 - DNA, 253 bp, synthetic construct
  misc_feature 1..253: note = Description of Artificial Sequence: Synthetic polynucleotide
  source 1..253: mol_type = other DNA
ggttgygtagygtttttaatttaatttttggatttattttygttttagtttttttygtgtttagygttttttgtaaatgattttttyggtygggtgtttygttttttttttyggtttttttygygtggtttgtttttygttygtttgygttygttyggtttttttgtttttgygtttttatttgatygtaaaggyggttagggtagttttygygyggtttgatagttayggtttttagtttgtttttggaygt

SEQ ID NO: 10428 - DNA, 209 bp, synthetic construct
  misc_feature 1..209: note = Description of Artificial Sequence: Synthetic polynucleotide
  source 1..209: mol_type = other DNA
ggttaggtttgagttttatttatttaygtygtattttttttttttygtgggggtttatatggtygtgtygggygyggtttygygggygyggygatygggygataaygyggyggggayggtygygggttyggttgtggygtatygygagtygaggyggggayggttaggyggygyggggtagtgggyggygtattttttataggtygttc

SEQ ID NO: 10429 - DNA, 225 bp, synthetic construct
  misc_feature 1..225: note = Description of Artificial Sequence: Synthetic polynucleotide
  source 1..225: mol_type = other DNA
ttgygatyggtttttaatttgggtygagttgygtagyggggygggygygyggggyggggygggtygygggttttggggagttggtygggaatyggagttygyggtygtttggtygaatttgttygygyggygtyggggaggagttyggggyggyggygyggggygygygttyggygagggygttttttttagggtygtttgtagtttgygggayggggtygagyg

SEQ ID NO: 10430 - DNA, 1133 bp, synthetic construct
  misc_feature 1..1133: note = Description of Artificial Sequence: Synthetic polynucleotide
  source 1..1133: mol_type = other DNA
ggaggagaagygaygtaagtgggtagttttttagygtyggygaggygygggaggaggagaagtagtggggaggygtagtygtttatttgyggggtagggygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattygggygtygyggtagttgtttyggttgtyggtyggyggtttygygttygttygtttygttttygttygttgttttgttgtaygaatttttttaatttttttt

SEQ ID NO: 10431 - DNA, 478 bp, synthetic construct
  misc_feature 1..478: note = Description of Artificial Sequence: Synthetic polynucleotide
  source 1..478: mol_type = other DNA
tgaattgagggggttyggyggtygttgaggaggggagygygygggaggaggggygaggagttyggaggygggygyggttggtagtttagagggttygggyggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygygattttggttttttygtaagtttttyggattygggygttttyggtttttttttatttatttttttgtygggtaggttygygatttttygtttttygggtyg

SEQ ID NO: 10432 - DNA, 201 bp, synthetic construct
  misc_feature 1..201: note = Description of Artificial Sequence: Synthetic polynucleotide
  source 1..201: mol_type = other DNA
ttaatgtgttttaataygttttaatgtgttgtgataggaaaagagtyggttaayggtattayggaagtattagttggtatagaggttyggtgtaattatygttttgtatygtaaaaygggtttaggaagtttttaggagatattagyggtgttagaatygagaaagtgaygatatagataatttatggatttygygtaygg

SEQ ID NO: 10433 - DNA, 208 bp, synthetic construct
  misc_feature 1..208: note = Description of Artificial Sequence: Synthetic polynucleotide
  source 1..208: mol_type = other DNA
gttttygtygtygttygggtygygttygtttygtttttaggygtyggtttyggagttyggttygygagtagyggyggttgtyggagggaygatgagttgygyggggygggygggttttgttyggttygtygygttygttttgttgatttgtagtttgtggtyggtaygggtagataaygygagttaggagtattatayggygtttatt

SEQ ID NO: 10434 - DNA, 210 bp, synthetic construct
  misc_feature 1..210: note = Description of Artificial Sequence: Synthetic polynucleotide
  source 1..210: mol_type = other DNA
ttagtttttygggaagtagtaggygtayggtygtttggatttttttggaggtgatggtygagygtttgttgtaatgygttaggygggaagtttygtyggygatgygttygaagatgtygttgataaaggaatttatgatttttatggttttagaggagatgtyggtgtyggggtggatttgttttagtattttgtataygtatayggagt

SEQ ID NO: 10435 - DNA, 229 bp, synthetic construct
  misc_feature 1..229: note = Description of Artificial Sequence: Synthetic polynucleotide
  source 1..229: mol_type = other DNA
ttttaagatagggtttttttttygttygggttggagtgyggtggtaygattttyggtygttgtaaygttygtttttgggtttaagtgatttttttgtttyggttttttgagtagttgagattataagygttagttattatagttyggttaatttttgtattttttagtagagatagggttttattatattggttattttggttttaaatttttgagtttaggtgagtta

SEQ ID NO: 10436 - DNA, 209 bp, synthetic construct
  misc_feature 1..209: note = Description of Artificial Sequence: Synthetic polynucleotide
  source 1..209: mol_type = other DNA
tttttttttttttttaatatttttttttagaaaaagaggaaygtaaygaagggagtttagttattatgttggagttgtggatyggttttgtgaggtttaygygggagygyggaggtttttgggttttagggygtyggtagatggtttgtagygtatygttyggttttygygttggttaygttygttagygttatttttttttttygttt

SEQ ID NO: 10437 - DNA, 255 bp, synthetic construct
  misc_feature 1..255: note = Description of Artificial Sequence: Synthetic polynucleotide
  source 1..255: mol_type = other DNA
gttatttygtagygagttaaagttattttttattttgggttygttaygygatttttgtyggttttygttttaygyggttttagtayggygttaaggtttygtttataaatyggtttygttttttygtgttygggttygtygtttattagaygtygtttyggygtagygagttgagggtaygtttatttttttttygggtttttagtttttaaggttttagtataatgttttaggaggaagattttaggttttttt

SEQ ID NO: 10438 - DNA, 297 bp, synthetic construct
  misc_feature 1..297: note = Description of Artificial Sequence: Synthetic polynucleotide
  source 1..297: mol_type = other DNA
tttattattgttaaygtygtygtygygttttttttattttatttttttttttttaggagaatttttagtttyggtttttttygtttyggygtttygttaygtgatttygggtygttttttataygtgatygtttttttttttttttttattttygtattygttttttttttagttttttgtttygttttgttggtygttaggtatttyggggagaggtygtttggaggyggggttttaggttttatttttyggagggtggagaggggygggtaaattaygtygagtgggyggggttt

SEQ ID NO: 10439 - DNA, 232 bp, synthetic construct
  misc_feature 1..232: note = Description of Artificial Sequence: Synthetic polynucleotide
  source 1..232: mol_type = other DNA
tagtygttttaagtttttttttttttttttttttttttttttgtttyggaaagttagygagttttyggtagyggtygtattttygtttyggtggtttgaygayggyggyggtygtttttgygygttttttygttttttttyggtttagtttagaygtygtagtggyggtaattgyggtagyggtggyggttttgatttygygtatttygttttttttttttagttagtttat

SEQ ID NO: 10440 - DNA, 247 bp, synthetic construct
  misc_feature 1..247: note = Description of Artificial Sequence: Synthetic polynucleotide
  source 1..247: mol_type = other DNA
tttttygyggttttttttttttygygtttttttttttatatygggttttyggggtagtagyggggaggggagatyggygggggagggaggatagggaggygaaggaattggggtggggggtgygtgtgtggtggagggggtgggaygatataggtgttttgaggggaggagtygggaggaaggygaggaggtygggttaagtgggggtgyggaggtyggggagataggaaygyggttgygggygygg

SEQ ID NO: 10441 - DNA, 292 bp, synthetic construct
  misc_feature 1..292: note = Description of Artificial Sequence: Synthetic polynucleotide
  source 1..292: mol_type = other DNA
gggygttgaggttgaagttggggtygggggtgggattgggggygttggggttgggtygggggtgggattgaggttgygggygtttaattgggattgagtygagggtagyggtggggttgggtygggggagtaggggtygygtygggtagygtygygtgttggagyggaggygggtgyggtyggggtaggtygygggaggaggaagygtttggggagtaggagttgggtygggygggttygygtttygtattygygggggtgaatyggagtygtygtagggggttyggggggt

SEQ ID NO: 10442 - DNA, 201 bp, synthetic construct
  misc_feature 1..201: note = Description of Artificial Sequence: Synthetic polynucleotide
  source 1..201: mol_type = other DNA
tgttgtggggtttagggttgtatggggtagtaaggygygggggttygggtygtagagttttyggggaggattyggaggggaggtagtggttyggyggttygggttatagttyggtgtggtgggggggagggagayggggygggagagggggtaaggttgtttttgaagggaattagttggttygttygttggtygagttgt

SEQ ID NO: 10443 - DNA, 201 bp, synthetic construct
  misc_feature 1..201: note = Description of Artificial Sequence: Synthetic polynucleotide
  source 1..201: mol_type = other DNA
atttttgttttttatatttattttttattttygttttagaaataygttttttatatygggttygtyggatttttatattttttattygygttagaaaygygygtattttygtggtttttttttgtygygygtaaataygttyggttygygtaygttttttyggtttggtttygtatattygygttagaaataygygtggtc

SEQ ID NO: 10444 - DNA, 201 bp, synthetic construct
  misc_feature 1..201: note = Description of Artificial Sequence: Synthetic polynucleotide
  source 1..201: mol_type = other DNA
ygaygttygagttagyggagttyggagtygttgggtttttygtttttttygttygttygtttttttygttttttyggtttttttygtttygtygttttgygtygttttattataaaaggtgaggttyggggggagggggygygggattttygtttygyggaagyggtttttatttgttttttaatttgttyggtygygttt

SEQ ID NO: 10445 - DNA, 201 bp, synthetic construct
  misc_feature 1..201: note = Description of Artificial Sequence: Synthetic polynucleotide
  source 1..201: mol_type = other DNA
gttttattaagyggttttagttataayggygtgtatgttaattaygtttgtaggttatygttygttttyggttgtyggattatttagygygttttttttygagtttyggayggggagaggaggagttaggggaggaggygggaggaagggaaggatggggaggataatgggggaagaagagggaggatggaggaagggggt

SEQ ID NO: 10446 - DNA, 201 bp, synthetic construct
  misc_feature 1..201: note = Description of Artificial Sequence: Synthetic polynucleotide
  source 1..201: mol_type = other DNA
tattatttygttgtyggyggygtttttttgggaagtagtagtaattggtggagttggagtygtagtagtttgagtygtygtagtagtttttgtyggagtygtagtaggaggaggaggaggygggygtyggggtgggygtyggggygggatayggagyggggttttgggaygattttttggaaaagtttttggyggaaaygg

SEQ ID NO: 10447 - DNA, 201 bp, synthetic construct
  misc_feature 1..201: note = Description of Artificial Sequence: Synthetic polynucleotide
  source 1..201: mol_type = other DNA
gggyggggtyggaggaaaaggggyggggyggyggggaaaatataaattaaaatttaaaaattagttaaaggaaggatggaagtttygyggttttttyggygtttagyggtgtttttgttttggtgttyggattttagttygyggtttgtttgtttgttagtttygtggatatygtattgtygggtagygtttyggtygtat

SEQ ID NO: 10448 - DNA, 201 bp, synthetic construct
  misc_feature 1..201: note = Description of Artificial Sequence: Synthetic polynucleotide
  source 1..201: mol_type = other DNA
tagtatgatgtygtttttttggtagtggtagggggtygggtaggyggtgggtttygggtygggttggggggygtygtyggtttttygggaagygtatagygyggygtaaagttatagygttyggagtttyggygggttgggtatttyggyggtygggttattggggtatttggyggtygggygyggaygtayggygygatg

SEQ ID NO: 10449 - DNA, 241 bp, synthetic construct
  misc_feature 1..241: note = Description of Artificial Sequence: Synthetic polynucleotide
  source 1..241: mol_type = other DNA
ygaagaaaggggygygggggygygggggygygggggygygtggggygttgggygtyggaggtttggtaggatgygyggtggggtygtygtygtygtygtygttgygygttygttttttggtygggygygygtttygtttygtagtatttatagggygtygyggtttygtttttttataggtttygtttyggttagtttaygtttygttttyggtttygttttttgtygttagggygygtag

SEQ ID NO: 10450 - DNA, 201 bp, synthetic construct
  misc_feature 1..201: note = Description of Artificial Sequence: Synthetic polynucleotide
  source 1..201: mol_type = other DNA
gtygttgtygttttgtygttyggtgtgygagygygttaaggtyggttgygygtygtttatgygttagtayggtttygtttggttygatygtatgygttgygatyggttgttygagtaaggtaattttgataygttgtgtatggattataatygtatygatttaattatygtygygtttagttygtygygtygtttgtygtc

SEQ ID NO: 10451 - DNA, 201 bp, synthetic construct
  misc_feature 1..201: note = Description of Artificial Sequence: Synthetic polynucleotide
  source 1..201: mol_type = other DNA
agaggaagtgagaggtgtttaattyggttatgtagaaygtagttgggttgttygaaaygaaataaagyggttatttygaaggaggtgttgtttttgggtyggtttaggttgagttagagtagaygttatttttaygttaaaaatattaggttattgttttagggagttgggttatttattgaggttatttttattttattt

SEQ ID NO: 10452 - DNA, 201 bp, synthetic construct
  misc_feature 1..201: note = Description of Artificial Sequence: Synthetic polynucleotide
  source 1..201: mol_type = other DNA
gtatttatttttttgayggtttygtttygtagggagggtttgtgtyggttgttggagtttattygtagatttatttttattattttygagggttagaggygygatttygygtattyggygtttygtttgttgygttagtatygttatttggtgattttgttgttttggaggttyggtttygtggtgyggagtaggygyggg

SEQ ID NO: 10453 - DNA, 201 bp, synthetic construct
  misc_feature 1..201: note = Description of Artificial Sequence: Synthetic polynucleotide
  source 1..201: mol_type = other DNA
ggtttttggagttattggtttagggygggttygygggatggggygggyggttyggggygtagtyggttaggtygttgttatggtaaygyggtggaaaaaygggtttttgggtatttygttgtyggtyggttggtaattttttagyggagggatygggtygagttygyggattttttygagtgttttttggggtttagtygt

SEQ ID NO: 10454 - DNA, 201 bp, synthetic construct
  misc_feature 1..201: note = Description of Artificial Sequence: Synthetic polynucleotide
  source 1..201: mol_type = other DNA
ttaaaagtagtttttttgaattttatttgggttttgtagggttttttygaggttygagaattgggagaagggaaagagtttatyggtttgtttgaaggtyggygggyggtgtaggtagttttttttagatttttttagtttyggttttttaygtatattagaagagtygttttttttttttagtgattgaaattatttgga

SEQ ID NO: 10455 - DNA, 201 bp, synthetic construct
  misc_feature 1..201: note = Description of Artificial Sequence: Synthetic polynucleotide
  source 1..201: mol_type = other DNA
ggttttgttttagggttttgtattttygagagttgttgtatgtyggggattggtttttaagtttgtttgagtttttttagtttttygggtatygttatgyggtgggagggtgagttttttttttttgttgaaatttyggyggtttggtaatyggtyggggggttttggatttttyggggagatattattgatgttttgtgg

SEQ ID NO: 10456 - DNA, 201 bp, synthetic construct
  misc_feature 1..201: note = Description of Artificial Sequence: Synthetic polynucleotide
  source 1..201: mol_type = other DNA
gtgtttttygttgatttttagaggagatattggttagggttttttttttygagataaattttattttggaaaggttgttagatygggygyggtgatttaygtttgtaattttagtattttgggaggatgaggtgggyggattgtttgagtttaggagttygaaattattttgggtaatatgttgaaatttygtttttatta

SEQ ID NO: 10457 - DNA, 201 bp, synthetic construct
  misc_feature 1..201: note = Description of Artificial Sequence: Synthetic polynucleotide
  source 1..201: mol_type = other DNA
gtatatttyggtygggtgygggtyggyggggtatagyggtttttayggttygttttygttagttatttttyggttttttttttygttgttygygtgtttygggtyggtttagtatttttygagttaygtgttygygtttttyggyggggaggagygtagtygygggggygygtttyggtgatttygttttttagttttttt

SEQ ID NO: 10458 - DNA, 201 bp, synthetic construct
  misc_feature 1..201: note = Description of Artificial Sequence: Synthetic polynucleotide
  source 1..201: mol_type = other DNA
ttttygygtatygtygtygygtatttatttttaygggtggagyggggyggggtagtayggtttygygygtagtttygattygttaggygtatygatyggyggygtagygttggygygayggttygattyggtygggtttttgtttygggygygggttyggtttgggagygggygagttygtttgtaggggaggyggggatt

SEQ ID NO: 10459 - DNA, 201 bp, synthetic construct
  misc_feature 1..201: note = Description of Artificial Sequence: Synthetic polynucleotide
  source 1..201: mol_type = other DNA
ggggyggagyggggaggggyggggyggagyggggaggggyggggyggagaaggatygtagggttgagyggggygttagygttagtgttyggtattgtttygggttgggttttttgygttagaggaaggggagttyggggayggggtayggggttygygaggtaygggtgttttttyggggtttyggaagttttttttttyg

SEQ ID NO: 10460 - DNA, 239 bp, synthetic construct
  misc_feature 1..239: note = Description of Artificial Sequence: Synthetic polynucleotide
  source 1..239: mol_type = other DNA
gagaggaagggggaaggagatagaggaatygagattggggtgagggagyggtygygygtggttttyggagaggygtttattatttgygtggygttttttygygtyggagtgyggttttgtttttagygttagtgygtygygyggttygtyggtttygtaggattggttatygttttttatttatgtaatttgygtgtgygtgtgygtgtgtgtgtgtgtttttttttygttygtttttt

SEQ ID NO: 10461 - DNA, 201 bp, synthetic construct
  misc_feature 1..201: note = Description of Artificial Sequence: Synthetic polynucleotide
  source 1..201: mol_type = other DNA
ttttttygtgggtggttttygtgagttttttggttagtttttttattttagttttataatggtttatygtttgtaatattttttttgyggttatagtttyggtggatggaggtaggagggggttayggggtgggggagatggatgygaagttggyggggaaagggagaaggaaatgggaagggatgggtggaaayggaaaa

SEQ ID NO: 10462 - DNA, 201 bp, synthetic construct
  misc_feature 1..201: note = Description of Artificial Sequence: Synthetic polynucleotide
  source 1..201: mol_type = other DNA
ttatttgaaattgataggtttgttttttatgataatagttgttattaattagttttttttatatttttttatttatyggttttagtattttgtatatttygyggagaattygtttttggttttttatagagtatagtattagggtgtagattattatatttatagagttattagttatttggtgtatgtttttttyggtag

SEQ ID NO: 10463 - DNA, 201 bp, synthetic construct
  misc_feature 1..201: note = Description of Artificial Sequence: Synthetic polynucleotide
  source 1..201: mol_type = other DNA
aaaatagtagttttatggaaaataatagaaaaaaattttattttagtttggtaattaayggttggtygggggaygtgttygygttgtttttttttyggtygttagggggygtaggaagaagttttggaggtttgtttygggatygygtattygtttttttttttygttagttttttttttattttygttgagtttygtttc

SEQ ID NO: 10464 - DNA, 201 bp, synthetic construct
  misc_feature 1..201: note = Description of Artificial Sequence: Synthetic polynucleotide
  source 1..201: mol_type = other DNA
gtttgaygaagttttttttgggggtygatgttttttttygggtgggaaggggygttgtyggtgagggttattttggygtyggtttgygtygttygaagtygggggggaggggaggttttygtttagtaggggttaygttygtttyggaygggggtygygygggygtttaggygaygtattttygtyggggttygtgatygt

SEQ ID NO: 10465 - DNA, 201 bp, synthetic construct
  misc_feature 1..201: note = Description of Artificial Sequence: Synthetic polynucleotide
  source 1..201: mol_type = other DNA
ttttgagaagtaatagatttygattaatgtgtatygttttygyggygtttygtygygttyggaatygttgtttatttggygttyggtaaggaaggttgtyggagggtttataggtgtttttttygttttyggagaagttyggtgtgggyggygttattttagaaaygttatyggygygtttgtttygagyggygggggyga

SEQ ID NO: 10466 - DNA, 201 bp, synthetic construct
  misc_feature 1..201: note = Description of Artificial Sequence: Synthetic polynucleotide
  source 1..201: mol_type = other DNA
tttgttatttgtatttaagatggatttttygttgtygtygttgttttttyggtttttttgttattattttttaygttttgtagttttgttttttgtttaygggttgttaagtygyggtttggtyggtggtggtagtggyggagttagataaagttttygtttttttygttttagagttttttaggygttttaagtggyggg

SEQ ID NO: 10467 - DNA, 201 bp, synthetic construct
  misc_feature 1..201: note = Description of Artificial Sequence: Synthetic polynucleotide
  source 1..201: mol_type = other DNA
ttttagggyggtygtttttattttyggtttttatttagyggggatttattagggygagggttgaagatttygygggaygtygygygtyggggatagygaygtatttatttttttagttatttgggaggttgtaggttygggtyggagttygaggtttaggggygygyggagtagttttggttaaggygtagggygyggggt

SEQ ID NO: 10468 - DNA, 201 bp, synthetic construct
  misc_feature 1..201: note = Description of Artificial Sequence: Synthetic polynucleotide
  source 1..201: mol_type = other DNA
ttttggggtygggyggggyggggyggggtaggggggtygggygyggtttaygygttttttygagtgygyggtgygggaygggygyggttgaygygttttygtyggtgtttgtgttttttygtaggttaggagggtattttgygttgttattyggatttggygggtagygagttgtagyggggtaygtttayggtygagtyg

SEQ ID NO: 10469 - DNA, 201 bp, synthetic construct
  misc_feature 1..201: note = Description of Artificial Sequence: Synthetic polynucleotide
  source 1..201: mol_type = other DNA
ygggtttggataggttagtttgagagtatgygaagtyggttttygggtagataataagagatatygtygggaagtgttaggaatttygygygttgttygyggggtttttttgtagtyggggttgggttagaaggatggtaaagttgygyggygtygttygggttggagtygtagtygaggagtygaagtttttttaggtyg

SEQ ID NO: 10470 - DNA, 201 bp, synthetic construct
  misc_feature 1..201: note = Description of Artificial Sequence: Synthetic polynucleotide
  source 1..201: mol_type = other DNA
gattyggagttaygyggggygggggtyggtatygagggtygggaggygygaagggtaygyggyggygggaagyggggygattygaaggtttaygggggtygggaggttgyggggygttygggattttttttygggtggttatygtgyggtyggggygyggaagttagaggtgtttagaggygtygatttygtygaggttgc

SEQ ID NO: 10471 - DNA, 201 bp, synthetic construct
  misc_feature 1..201: note = Description of Artificial Sequence: Synthetic polynucleotide
  source 1..201: mol_type = other DNA
tagtygaggtagaaattygtttygaggygygggygtygggttygggttttaaggatgygygtygggttttttttygyggggatagtygagtttygtyggygttttaggtgttttygtagtgygttygggygyggaygtttttttgttttyggaggggaagygggagggtttttggggtaaygtttygatttygggtttttt

SEQ ID NO: 10472 - DNA, 201 bp, synthetic construct
  misc_feature 1..201: note = Description of Artificial Sequence: Synthetic polynucleotide
  source 1..201: mol_type = other DNA
tataggtgttttygtygtaggtttygtatatttatttatggtatttatataggggttygaagaatatgttyggtttagttaygtggtagatgtagaygtygtagtygtagyggtttyggtygtggtatagygyggttttygggggttgtttaggtgygyggtagygtygtttygattyggttygggatagtttgtaggygg

SEQ ID NO: 10473 - DNA, 201 bp, synthetic construct
  misc_feature 1..201: note = Description of Artificial Sequence: Synthetic polynucleotide
  source 1..201: mol_type = other DNA
agatygttgtttggttattttaygtttttgagttttttatatagttagtttygtgattttygagtttygtgattttygagtttygtgatttttaagtttyggaagtygttgtaggtagyggtttagttaggtttygttttttttatyggagttttaygygttaattttagttaggtttygttttyggtygttttaggygtg

SEQ ID NO: 10474 - DNA, 201 bp, synthetic construct
  misc_feature 1..201: note = Description of Artificial Sequence: Synthetic polynucleotide
  source 1..201: mol_type = other DNA
gtagtagtttatygaggayggggattygtaagtggyggaggttyggggttgggggtygtygggagggygggaygygygyggtttgggggtgggaggygtygggtttggagttygagtygggggattagygatgtagtygggygggygtygyggtatttyggggtttttgtatygtttygaaygttgtagggttgtagggtc

SEQ ID NO: 10475 - DNA, 201 bp, synthetic construct
  misc_feature 1..201: note = Description of Artificial Sequence: Synthetic polynucleotide
  source 1..201: mol_type = other DNA
attttgtaggtygtatttttaattygtattttatttaggttttygtttggygtygatttgttttagtttaattttyggtttygtagattaggtatttttygggaygyggggtagattttgygttygggttttttttygtagtygggttgttyggtttttgygygygtataataggyggtayggygtagttttygggagygc

SEQ ID NO: 10476 - DNA, 201 bp, synthetic construct
  misc_feature 1..201: note = Description of Artificial Sequence: Synthetic polynucleotide
  source 1..201: mol_type = other DNA
aggatggygatggtattggygyggattttttttatggtgggtagaygggygttttaggtgggggattgggtyggygtgttttyggggtyggggygggggygttygtagttttagttgtttgttttygttygygtttagttgtttagttttgtagagtagaaaaaggagagaggtgggggggygggggggtgatagggagag

SEQ ID NO: 10477 - DNA, 201 bp, synthetic construct
  misc_feature 1..201: note = Description of Artificial Sequence: Synthetic polynucleotide
  source 1..201: mol_type = other DNA
ttagttttttttgagggagtttagyggtgygggttygtttttttttagtttagtttttttgatatygttttttttttggggaygttgtttgygggttygygygttttygttttygatttttttgtaggttttttygggggtyggggtaggatygtatttatygaggattygggygttggagttagtagtagyggtaygagt

SEQ ID NO: 10478 - DNA, 201 bp, synthetic construct
  misc_feature 1..201: note = Description of Artificial Sequence: Synthetic polynucleotide
  source 1..201: mol_type = other DNA
taagtygaagtttttgaaggaggttyggtgttatttyggtgtgatygygtttyggygaygttgggtagggtgtagggagttagttyggtygyggtttagygggaggggagggggtyggtttygaattygggygttygggtygygggtgatttattgggaaygttaggttygygygtttagatyggygggygaygtttagyg

SEQ ID NO: 10479 - DNA, 201 bp, synthetic construct
  misc_feature 1..201: note = Description of Artificial Sequence: Synthetic polynucleotide
  source 1..201: mol_type = other DNA
gggggttyggtttagggygggaaatgggtggggaggggyggggtttgggttggagattggayggaggagtygggyggagatgtaattggaggaagagggygggayggggyggagaaggtttttygtatyggyggagggagagggattaggagggggttgyggygggggaggagagggggttttyggtttagagattgaggc

SEQ ID NO: 10480 - DNA, 201 bp, synthetic construct
  misc_feature 1..201: note = Description of Artificial Sequence: Synthetic polynucleotide
  source 1..201: mol_type = other DNA
gygatttttgttttttttttgggtygagyggtaggygygttygtatygttttygttttttygtygtagtygttgtygatyggttggttgggttttgyggygtgaggatttyggyggygtygtagtttygygagttatggtttagttyggyggggaggttyggttygggtttaagayggyggtgtagattygygtygttatt

SEQ ID NO: 10481 - DNA, 201 bp, synthetic construct
  misc_feature 1..201: note = Description of Artificial Sequence: Synthetic polynucleotide
  source 1..201: mol_type = other DNA
tttatgaatatttyggggygygggagttygagygttgtyggagggygtttygggggaggyggtygttgatgtaagttyggygggtygttgggtttygttyggttgyggygggagtttygggaygggtyggaygggtyggggtagaggaggygaggygagttygygggtggttagttataaagttygggyggygagatagac

SEQ ID NO: 10482 - DNA, 241 bp, synthetic construct
  misc_feature 1..241: note = Description of Artificial Sequence: Synthetic polynucleotide
  source 1..241: mol_type = other DNA
ttttatttttatatatttatattyggtygtttttygtttttttattygtttgtygygygygygygygatttygtttatatatagygygygygaygtyggyggagatygtttygtttttttagatygaaygtygttygttygtttgttgaggagyggygygygtttyggtttygtttttttggygtygyggygyggygggyggggggyggyggtyggaggagttgggggtygggttagygyg

SEQ ID NO: 10483 - DNA, 201 bp, synthetic construct
  misc_feature 1..201: note = Description of Artificial Sequence: Synthetic polynucleotide
  source 1..201: mol_type = other DNA
ttttygtygttttttaggtttttagtgaggttttttagttggtygtttattatggtttttattatgaaygttatggttttygtyggtyggggtatygggygtttgttattaygygttaggtatygggtaygttygygtttattttagtattaggtttygyggatagttttygtygygggttygygttttaygtttggtatc

SEQ ID NO: 10484 - DNA, 201 bp, synthetic construct
  misc_feature 1..201: note = Description of Artificial Sequence: Synthetic polynucleotide
  source 1..201: mol_type = other DNA
gattyggtatgaggagttyggtatttttgttttttagttttttggaagtttttttttggattggtyggygtygttttttygatatttgggggttgaggtyggtatttygggtttgygtggaggggygagygttaaggttgygagagtygggtttygatttgtaattattttttttaatttttatggagtttygtttygygt

SEQ ID NO: 10485 - DNA, 201 bp, synthetic construct
  misc_feature 1..201: note = Description of Artificial Sequence: Synthetic polynucleotide
  source 1..201: mol_type = other DNA
gygttyggtagagagtttttagtygtttyggatttygygtagtttygtagagaygygygtgtygttygtaygggtyggtattygggtygttttygtyggygtgttaggatttygtatagaagygttyggaygyggaygtaygtagtygyggttaygattttygtygttygttyggttygtgttyggttttggttagtaggg

SEQ ID NO: 10486 - DNA, 201 bp, synthetic construct
  misc_feature 1..201: note = Description of Artificial Sequence: Synthetic polynucleotide
  source 1..201: mol_type = other DNA
ttttttyggttttttttttatttttygttttyggggtttttttttgttgagygggggttgtygggatttgggattgyggggttgtttygatttygtagtygttygyggtggaagttagttygggtttggttttgagygygyggttggggyggtygttgtttatggtgttggygygggtggygygtyggtyggyggggtttg

SEQ ID NO: 10487 - DNA, 201 bp, synthetic construct
  misc_feature 1..201: note = Description of Artificial Sequence: Synthetic polynucleotide
  source 1..201: mol_type = other DNA
tygttygygtattggggttttygaggtgtgatgttatttgttygtagaatyggtttttttygygtygtttttttygygtttttattttagtttttttttygtygttttyggggttaatatggtagyggygtygtygttttattttygtaatygtaygattyggttggtagggtygtyggttyggattttygagatttatat

SEQ ID NO: 10488 - DNA, 201 bp, synthetic construct
  misc_feature 1..201: note = Description of Artificial Sequence: Synthetic polynucleotide
  source 1..201: mol_type = other DNA
tygygggygyggtttttggaayggattttttttygagtygygttygtygggtygtttttttttygttygtagatttyggttyggtttygtygtygygygygttttttttygttttggttttttttttttygttttygggtttyggygttttygttyggttygagygygyggtttgtttygttyggtttattatggygyggt

SEQ ID NO: 10489 - DNA, 201 bp, synthetic construct
  misc_feature 1..201: note = Description of Artificial Sequence: Synthetic polynucleotide
  source 1..201: mol_type = other DNA
ggttaggttttttaggagtagttggggaatattyggygattttggyggttgttttttggtggygtagggagttygygtgtttgygagtgygtgtgtgtgygaagtttttygggtaagtgtgttagygygygtttgggtgtgtgtaagggtgtgagygtgtataygtgggtaygggygtgtgygygygggggtgttyggttg

SEQ ID NO: 10490 - DNA, 201 bp, synthetic construct
  misc_feature 1..201: note = Description of Artificial Sequence: Synthetic polynucleotide
  source 1..201: mol_type = other DNA
tttygtttttattygttttttttatygygtygttttttygttttgttttgygggtttaggyggaattyggaayggtygtttttttttttygtttttygtygtygttttttttttttttttttyggttttttttttagtttygggtyggagyggggtgtyggyggyggtyggttygggyggyggygtttggttatgtygtgt

SEQ ID NO: 10491 - DNA, 201 bp, synthetic construct
  misc_feature 1..201: note = Description of Artificial Sequence: Synthetic polynucleotide
  source 1..201: mol_type = other DNA
ttaagttygttgggygttygtttttgygtatygygttygtttttttygtttgtgygtttgggtttyggygtaygtattgtatttgtygttygtttttgtygtgtgtgtgtattgtyggggttygttygtttaygttygygygtgygtttttatttttatttygtattygygtgtaygatttattygtygtygttgtgygyg

SEQ ID NO: 10492 - DNA, 201 bp, synthetic construct
  misc_feature 1..201: note = Description of Artificial Sequence: Synthetic polynucleotide
  source 1..201: mol_type = other DNA
tgtygaatgaagttgagygttttagtggaattagggattttaggggtgagygatygygaggggagagygaygaaaagggyggtyggagttggaggggygyggagttaaataaaaaagggyggtyggagttgtaggggygtygagttaaataygttatttttagatggggggttttaggygagttgtttagtttttttgagg

SEQ ID NO: 10493 - DNA, 219 bp, synthetic construct
  misc_feature 1..219: note = Description of Artificial Sequence: Synthetic polynucleotide
  source 1..219: mol_type = other DNA
cgtttgtttcgtcgttcgtatcggtttagttttcggcgttcgttcgtttttttcgttcggagcgttgtgagttaggagtagtcgtaggtttttcggacgcgttcgtcgcgcgtattacgtggttcggaggcggtcgttagtttgcgttcgcgatcgggggcggacgttgtattatcggttcggagttgggtaggggaggtttttcgttttttttttagg

SEQ ID NO: 10494 - DNA, 315 bp, synthetic construct
  misc_feature 1..315: note = Description of Artificial Sequence: Synthetic polynucleotide
  source 1..315: mol_type = other DNA
gacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcg

SEQ ID NO: 10495 - DNA, 201 bp, synthetic construct
  misc_feature 1..201: note = Description of Artificial Sequence: Synthetic polynucleotide
  source 1..201: mol_type = other DNA
cgcgtcgttttagcgttttgtagcggaggcgtcgtttttatttcgatcgtaggttcgttcgggtcgttcgttcgtcgggtatcgagtcgttttgtcgcgcgttgcgtttcggggcggggtgggaggagagggagtagtcgttattttgtttaggtcgtcgcgggttagttttgtagttagttttagttttgggtcgggtgt

SEQ ID NO: 10496 - DNA, 201 bp, synthetic construct
  misc_feature 1..201: note = Description of Artificial Sequence: Synthetic polynucleotide
  source 1..201: mol_type = other DNA
gttcggagcggtcgtgaggggcggacggggggtttcggggcgggtttgtaggttttggggatttgaggttgtcgggaggggttgttagggggcgttggtcgggcgtcgggttttgcggagttggggcgtcgatttttgattcgcgagaggggcgttttcgtcgtgttggtcgtagttgttatttttagcgtttttattatt

SEQ ID NO: 10497 - DNA, 201 bp, synthetic construct
  misc_feature 1..201: note = Description of Artificial Sequence: Synthetic polynucleotide
  source 1..201: mol_type = other DNA
cggcggtgattgcggtttcgcgcgcggttcggtttaggtaggattcgaagcgcggtttcgggcggcggcggcggcggcggcggcgtggtttcgttcgggcgggttttgcgggataagacggggagtcggttacggggtggggcgattggcgtttcgggagtaggaggagaatcgcgggtaggcgggcggggagggtgcgcg

SEQ ID NO: 10498 - DNA, 201 bp, synthetic construct
  misc_feature 1..201: note = Description of Artificial Sequence: Synthetic polynucleotide
  source 1..201: mol_type = other DNA
aagtttttcgtttagttttgtcggttcggtttgggcgttgtggatcggtaatagtagttttattaggatgtaggtcggattaagtttttggggaaaattcgttgtaataattgttttttatatataatttttaattttttttttattttcgtttttaattcggagatttgtaaagtttaagaaagggaaaagtaattttat

SEQ ID NO: 10499 - DNA, 201 bp, synthetic construct
  misc_feature 1..201: note = Description of Artificial Sequence: Synthetic polynucleotide
  source 1..201: mol_type = other DNA
tagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttg

SEQ ID NO: 10500 - DNA, 201 bp, synthetic construct
  misc_feature 1..201: note = Description of Artificial Sequence: Synthetic polynucleotide
  source 1..201: mol_type = other DNA
ttttatgacgtcgaattgtttgggggatcgttagcggtgcgtcggtcggagttagttggtggcggggcgggcggttcggagtgtttgtttaattttgagcgttcgcgagggggaggggaggtagttggttacgggttagggggtagtaaggtggaggagcgggggttgggaaaggggagggtatttttcgggttgtttgtt

SEQ ID NO: 10501 - DNA, 201 bp, synthetic construct
  misc_feature 1..201: note = Description of Artificial Sequence: Synthetic polynucleotide
  source 1..201: mol_type = other DNA
ttttttcgttttagttagacggggcgttcgcgttttttttttcgtttcgcgttggtttttaataggaagtcgtttcggtttttagtacgtgatttttatcgtatttgtatatcggagggcgaattggttaatcggtattttgtatttgagtttttttttcgcgcgtttttttcggtttattggtttttcggttaggttacg

SEQ ID NO: 10502 - DNA, 201 bp, synthetic construct
  misc_feature 1..201: note = Description of Artificial Sequence: Synthetic polynucleotide
  source 1..201: mol_type = other DNA
gtcgttatcgttatcgtagttgtagcgtttttttatatttttagcgcgtcgtcggtcgggtagtttggtcgcggtacggaggaggggttttggagggggcggtcgggggaggcgacgtcgagttatcgttttcgggtagtcgtcgtcgggggggagcgcggagatttgaaagggcgcgtcgggtaacgttttttttttttt

SEQ ID NO: 10503 - DNA, 201 bp, synthetic construct
  misc_feature 1..201: note = Description of Artificial Sequence: Synthetic polynucleotide
  source 1..201: mol_type = other DNA
ttattgttttttgggcggtgtggattagttgtagagtgtgatttgcggttagggagtgttttttcggagttttcgtttttagatttttggtgttaaagacgttttgtgagcgggtggggtcgggcgttttagttacggcggtcgtcgtttttttttttcgtaggacgggatagcgtttttgtggatcgcgttttagatggg

SEQ ID NO: 10504 - DNA, 201 bp, synthetic construct
  misc_feature 1..201: note = Description of Artificial Sequence: Synthetic polynucleotide
  source 1..201: mol_type = other DNA
cgtggaggcgataggcgtcggcgataattttttagttcgggcgtcgcgcgtcgtttcgcgggacgcgtattggggatttcggtcgtttttttcgtttttcgcgcggatataaagttcggtagtcgcggcgtttagagggtcgagggttatcggatagttcgggtagattttggattcgtttcgcgggagttgtttttttgt

SEQ ID NO: 10505 - DNA, 243 bp, synthetic construct
  misc_feature 1..243: note = Description of Artificial Sequence: Synthetic polynucleotide
  source 1..243: mol_type = other DNA
aaggttggagggtgttagaaagatgatcggtcgggtacggagcggggagttcggagtcgcgcgtggggaggggaggtggaggagggggcgtcgggggagcggggggcgcgtgaggggtgcgagcggggttcggggggcgcgcggtgggtgtggggggcgtcgggtttatttatttttcgttagcgtcgttattgtcggttatatgattgaggttgttgttgggatgacggttcgggttttagt

SEQ ID NO: 10506 - DNA, 201 bp, synthetic construct
  misc_feature 1..201: note = Description of Artificial Sequence: Synthetic polynucleotide
  source 1..201: mol_type = other DNA
ttttgtatttgtaatttttcggggtagtgatatagttggtttcggtgttttggcggagggtagaagtgatggtcggttgcggttttgtagggtgagaatcgggttagataagtgagtgttttagagtcggggagttgtatacggaggggagggagtggcgggcgttgcgtcgggtttttttaggaagaggtgagcgggttg

SEQ ID NO: 10507 - DNA, 201 bp, synthetic construct
  misc_feature 1..201: note = Description of Artificial Sequence: Synthetic polynucleotide
  source 1..201: mol_type = other DNA
cgaatgtggttaagggggtcgtttagatgggtgtagatacggttaagatcgtgttgatcggtattaaggatattgtttgtagtggggttatcggtgttgcgaacgtggttaagggtgttgtgtaaattgggttgaaaacgatttaaaatatcgtaataggtataaagaatatttttggtagtggggtgatcggtgttgcga

SEQ ID NO: 10508 - DNA, 201 bp, synthetic construct
  misc_feature 1..201: note = Description of Artificial Sequence: Synthetic polynucleotide
  source 1..201: mol_type = other DNA
gtcgcgtttttgggaacggttagggaagtaagtagaagtcgggaagtcgcgaaagaggcgagaaagtgcgattttttttttagattttcggtttttcgtcgaaatttttgtcggtcggttaaattttagataatggaagttttacgtttttatttttatttttttttataagttcggtcgcgggtttttttcggttcggga

SEQ ID NO: 10509 - DNA, 201 bp, synthetic construct
  misc_feature 1..201: note = Description of Artificial Sequence: Synthetic polynucleotide
  source 1..201: mol_type = other DNA
tgtgacgattttttaagggggttttgtgagtattttttttttatagttaggaaattgaggtatagaagggagggattgtttggtaggagttaatagaggcgtatagagtagcgtgatgagtttcgggttttgggggcgggttcgcgagtaggtagtttttattttatggtggatttttaggtttttttttttgtttcggtt

SEQ ID NO: 10510 - DNA, 201 bp, synthetic construct
  misc_feature 1..201: note = Description of Artificial Sequence: Synthetic polynucleotide
  source 1..201: mol_type = other DNA
tacggagtttttttacgcgtttattgcggtttcgtcgtgttaaggggagtttggttgtttacgggttttatttgttagcgagaagatagtttggtcgggcggttgattttattttgtaattttgatattgtgtttttcgggtttgtcggttttatgatttgtgtttaaagtttgatttttcgtagattaggtaaaagttaa

SEQ ID NO: 10511 - DNA, 201 bp, synthetic construct
  misc_feature 1..201: note = Description of Artificial Sequence: Synthetic polynucleotide
  source 1..201: mol_type = other DNA
ttttgtgtttttacggcgcgtagaggcggcgtcgcgaattttgtgtgtattttatacgacggcggggattgaggtttttcgtagtttagagtcggagttcggggtcggtcgagttcgtaggatcggttttttcgtcgatttttacggttttatttagttttttgggtttatggcggcgtcggcgttggtgagtggagggtt

SEQ ID NO: 10512 - DNA, 201 bp, synthetic construct
  misc_feature 1..201: note = Description of Artificial Sequence: Synthetic polynucleotide
  source 1..201: mol_type = other DNA
ttatcgtagtcgatagttttataaatattatcgttcgtttagttttcgttttttcgggtcggttgttatttcgcgttttcggtttggttttggtttcgtcggttgtattgtacggttcgttttttcgtttatttgtttattaattttgtagacgttttgtgtttattttttttttttttttggttattttttttttttgtt

SEQ ID NO: 10513 - DNA, 201 bp, synthetic construct
  misc_feature 1..201: note = Description of Artificial Sequence: Synthetic polynucleotide
  source 1..201: mol_type = other DNA
ggcgtttttttcgttcgtttgcgggttcgttgcgttagtcgtcgtaataaagtttgatagggcgtggtttcgcgggaagcgggttcggcgttgttcggtcggggcgtaggcggttcggttcgggttttttcggtagcgtcgagtttagggttttttaattcgttatcgtcgtcgtttgtttcgtcggggcgttttagtttt

SEQ ID NO: 10514 - DNA, 201 bp, synthetic construct
  misc_feature 1..201: note = Description of Artificial Sequence: Synthetic polynucleotide
  source 1..201: mol_type = other DNA
aaaataaaggatgggtgaataaattgagattcggtttgttgggcgttatgtggagatcgtgtgtaggaagagttaagatattagagtcgggggggtttcggtgatttttgtcgttttttgtattttgggtttatggttggggtttgtttttttttagttggtagtgttattttttttgtgttttattaagtttattagtaa

SEQ ID NO: 10515 - DNA, 201 bp, synthetic construct
  misc_feature 1..201: note = Description of Artificial Sequence: Synthetic polynucleotide
  source 1..201: mol_type = other DNA
tgtcgtggtttcgggttattgtagtttttttgtttcgggttttcgtggtttttttgtttcggtttgttaagtgtttgggattgcgggcgggcgtcgttacgtttgattggtttttgtatttttggaggagacggggtttcgttttgttgatcgggttggtttttggtttttgatttcgagtggtttgttcgttttggtttt

SEQ ID NO: 10516 - DNA, 233 bp, synthetic construct
  misc_feature 1..233: note = Description of Artificial Sequence: Synthetic polynucleotide
  source 1..233: mol_type = other DNA
agtattcgatttgtgaaaattacgtttatgtagtaatataattggttcgaaagcgttaaagagttaattaagaggttttcggtttttcgtagtttatagcgtagttcgattttttagagtcgtcgagtagacgttcggtgaattttagaggcggcggagggtggcgaggagttttcgttttttttcgtttttttttttttcgatttcgttttttttttttttttttttttttt

SEQ ID NO: 10517 - DNA, 201 bp, synthetic construct
  misc_feature 1..201: note = Description of Artificial Sequence: Synthetic polynucleotide
  source 1..201: mol_type = other DNA
tcggagttgtagtagaagcgttttcgatttcgtttaggtttttagtttatttttttttgaaggtcggtagggggcgttattatcgttggttttttcgcgcggtttcggttttcgtttcgggaatcgagtgtttgtagttcgcgattttggggaggtatagggttagggtatcgtttcggcggagaaagtggttgtgtcgcg

SEQ ID NO: 10518 - DNA, 201 bp, synthetic construct
  misc_feature 1..201: note = Description of Artificial Sequence: Synthetic polynucleotide
  source 1..201: mol_type = other DNA
gggggacgggttagttagggtaggagtttaaggatatgaggtaaagattttaggttgggatttttcgtagttcggaggcggggggtggggagggagggtcgggggggtgttgggcggagacgttgggtattggggttagcgttgggtagttatgtacgggggcggggtaataggtaggttagttgttgttgttttttagga

SEQ ID NO: 10519 - DNA, 201 bp, synthetic construct
  misc_feature 1..201: note = Description of Artificial Sequence: Synthetic polynucleotide
  source 1..201: mol_type = other DNA
aagttcgtgtagcgcgcgtcgttttattaacgcgtttcggcgtaggcggtagaggaaagcggtttttacgcgcggcgttcgcggtttcggggttaggggcgcggttagtagtgttagtacgttttttattacgtcgtcgtcgtttttttcggcggtggtcgagatcggggcgaggttcgtagcgatcggttcggcggggtt

SEQ ID NO: 10520 - DNA, 201 bp, synthetic construct
  misc_feature 1..201: note = Description of Artificial Sequence: Synthetic polynucleotide
  source 1..201: mol_type = other DNA
taggaatgagtttgttgagggtttagtttcggggtcgggagtttgttgtaaaggatatgaaaaatttttattattatttttgtatgtgaaaagaatatgcgtgttggaaataattttttaatttatatatttttaaatatttgtttagatttataggagaaatatttttattgatttttgtataaagtgtattggaggaaa

SEQ ID NO: 10521 - DNA, 201 bp, synthetic construct
  misc_feature 1..201: note = Description of Artificial Sequence: Synthetic polynucleotide
  source 1..201: mol_type = other DNA
ggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgag

SEQ ID NO: 10522 - DNA, 201 bp, synthetic construct
  misc_feature 1..201: note = Description of Artificial Sequence: Synthetic polynucleotide
  source 1..201: mol_type = other DNA
agtttttaagggaggaggggagagttgtagagaggaggaggggtcggggaggtcggttttataaaggcggttggaataattttgttcgttagatttcgtcgttcggattttttgagttgttcgttattttacgtgatcgcgtcgttttttagttttatcgttgagtgagttggggcgcgtttttatttcgtttttagtttt

SEQ ID NO: 10523 - DNA, 201 bp, synthetic construct
  misc_feature 1..201: note = Description of Artificial Sequence: Synthetic polynucleotide
  source 1..201: mol_type = other DNA
gaggagtagtagcgttcgtcgggggatgtagtagcggtagcggcggcggcggcggcggtagcggtagcggcggcgcggagttttttgcgtttagcggttcggtcgggttgcggtagaggcggcggcggcgtttcgtttcgggtgaggttgtcggggtcgtgcgcgttggtgagtggggcgtggggggtaggtgggtggttg

SEQ ID NO: 10524 - DNA, 201 bp, synthetic construct
  misc_feature 1..201: note = Description of Artificial Sequence: Synthetic polynucleotide
  source 1..201: mol_type = other DNA
gttcggagaagtggatttcgttttatcgagaggttagggtttttatgttttcgttttcgatttcggtttagtggtttttgtttttcggattgttttcggcggggcggggttgtatttcggagttttagtttatttcgtagtttttttcgtatttgatattatcggttattttttataatatggcgttcggcgttttttaaa

SEQ ID NO: 10525 - DNA, 201 bp, synthetic construct
  misc_feature 1..201: note = Description of Artificial Sequence: Synthetic polynucleotide
  source 1..201: mol_type = other DNA
ggaatttggaggaatatggcgttgtcgttttttggcggaagcgttcgggtttgcgggtaggggtagttttttagggttcggaggcgtagtgaattttcgcgagttcgtagttcgagtttcgcgttttcggcgtttttgagttcgtttagcgttgtttgcgtttttttttttttttcgttcgtcgttttttttttttttttt

SEQ ID NO: 10526 - DNA, 201 bp, synthetic construct
  misc_feature 1..201: note = Description of Artificial Sequence: Synthetic polynucleotide
  source 1..201: mol_type = other DNA
gttagggatcgttttttattgttttttggttgtcgaggagcggttatcgggttcggttttagtttttttgttttgatttttttttttaagtttttatgtcgagttggagagcggtttttgagtacgtatgtggttcgaaaggtggtagttggtcgggtttgggttttttatgtgatttagttatgcgagggatcggttgaa

SEQ ID NO: 10527 - DNA, 410 bp, synthetic construct
  misc_feature 1..410: note = Description of Artificial Sequence: Synthetic polynucleotide
  source 1..410: mol_type = other DNA
agatatgttgggttagtagtgttggttttattttagattttttttagttttttttagttagtcgttaaggggtttttttaatcggaaatttttaattcgcgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcgcggtgatttcgttgcggatcggttcgcggtgattttagcgcgaacgagttggttgtcggttggggcgagaaaggtttgcggatcggtttgggcgtatgcg

SEQ ID NO: 10528 - DNA, 201 bp, synthetic construct
  misc_feature 1..201: note = Description of Artificial Sequence: Synthetic polynucleotide
  source 1..201: mol_type = other DNA
gagttagagatgtatttttggtcggtttgagtatttgcgggaattttgtgagtttttgaggtttattttttgttttttattttttttttttgtaaatttcgagttcggggtaaagttgttttttttttttatatttttttttaattcgataattaacgttttttagttttcgggaatgggacggattttttttaaggattt

SEQ ID NO: 10529 - DNA, 201 bp, synthetic construct
  misc_feature 1..201: note = Description of Artificial Sequence: Synthetic polynucleotide
  source 1..201: mol_type = other DNA
gggatttttcgtttttcggtttagggggtatttatttcgtacgtggagttcgggtagcgtttttagacgtatttagcgggatatcggagaggacgtcgacgtagtgtaacgtttcggtcgaagcgtcgaataatatgcgcgcgtcgcggaggaggtgcggggcgtgttcgtttaggtagcgggtcgtttcgacgtggtaga

SEQ ID NO: 10530 - DNA, 201 bp, synthetic construct
  misc_feature 1..201: note = Description of Artificial Sequence: Synthetic polynucleotide
  source 1..201: mol_type = other DNA
atgtgttttgtcgagttgatttgtttagtttattttttattttgaaacgacgttaagtatgaagaagagttgtataaataatgttaataatttcggtgtcgtttttatgggggttatggtggttttagtgtattttatatgttttttttttttttgtttttttttttcgtgtatatatatattgttttttgatttaagagt

SEQ ID NO: 10531 - DNA, 201 bp, synthetic construct
  misc_feature 1..201: note = Description of Artificial Sequence: Synthetic polynucleotide
  source 1..201: mol_type = other DNA
gtgattttgcgaggttatatttcgggtgcgtcgttgcgggttcgtgggttcgtgggttgtagtttttcgtttttgtcgggtggacgagtttcgggttcgcgtggagttgttcggttaaggtcggttcgggaggggcgcggcgtagggcgggtaggggcggggttttaggttaacgtttagttttagatttagtttcgtcgt

SEQ ID NO: 10532 - DNA, 201 bp, synthetic construct
  misc_feature 1..201: note = Description of Artificial Sequence: Synthetic polynucleotide
  source 1..201: mol_type = other DNA
ggagggagaaagggagagagttttagtcgtttcggttgtggtaggaggagttttaagagcgtttttcgagttcgtttcgtatttttaggtttagttcggcgtaggttttttttttcgttttttttattttcgttagttgttgaaatttttttatcgttttttcgcgggtaatagtgttcgttaggcgtcgtcgcgcggtgt

SEQ ID NO: 10533 - DNA, 201 bp, synthetic construct
  misc_feature 1..201: note = Description of Artificial Sequence: Synthetic polynucleotide
  source 1..201: mol_type = other DNA
gtttttaatgcgggcggttttcgtattttacgcggttcggggtttttgtttatttttcgcgggcgggtttcggatttttggggttttttagttttttttcgtttttttttcgcgtcggtttcgtgttttgcggttcggcggtttcggcggcgcgagtcgggggaggcggcgaggggtgttttcgaggttcggcggcgcggt

SEQ ID NO: 10534 - DNA, 201 bp, synthetic construct
  misc_feature 1..201: note = Description of Artificial Sequence: Synthetic polynucleotide
  source 1..201: mol_type = other DNA
ttcgtattttttttgatttttatggatatttagttaatagtaggaataaaaattaagatttttttttttttattcgtttggatatttattttttcggttcgcgtcgtcgtgttttttattcggttatatagcgattttaaaagtttagtttttatttcgcggagatttcgatagttttgggaggttttttttaaaagggaa

SEQ ID NO: 10535 - DNA, 201 bp, synthetic construct
  misc_feature 1..201: note = Description of Artificial Sequence: Synthetic polynucleotide
  source 1..201: mol_type = other DNA
agtcgttcggttgacgtgataagggaggtgtaggttaatacggcgatttcgcgttttttggcggtagtgtcggagtagcggcgttgtttttgatttattcggtattcggttttcgggatcgtttggcggttgtgaatgtagagttggggcgacgtggggttcgttttttgggattgggtgtgagtttgcgtagtgagttat

SEQ ID NO: 10536 - DNA, 201 bp, synthetic construct
  misc_feature 1..201: note = Description of Artificial Sequence: Synthetic polynucleotide
  source 1..201: mol_type = other DNA
aattgaacgtttgaaacgaaggtggcgcggtttggataaatttgatttttcgatatttttcgtttttgcgttcgttttcgttaagcggggaggagcgatcgttataatggattttttcgtaggttttgtgcgcgttgggaatttagttgtcgtcgtttcgtagagttttttgttttcggagggcgtttattttcgggtcgt

SEQ ID NO: 10537 - DNA, 201 bp, synthetic construct
  misc_feature 1..201: note = Description of Artificial Sequence: Synthetic polynucleotide
  source 1..201: mol_type = other DNA
gtttcgggcgtttgttgtttcgtgtttttatcgacgattttatttagttgcgttacgcgtcgtttcggttgtcggtcgcgcgttttgttcgtcggttttcgttcgtaatcggcggtttagggcggattcgggtttttgcgttttcgcgagaagcgcggcgttgcggggtcgtgggcgtttgagttcgcgcggttttcgagg

SEQ ID NO: 10538 - DNA, 294 bp, synthetic construct
  misc_feature 1..294: note = Description of Artificial Sequence: Synthetic polynucleotide
  source 1..294: mol_type = other DNA
ttcgtcgtttatgtttttattgtaaggtcgtagttttcgtcgtcgatttcgatttttcgtttcgtttagtcgcggtttcgttcggcgtttttttttcggtggaagtttaagtttaattaattgagttcgaggcgggagggaagggttttgcgcgtcgtggttcgtttcgtttttttttcgcgttttttttttcgttttgggtggtatttttttcgtcggtatttataataagtcgttgattaatgaggtcggggtcgttttatttcgttcggtcgggtcggggttttcgcggga

SEQ ID NO: 10539 - DNA, 201 bp, synthetic construct
  misc_feature 1..201: note = Description of Artificial Sequence: Synthetic polynucleotide
  source 1..201: mol_type = other DNA
taagtttatagaagagtaaatttttatttttcgaggttgttgtggaagttatcggggttgggatagtagagaggaatttagacgggaatatcgttttttcgttagattttcggcggtttttttttttttttttaaatttatttttaaagttaagtgtaggttttttcgttttagttagaagcgttgcgtgagtttttatac

SEQ ID NO: 10540 - DNA, 201 bp, synthetic construct
  misc_feature 1..201: note = Description of Artificial Sequence: Synthetic polynucleotide
  source 1..201: mol_type = other DNA
gaggtttacgttttttagatcgttatagtcgttgttatagggtttgagtttgggcggcgtttcgtttcggtcgtacggtgcgtcggcgttaatttttttcgaaggtttcggtagttaagattgtaggtttttattaagtattgttttcgaattgggttacgagagcgtgtttttgattggtttgttttggaggttgggaag

SEQ ID NO: 10541 - DNA, 201 bp, synthetic construct
  misc_feature 1..201: note = Description of Artificial Sequence: Synthetic polynucleotide
  source 1..201: mol_type = other DNA
tttttcgcgcgtcgttttttttcgtcgtcggtcgcgtgcgttttcgttttttttttcgcggcgggagtattttcgttcgttatttggggattcgcgtcgcgtttttcgttttcgttcgttcggcgtttatttttcgcgttttttgttcgttggggttataattgttttttatttttcggaggggttattttgggggtggtt

SEQ ID NO: 10542 - DNA, 201 bp, synthetic construct
  misc_feature 1..201: note = Description of Artificial Sequence: Synthetic polynucleotide
  source 1..201: mol_type = other DNA
gcggtttcggtgagcggggcgaggggcgggtgggtagcggcgtcgggggaggtcgaggaggcgaatggtggtgtcggggcggcgggtatcgggcgaggtcgcggttagttttttcgggtcggagttgggtatcgcggggacggggagtgtcgggggtaggtgaggttagggtaggagtttacgcggtgggtgcgaaggttt

SEQ ID NO: 10543 - DNA, 201 bp, synthetic construct
  misc_feature 1..201: note = Description of Artificial Sequence: Synthetic polynucleotide
  source 1..201: mol_type = other DNA
ggaggcgttgcgttaggcggaggaggagcgtaaggttaagtacgttaagatggaggcggagcgcgaggtcgtgcgttagggtattcgagataaggtgcgcgtcgggtcggtttcgtttgcgggaaggcggttttgagtttagcggggatttagatttcgtttgggtggaaggggttgttcggaagaggggcgggcgttttt

SEQ ID NO: 10544 - DNA, 201 bp, synthetic construct
  misc_feature 1..201: note = Description of Artificial Sequence: Synthetic polynucleotide
  source 1..201: mol_type = other DNA
aaagagaaaagaaatagataaaattagggtagggggtaaaaaagtttttcgcgtttttcggaatttagcggtcgcggtcgcggttatcgtcgtcgtcgtcgggggtgggtttcggaagagtttgtttagtagggaaggggaggacgggttaggagcgaaattttgtaggcgaggaagggatagacgcgtaaagaaaaagtg

SEQ ID NO: 10545 - DNA, 201 bp, synthetic construct
  misc_feature 1..201: note = Description of Artificial Sequence: Synthetic polynucleotide
  source 1..201: mol_type = other DNA
cgcgggcgtagcggcggtcgggtacgaggtcgggttgatattattatttgttggggcgcgggaagaacggtagttgttttgcgttgtttcggcgagggacgtttggaaaaggttgaagttttgggcgtttttaagttcgttatttacggggttttcgttattttagtttgttcgtcgtcggtcgttttttgtgattttttg

SEQ ID NO: 10546 - DNA, 201 bp, synthetic construct
  misc_feature 1..201: note = Description of Artificial Sequence: Synthetic polynucleotide
  source 1..201: mol_type = other DNA
ttttttagggatggttttgtgtttgggttttttttttttttaaatttcggggtggtttttgttttattagattgaatcggttttaaggagaaaagttgacgattattttgttttagttttcgggaagttttgttttataaagaataagagtttttggttttgtgaaatgagttataggttgttttgattatgtttatttgg

SEQ ID NO: 10547 - DNA, 201 bp, synthetic construct
  misc_feature 1..201: note = Description of Artificial Sequence: Synthetic polynucleotide
  source 1..201: mol_type = other DNA
ttttaaatttcgatcgtcggtttggcgcgcggttgcgtttatcggtttcgcgttgttgtcgtcgttatcgttatttcgtcgtcgtttcggttcgcgggtcgtttaggttagtattcgggtcggtttgttttcgtcggtcgttcgggtgttcgtcgtcgcgtcgcgtttcggtcgggcgtggatggagggcgtcgcgcgttt

SEQ ID NO: 10548 - DNA, 201 bp, synthetic construct
  misc_feature 1..201: note = Description of Artificial Sequence: Synthetic polynucleotide
  source 1..201: mol_type = other DNA
cggtcggatttttttttagattgtttgcggtttgaaggggttaggttcgcgtaaggttttaggttgtttgggcgtcgggtcgtattgttaggagttgttcgggagtggttttttaggaatattaggtattgattatatattaggggttgggaaattaggtggtttgtattaaggcggtttcggggatttgtttgtggtaag

SEQ ID NO: 10549 - DNA, 463 bp, synthetic construct
  misc_feature 1..463: note = Description of Artificial Sequence: Synthetic polynucleotide
  source 1..463: mol_type = other DNA
agcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgt

SEQ ID NO: 10550 - DNA, 201 bp, synthetic construct
  misc_feature 1..201: note = Description of Artificial Sequence: Synthetic polynucleotide
  source 1..201: mol_type = other DNA
ggggacgttagtggattggagtcgcggagtttcgagggaaaaattttgtaggcgtcgcggtcgggattcggttacggttttagtttattttagtaggtgcgggaggaagaggtagcgtcggagtttcgaggttagagagtttcggcggcggcggtcgtttttttttttcgagttggtttgaagtcgttgggtattttcggt

SEQ ID NO: 10551 - DNA, 201 bp, synthetic construct
  misc_feature 1..201: note = Description of Artificial Sequence: Synthetic polynucleotide
  source 1..201: mol_type = other DNA
agggttgggaggatttgtagtttttttgttggttttttttttttaggaagtcggttagtttggagtcggttgtttatttcgatttatttttcgtttgggcggagtaggaatgtggaagttggttcgaaaggattgtgtttttttttcgttaaatatttttttttcgcgttttttattaagttttggtcggggttgtggagc

SEQ ID NO: 10552 - DNA, 201 bp, synthetic construct
  misc_feature 1..201: note = Description of Artificial Sequence: Synthetic polynucleotide
  source 1..201: mol_type = other DNA
agggcggagttttcggggtagaggcgtttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttt

SEQ ID NO: 10553 - DNA, 201 bp, synthetic construct
  misc_feature 1..201: note = Description of Artificial Sequence: Synthetic polynucleotide
  source 1..201: mol_type = other DNA
cggaggaggttgcggggggtttcggtttaggcgaaggaagggtaagaggttgttcgatcgggggcggcgtcgggaggtgggtgggtttaatatttaggtcgggggaggggtttaagagatatcgggaagggtagtcgagttttaggggcgggtggggtggtagttgtgtgtagtaggggatagggttgggtttttggaagt

SEQ ID NO: 10554 - DNA, 201 bp, synthetic construct
  misc_feature 1..201: note = Description of Artificial Sequence: Synthetic polynucleotide
  source 1..201: mol_type = other DNA
tagtcgatatgacgcgcggcgtagttaatgggaggcggagttggcgttttttggtcgggggggggtcggaggggtgggtttcgcgttttcggtgtttgtcgtgtttattgaatggagagagcgagcgtcggttagtttattcggtcgtttcgtgttttagtcgtagtcgtcgcgttttttagtttagttttaagtcggatt

SEQ ID NO: 10555 - DNA, 201 bp, synthetic construct
  misc_feature 1..201: note = Description of Artificial Sequence: Synthetic polynucleotide
  source 1..201: mol_type = other DNA
ttttttttaagtttttttttggggattgatattttattagtatagagattaataatgttagataagagatttttgattttatatttggggttttcggaacgatgtttgggagagaaaatatgacgttttttgtagaggcgaattttagttcgggaggagggaggtcgttgggatgtgtcgtcggcggtttttgggttcggt

SEQ ID NO: 10556 - DNA, 201 bp, synthetic construct
  misc_feature 1..201: note = Description of Artificial Sequence: Synthetic polynucleotide
  source 1..201: mol_type = other DNA
agattggattcgaattcggtttattttattcgagcggcgacgttagcgttgattttaggcgtgtttcggttttcggcgcggtttcggtttaatcgtgtacgttcgcggaaggtttcgtattcgcgttagaagtggtttgttcggggttatcggttcgtaagttttcggtgttttcgaggtttttgtttcgtttcgcgcggt

SEQ ID NO: 10557 - DNA, 201 bp, synthetic construct
  misc_feature 1..201: note = Description of Artificial Sequence: Synthetic polynucleotide
  source 1..201: mol_type = other DNA
ggggttggggagggttgtcggcggcgcggcggggtcggcgggaggcgggaggttgcgcgcggcgcgggagcgtgcgtcggggttagtaggggcggggttcgcgcggtcgtcgggattggaggcgcgggggtagcgggtagggtattttgagggtatattttcggttatttggcgggagatttagttttgtcgcgcgtcgtt

SEQ ID NO: 10558 - DNA, 201 bp, synthetic construct
  misc_feature 1..201: note = Description of Artificial Sequence: Synthetic polynucleotide
  source 1..201: mol_type = other DNA
gtttcggtcgtcgggcgcgtagtcgtttttttcgcgttttgttcgtttttatggtattttttaggaacgggaagggggtgggagtcgagtcggcggtcgcgtcgcgtcgaatgtgtgttttttttttcggttgtttacggcggtcgaggcgtattgtattttgttggcgtcgaagggtgttttggaatagtagagggagga

SEQ ID NO: 10559 - DNA, 201 bp, synthetic construct
  misc_feature 1..201: note = Description of Artificial Sequence: Synthetic polynucleotide
  source 1..201: mol_type = other DNA
tttagtgttgttcgggcgttttttcgtagtagttttagggcgaggaggatggggggggttttcgtaggggttatattgtcggagttttacggattcgggcgggacggtgaggtttttatattgagtcggtggtaaagttttcgcgaggatgaaggaggaatttcgtgttttttattttattaggtttcgtattttttggtt

SEQ ID NO: 10560 - DNA, 258 bp, synthetic construct
  misc_feature 1..258: note = Description of Artificial Sequence: Synthetic polynucleotide
  source 1..258: mol_type = other DNA
ttttttgggataagaagtggagtggggcggttaggacgcgggtcgtggggatcgcgagggaggagggggcggtcgttcggatttatttcgtggggttttcgcgcgcgggcgtttcggcgtgtcggattatgtcgtcggtagtttcgggacggggaacggaggcgtttaggcgtcgggtcgcgcggaacgcggagtttcgggcgttcgtatgtttttggttttggttttttggaagggttaggtcgtcgttgtcgtcgc

SEQ ID NO: 10561 - DNA, 201 bp, synthetic construct
  misc_feature 1..201: note = Description of Artificial Sequence: Synthetic polynucleotide
  source 1..201: mol_type = other DNA
ttcggtcgttacgtttttttcgagggtcgtttcgttttcgtcgggtttcgcgagcgcgcggtgggggaggggagggtttcggagcgcgtttgcgtggggcgggggcggtagtcgattaggggttgggtttggtcgtttagggtcgggttttggttcgtcgtttacggtgcggagggttggtgggttttttttggtcgtcgg

SEQ ID NO: 10562 - DNA, 201 bp, synthetic construct
  misc_feature 1..201: note = Description of Artificial Sequence: Synthetic polynucleotide
  source 1..201: mol_type = other DNA
tagtagttttttagagttttggtttggtagggaggggacggcgttcgagtagttatattgtagtttttcgggtttttttttcggtcggcgtaggtttcgcgtttacgattttttttgggagtcggatttgttttttttatcgtcgttattcgtcggtttttgcgttttttggttttcgatatttcgtttggtcgttttttt

SEQ ID NO: 10563 - DNA, 201 bp, synthetic construct
  misc_feature 1..201: note = Description of Artificial Sequence: Synthetic polynucleotide
  source 1..201: mol_type = other DNA
ttttcgcgttatttcgggttcgttttcgttcggttttttcggagcggtcgcgtttttagtcggggagtttaggggttttggttcgcggagtcgggcgcgcggggggcggttggggtcgtagtagggggaggttcggcgttcgtagtcgtcggcgcggggtttatcgggcgtgtgggtttatttcggtcggggcgcgacggg

SEQ ID NO: 10564 - DNA, 201 bp, synthetic construct
  misc_feature 1..201: note = Description of Artificial Sequence: Synthetic polynucleotide
  source 1..201: mol_type = other DNA
gggtttttagtacgcgttttagcgtcggagtagggttagggtttttttgcgattcggtttcgttttagatttttttagttttcggtcgcggattcgggtcgcgtgtgagcgttttttgtattttttatttttagggttcgtcgagagttacgattttttatagaaaatgagcgataaagagattttgtattgttttgattg

SEQ ID NO: 10565 - DNA, 201 bp, synthetic construct
  misc_feature 1..201: note = Description of Artificial Sequence: Synthetic polynucleotide
  source 1..201: mol_type = other DNA
tcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggta

SEQ ID NO: 10566 - DNA, 201 bp, synthetic construct
  misc_feature 1..201: note = Description of Artificial Sequence: Synthetic polynucleotide
  source 1..201: mol_type = other DNA
ttcgttttattttttgtttgttttcggttgttagagatttaggtgtagagagattttagaggtggcgttcggggttttggcgttttttttgcggacgttcgttgtagagtaggaagtcgtcgtttcggggcggaggggcgagtcgggttagggggtcggggtggagaggtttgtagggtttgcgcgttttttttattcgcg

SEQ ID NO: 10567 - DNA, 201 bp, synthetic construct
  misc_feature 1..201: note = Description of Artificial Sequence: Synthetic polynucleotide
  source 1..201: mol_type = other DNA
agtattaggttcggtttttcgtatatcgtttcgaatttcgggggtacgggcgcgggtttttcgggtttttcgggggacgcggggtttttaagttaaacgcgcggttcgggggacggcgtcgcgggttttttcgggtacgcgcgttttttaggggacgcgagttttttcggggacgcggcgttcgcgttgtcggttttttat

SEQ ID NO: 10568 - DNA, 201 bp, synthetic construct
  misc_feature 1..201: note = Description of Artificial Sequence: Synthetic polynucleotide
  source 1..201: mol_type = other DNA
ttttcggtcgaggaggggtcgcgtggcgtcgcggggggcgggtcgcgtacgtttttcgtagggaggatttagggatagttagggtttcgggagagttcgcgcgtatcgttcggtttcgcggcgttagttatggcgttcgtgcgtggtttcgttagggatggggcgacgcggttagagtcgtacgcgatcgaaattcgtatt

SEQ ID NO: 10569 - DNA, 201 bp, synthetic construct
  misc_feature 1..201: note = Description of Artificial Sequence: Synthetic polynucleotide
  source 1..201: mol_type = other DNA
gttagaaaggatcgagaaaaattttaaagttttaagtttgagttagggagggttttagagggaggtttgattgtagatcgggagtttttttttttcgtgcgtcgttgttcgggacgagaaattcgtggggtatttaggattaggatacgaggttttagtttgggtaggtggataagttgtggggttttatttttcgtaggc

SEQ ID NO: 10570 - DNA, 201 bp, synthetic construct
  misc_feature 1..201: note = Description of Artificial Sequence: Synthetic polynucleotide
  source 1..201: mol_type = other DNA
gtcgttgagtacgcgttttaggtaggttttgggaagttcgggatggaagtagttttttttttttcgtttttttttttttttttttttttttttttttttcgcgtttttttttttttttttgttttttttggacgtgggttgtcggttgtagttcggagggacggggcgcgggacggagtttttcgcgggaggaggggtcgg

SEQ ID NO: 10571 - DNA, 203 bp, synthetic construct
  misc_feature 1..203: note = Description of Artificial Sequence: Synthetic polynucleotide
  source 1..203: mol_type = other DNA
gtaggagcggttcgtgttcgcgggcgggagcgtgcggtttggattgtttcgtcggataggtattgttttttcgttttttcgggttcgaggcgggtcgcgcgcgtcggtcgtcgttcgggcgtttcgcggtgggcgagatgcgtcgcgttcgttttatgtttgtcgttcgcgcgttttttgttttttatttcgtagtcgttcgt

SEQ ID NO: 10572 - DNA, 201 bp, synthetic construct
  misc_feature 1..201: note = Description of Artificial Sequence: Synthetic polynucleotide
  source 1..201: mol_type = other DNA
tttttcgtagagggtaggatatttattttttcgtgtatttgtttttttttcggtttttcgtttttagtagtattttaggatttaggggtgttatcgggtcggggagggaggggttgagtttgggtttggggatatcgggatagggggaggggttggcgttttcgtttggtcgggatttcgtggtttagcgcggttttacga

SEQ ID NO: 10573 - DNA, 201 bp, synthetic construct
  misc_feature 1..201: note = Description of Artificial Sequence: Synthetic polynucleotide
  source 1..201: mol_type = other DNA
agcgtttgtttaatttgtagtgatatcgtttagttgtttagggttttagttgttatagttaattagttcgcggtcggggaggagcgtcgggtaggggggcgggggggtatgaaggggtcggcgggggaggttgtgggggttgtaggaggggtaggcgtaggaggaggtttgtggtttttaggttcggttcgtttttttagg

SEQ ID NO: 10574 - DNA, 201 bp, synthetic construct
  misc_feature 1..201: note = Description of Artificial Sequence: Synthetic polynucleotide
  source 1..201: mol_type = other DNA
gggcgtattgggcgaaggcgacgcgcggttcgtgggtgtagcgttgggcgttttgaggaggtttttgttgcggtttcgggcgtttgtgcggtttttgagcgcggagttgggatcgcgttttttttcgttattggacgacgtgagtaaacgtttcgttttcgggtttcgtttttgtcgttgttatcgttttcgtttttttag

SEQ ID NO: 10575 - DNA, 201 bp, synthetic construct
  misc_feature 1..201: note = Description of Artificial Sequence: Synthetic polynucleotide
  source 1..201: mol_type = other DNA
taggtagaggggggcgggagggggtgtgagggagaggaggagtcggagtcgtcgttgcggtttttttcggggaggggagaggagaatttttttttttttcgtttttttttagtttttcgttggttcgggagggggtggggcgtcgaggtcgcggcgattcggtagggtttggtcggtgaagagtaggcgggcggggtgcgg

SEQ ID NO: 10576 - DNA, 201 bp, synthetic construct
  misc_feature 1..201: note = Description of Artificial Sequence: Synthetic polynucleotide
  source 1..201: mol_type = other DNA
ttaattttgcgttttttttttagttcgagttttttcgttgtttttttttttttttttttcgagtttttttttttttggcgcggcgtcgttagttagtttcggcggggagagtgtaggtattttgtttttagaataattagtaggatttaagtcggtttttcgagcgcgttttttttttttttttttgtttttttttttcgg

SEQ ID NO: 10577 - DNA, 201 bp, synthetic construct
  misc_feature 1..201: note = Description of Artificial Sequence: Synthetic polynucleotide
  source 1..201: mol_type = other DNA
cgcggacggcgttcgatagtagttggaggagcggtttgtcgatttggcggcgagttatttggaggttattcgtgcgcgggacgagtgggatcggtagaacgcgcggttgcgttaggagaacgttcggttgcggttcgagaatcggcggttgaagcgcgagaatcgtagtttttttcgttaggttttgcggtttttcggcga

SEQ ID NO: 10578 - DNA, 201 bp, synthetic construct
  misc_feature 1..201: note = Description of Artificial Sequence: Synthetic polynucleotide
  source 1..201: mol_type = other DNA
ttcgttttttcgttttagttcgcgtatttatcgcgtacgtagagtagtgatatggtcgaggatcgggtaagtttttgtcgcgttttagtcgcgtcggatcgttttttttttttttttagtaggtgtcgcgattgttttcgttatcggttttacgggtttggtagttttttatggtttcggtcgtaggtagcgtttcgtcgt

SEQ ID NO: 10579 - DNA, 201 bp, synthetic construct
  misc_feature 1..201: note = Description of Artificial Sequence: Synthetic polynucleotide
  source 1..201: mol_type = other DNA
tggttattgttgcgtaggcgtagttttgggagcggcgggagttggaagtttaggagttttagggggcgtagggtcgggtagaaggcggcgagttgggggcggatatttatcggggattggaagcggttcgcgtaggttggggatattcggggttagggcgggtcgtttggggtgggagagtatagtgaggaagtttgacgt

SEQ ID NO: 10580 - DNA, 201 bp, synthetic construct
  misc_feature 1..201: note = Description of Artificial Sequence: Synthetic polynucleotide
  source 1..201: mol_type = other DNA
ttggggacgtcgtagttcggttcggggagggggcgttaggtcgggagtcgtagcgcgggagggacgagttcgggtcggcggggggaggggagcgggaagcgtttttgttgttggcgatcgggattttttttcggtataggggaaaggcggggaagttattttttatcgggtttgtgtttttgagaggattttttgatggtt

SEQ ID NO: 10581 - DNA, 201 bp, synthetic construct
  misc_feature 1..201: note = Description of Artificial Sequence: Synthetic polynucleotide
  source 1..201: mol_type = other DNA
ggtttttgggaggcgtcgcgtgggggcgcggttcgtggagttcgggcgttagggatcggtcggggtcggcgtacgggtgcgttttgggttcgttcgggtcgtgggagttagggagttagggagttagggatttcggttttcgtacggggtagataggggtagcgcgggcgattcggagcgtttgcgttttcgcggtttttt

SEQ ID NO: 10582 - DNA, 523 bp, synthetic construct
  misc_feature 1..523: note = Description of Artificial Sequence: Synthetic polynucleotide
  source 1..523: mol_type = other DNA
agagtatcgggttttttattgttttagagcgcgtgtgcggttttgggcgcgtatagtgacggtgacggtatttttggttcggtagcgtcgaggtcgtttcgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcgtggtttttcgggggcggtatcgttaggtgagcgtcggtcggggcgaggtcgggtttcgggcggtaggtacggggttaggtggttttgaaatttggcgtag

SEQ ID NO: 10583 - DNA, 201 bp, synthetic construct
  misc_feature 1..201: note = Description of Artificial Sequence: Synthetic polynucleotide
  source 1..201: mol_type = other DNA
cggcggtaggcgggggagggggtgggggtgtaggggcggtttcgcgggtcgcggggggggcgcgcggcgtagcggggtttcgggcggggcgtagcgggtcgcggggtttcgggcgcgtttttcgcgttattttagtgttatggtgcgttcgttgagtcgtcgggtttagagttggggttggcggcggagggatacgggtcg

SEQ ID NO: 10584 - DNA, 201 bp, synthetic construct
  misc_feature 1..201: note = Description of Artificial Sequence: Synthetic polynucleotide
  source 1..201: mol_type = other DNA
cgttttttcgttttttcggtatttgtttattttcgtaattgtttcggtttttaatatttgtatcgtttaatttttttttttttcgttttttgtttttttcgtatttgttcggagttttagtatttgtttcgtttttcgttatttttttttttgttggtttgatggggtgtgggtttaagggagttatatttgggcggaggt

SEQ ID NO: 10585 - DNA, 201 bp, synthetic construct
  misc_feature 1..201: note = Description of Artificial Sequence: Synthetic polynucleotide
  source 1..201: mol_type = other DNA
tttcggtttgacggaatataggcgacgtacgtgaagtttaggttttattttagcgtaggcgggtttttagcgatttatagttgttatatattcggttagcgtcgattttcgaaggcgtattttttatattttatttcgagtatcggttttatcgttagggaaggtttttttggatagtaaggtcggggtttaggatttgcg

SEQ ID NO: 10586 - DNA, 201 bp, synthetic construct
  misc_feature 1..201: note = Description of Artificial Sequence: Synthetic polynucleotide
  source 1..201: mol_type = other DNA
cggtaattttttttatcgttttttgtagtaggcgtcgagtcgtcgttattttgtttttcgttttttttttttttttatcgatatttatatagcgaaaatcggttcggtcggtttgcggtttttattttacgtttgtagttttcgttttttcgttaggttttatttcggcgcggtgttttaggtcggtcgcggagtcgattc

SEQ ID NO: 10587 - DNA, 201 bp, synthetic construct
  misc_feature 1..201: note = Description of Artificial Sequence: Synthetic polynucleotide
  source 1..201: mol_type = other DNA
cgtcggcgggcgggaggtatatacgcgcgtataagcggaaagaaagcgggtttattgcgtggggatgttcgttcgcgtagttgtttcggcggcggcggtcgttgtttgtatcgaggtcgaggcgcggcggtggcggcggcggttgcggattgagtttttttcgtcgggcggtggatgtagggcgcgggaggggcgcgaggg

SEQ ID NO: 10588 - DNA, 201 bp, synthetic construct
  misc_feature 1..201: note = Description of Artificial Sequence: Synthetic polynucleotide
  source 1..201: mol_type = other DNA
tttttcgttagcgtttttcgttcgttcgttttttttcggtttcgtttcgcggggttgttggagaaattaagtttggggttttttttgtcgagtacggggcgagttttagaaggttttgtcgtgatggaaaatttttaggtaaattttttcgggttcgtggtttttaggtcgggaagttttcgttacgtgaagggttttcgt

SEQ ID NO: 10589 - DNA, 201 bp, synthetic construct
  misc_feature 1..201: note = Description of Artificial Sequence: Synthetic polynucleotide
  source 1..201: mol_type = other DNA
tttttatatagaaaatttgtattagttatgtaagttaaaaagttgtgtgaatttaggtgtttcggaaaggggttgtaggatatagtaaaatgttagtagcgtgtcggattttttttttttatttttttttttaaagaatagaggttaggaaaaatattggttgggacgttagaagggttatgtgttaattataattatatt

SEQ ID NO: 10590 - DNA, 301 bp, synthetic construct
  misc_feature 1..301: note = Description of Artificial Sequence: Synthetic polynucleotide
  source 1..301: mol_type = other DNA
gcggatggggttttgattagttgtggatttttgttttagcgtatttatttaatcgtgttttttttggttggtagagggcgttaaaggcgacgtgtcggtcgttagttttaggtcgagtttcgagcgtttgtaggaatacgtttttttattcggcgcgggacgtagagttgcgagagaattttgtttagcgcggatttaacgttagggcgtcgtttagaggttggtttttgtttcggttttattcgtcgggagattatagagttgtttttttagtcgttcgtcgttagaaattggaaaaaaa

SEQ ID NO: 10591 - DNA, 223 bp, synthetic construct
  misc_feature 1..223: note = Description of Artificial Sequence: Synthetic polynucleotide
  source 1..223: mol_type = other DNA
ttagagttgtacgtagatgaatacgaagagtagcgcgtagaatacggtgtagacgacggtgaggttaagttttacgtaggggggtacggtcggggttagcgtgggcggtagcgagtcgttgcgggttgggttttacggcggggtttttatcgggtcgggggcgttgtcgcgcggtcggggacgttcgggttttatcggggtttacggtcgtcgtcgttttcgc

SEQ ID NO: 10592 - DNA, 720 bp, synthetic construct
  misc_feature 1..720: note = Description of Artificial Sequence: Synthetic polynucleotide
  source 1..720: mol_type = other DNA
tagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgtt

SEQ ID NO: 10593 - DNA, 1683 bp, synthetic construct
  misc_feature 1..1683: note = Description of Artificial Sequence: Synthetic polynucleotide
  source 1..1683: mol_type = other DNA
atcgagggagggtgtaaaaggcggggggcggagggggggtagattagattaggcgaaatttaataagtttttagttttttagtttaaagtttttattatcgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcggtttagtggtttttgcgcgtcggagttcgtcgcgaagattgagcggtcgcggggatcgtcgcgggtttcgcgcgtatttttgggtttaatattgttatta

SEQ ID NO: 10594 - DNA, 233 bp, synthetic construct
  misc_feature 1..233: note = Description of Artificial Sequence: Synthetic polynucleotide
  source 1..233: mol_type = other DNA
aaataaaaagattaaaggagtagcggtcggggcggtagcggtttttaggtcgggatattcggggtggtgcgttcgggtttgcgggggttgcgtcggcgtcggggaggcggggggagcgggagcgggcgacgcggggaaggggggagttagggggagggcgtcggtcggaggaggggcggattcgttcgttttagtcgagtagagtatagtcgagtcgagcggttcgggcgggg

SEQ ID NO: 10595 - DNA, 213 bp, synthetic construct
  misc_feature 1..213: note = Description of Artificial Sequence: Synthetic polynucleotide
  source 1..213: mol_type = other DNA
tttttttttaaagtaaatagtatttttttattattttgtagttgggttttttttattggttttcgttttttcggtggagacggcgacgtggtttatacgcgagtttttcgtcgaggatgaattattagttagttcgagttgttatattttattttagtatagttatcgcgagagtttcggggtcgcgtcggcgtgttttacgtacgcgtagtt

SEQ ID NO: 10596 - DNA, 236 bp, synthetic construct
  misc_feature 1..236: note = Description of Artificial Sequence: Synthetic polynucleotide
  source 1..236: mol_type = other DNA
cgcgttgagttttattttgcggcggtcggacgtttcggcgtagggggcggcgcggcgggcgcggtgttgggtatcgataacgtgtgcgagttggcggcgcggttgttttttagtatcgtggagtgggcgcgttacgcgtttttttttttcgagttgtcggtggtcgattaggtggcgttgttgcgtttgagttggagcgagtttttcgtgttgaacgcggcgtaggcggcgttgtt

SEQ ID NO: 10597 - DNA, 233 bp, synthetic construct
  misc_feature 1..233: note = Description of Artificial Sequence: Synthetic polynucleotide
  source 1..233: mol_type = other DNA
ttagttgtggatttttaatatttgtaggttataggattagaggttgggtttttaggagtagaggatatagagtagtgaagacgagattcggagttttagcggtagttaaagataaagaagcggataaatttcgttatatttcggaagtcgtttttttcgtttaagttgcgtgtttgattggatagtttttagtttagcgtcgttgattggataacgtttaaaattttattttt

SEQ ID NO: 10598 - DNA, 737 bp, synthetic construct
  misc_feature 1..737: note = Description of Artificial Sequence: Synthetic polynucleotide
  source 1..737: mol_type = other DNA
ttcgttcgatttaggtttcgagtttttttttcgattttttttagtttaaaggttgtattcgttttaggtttttttagttcggttttttagtttttttttcggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcgttgtcgggcgaggtcggtttacgtggagtcgggagtttgaggtttttgtacgcgggagttgcggacgatggtggttagtgttattgtttacgacgttatt

SEQ ID NO: 10599 - DNA, 308 bp, synthetic construct
  misc_feature 1..308: note = Description of Artificial Sequence: Synthetic polynucleotide
  source 1..308: mol_type = other DNA
atagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtgga

SEQ ID NO: 10600 - DNA, 1100 bp, synthetic construct
  misc_feature 1..1100: note = Description of Artificial Sequence: Synthetic polynucleotide
  source 1..1100: mol_type = other DNA
tgatgcgtttggtgattttttttgggtttttgtttaagcggagttataggttgtgggggcggttaggtttttggggaagagtaggtgtcgcggtgtcggcgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcgtttcgcgatttgttcggttgttcgcgttgtcggcggttgttgtataagtcggtgacgttgttttgcgggtttatagtttgtaagcgttgcgtggagttag

SEQ ID NO: 10601 - DNA, 214 bp, synthetic construct
  misc_feature 1..214: note = Description of Artificial Sequence: Synthetic polynucleotide
  source 1..214: mol_type = other DNA
gaagaaataatatattgtagattgtaacgagtacggggagttagcgaaaggtagggcgtttattagggcgcgttgagagatcgggaattttcgtaagggcgttcgcgtcgttcgttattcgtcgtcgcgcgtacgtcgcgttttcgtttatttttaaataatatttatagttagggtttttttttttttttttttttttttttttgttttcgtt

SEQ ID NO: 10602 - DNA, 582 bp, synthetic construct
  misc_feature 1..582: note = Description of Artificial Sequence: Synthetic polynucleotide
  source 1..582: mol_type = other DNA
agtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagag

SEQ ID NO: 10603 - DNA, 203 bp, synthetic construct
  misc_feature 1..203: note = Description of Artificial Sequence: Synthetic polynucleotide
  source 1..203: mol_type = other DNA
tttttaggaggcgttttgatttcgtatttcggttttttatttttcgatcgttagttttagggtcgtcgcggcgacgcgcgattttttttttttgaggggcgcgggtttcggacgcgtcgggttttgttaggtatttagtggagggtcggaggtcggcgattagttcgagtttagtcgtttcgggagttggcgcgagtgtcgtt

SEQ ID NO: 10604 - DNA, 823 bp, synthetic construct
  misc_feature 1..823: note = Description of Artificial Sequence: Synthetic polynucleotide
  source 1..823: mol_type = other DNA
taattatttgttttagatcgcgttatttgtaatttgtttcgggttggcgttatattcggcgtttcggcgttttttataagtgttttcgtttatgattagcgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcgttggttgcgggttttgggggttttttgtttttttcgggtttcgttttttcgtatttttttggtttgattatgatttttgaaggagaatacggataattcg

SEQ ID NO: 10605 - DNA, 293 bp, synthetic construct
  misc_feature 1..293: note = Description of Artificial Sequence: Synthetic polynucleotide
  source 1..293: mol_type = other DNA
ttttgtttttaagggagagggatagtattttttcgggtttttagtttttttgggtgtggcgggagagttttgggcgaggttgcgtttatatttgtatttcggtcggttttttcggttgatttcgttttggttgatttcgcgtatattttttttttagcgttgtaaggatcgtttgaattcgttggttatttcggtgatgaattagtggttcggtgtgaagttgcgggtgatcgagggttgggacgaggacggttattatttagaggagtttttgtattatgagggtcgcgcgg

SEQ ID NO: 10606 - DNA, 262 bp, synthetic construct
  misc_feature 1..262: note = Description of Artificial Sequence: Synthetic polynucleotide
  source 1..262: mol_type = other DNA
gcggggtatgttggcgcggttcgagggtacggtattggttcggtttttttttcgcgttcggtttcggcggtttttagtgttttcggtttattgttcgggcgcggcggttgcgggattcgcgtggcgtcggcgacggttcggtttagttttgcgttttgtacgcgcgtttttgttttcgggttcggtagtcgtttttttttaacggggggagggggttattgttttcgtttttcgttttttttggagttaattagcgcgttcg

SEQ ID NO: 10607 - DNA, 240 bp, synthetic construct
  misc_feature 1..240: note = Description of Artificial Sequence: Synthetic polynucleotide
  source 1..240: mol_type = other DNA
gttttttttttattgttttttcgttattagtcgtttttgtcgtcgagttcgtagtcgttagcgcgtttcgagtttttttaggttagaggttttcgtaggcgatggcggataagagggcggggattttagaagtcgcggcgcgttcgtcgttcggttttgttcgggagggggacgcgcgtacggttttcgcggttcgggttcgagaagttggggggcgcgggtttttttatttcgtagcgg

SEQ ID NO: 10608 - DNA, 1240 bp, synthetic construct
  misc_feature 1..1240: note = Description of Artificial Sequence: Synthetic polynucleotide
  source 1..1240: mol_type = other DNA
ggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgtt

SEQ ID NO: 10609 - DNA, 222 bp, synthetic construct
  misc_feature 1..222: note = Description of Artificial Sequence: Synthetic polynucleotide
  source 1..222: mol_type = other DNA
aataaaaatttatattatatagcgatggtggtgtttggtggcggtggcggggtggggggtttgattagatgagtcgtttttcgcgttttcggcgtcgggcgttatggttcgagtcgaaggcgtttttggtttcggagcgttcgcggtttttgcgtttggcgcggtcgtttaagtaggagaagaaggcgtagtttaggaatattcggaagtagtaggtcgttt

SEQ ID NO: 10610 - DNA, 714 bp, synthetic construct
  misc_feature 1..714: note = Description of Artificial Sequence: Synthetic polynucleotide
  source 1..714: mol_type = other DNA
tgtgattttttttttttgttttaagtggttggcgatatagttttcggcgcgtcgggtattgaggttttggagtatagcgtggggggtttggtatagatacgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcggttgttttttggagtatttttgttatagtatttttattttgggttagggtattttgttgcggattttgagttttaggaaggaggtttataatagcggaaagttatttttttttaagaattgttgagtttttcggattgtatttttaaagattttttttgaa

SEQ ID NO: 10611 - DNA, 1216 bp, synthetic construct
  misc_feature 1..1216: note = Description of Artificial Sequence: Synthetic polynucleotide
  source 1..1216: mol_type = other DNA
tttattttgaggttttttagatttcgtagggttttttacgttattaagtttgtttcgattttttttcgttgttttttatattttttgtcgcggcgcggtcggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcgggtcggtgtttttgtcgcgggaaggaggattcggacgtttaatttagcggcgaagtcgttttttattggaggaggtttttcgaaaacgtttttgaaattt

SEQ ID NO: 10612 - DNA, 207 bp, synthetic construct
  misc_feature 1..207: note = Description of Artificial Sequence: Synthetic polynucleotide
  source 1..207: mol_type = other DNA
ggtttgtttagtttttatttcggtatcgaagtcgtagttttcgggtttattttcgtatttttaggggttttcgggggttgtcgataggtttttgattagcgagcgcgttttcggggtaagtatttttggcgggtagaaatttgggagcggagtatagcggtgtaagggaatcgtgttaggcgggaagggcggaatttgcggggaatt

SEQ ID NO: 10613 - DNA, 253 bp, synthetic construct
  misc_feature 1..253: note = Description of Artificial Sequence: Synthetic polynucleotide
  source 1..253: mol_type = other DNA
ggttgcgtagcgtttttaatttaatttttggatttattttcgttttagtttttttcgtgtttagcgttttttgtaaatgattttttcggtcgggtgtttcgttttttttttcggtttttttcgcgtggtttgtttttcgttcgtttgcgttcgttcggtttttttgtttttgcgtttttatttgatcgtaaaggcggttagggtagttttcgcgcggtttgatagttacggtttttagtttgtttttggacgt

SEQ ID NO: 10614 - DNA, 209 bp, synthetic construct
  misc_feature 1..209: note = Description of Artificial Sequence: Synthetic polynucleotide
  source 1..209: mol_type = other DNA
ggttaggtttgagttttatttatttacgtcgtattttttttttttcgtgggggtttatatggtcgtgtcgggcgcggtttcgcgggcgcggcgatcgggcgataacgcggcggggacggtcgcgggttcggttgtggcgtatcgcgagtcgaggcggggacggttaggcggcgcggggtagtgggcggcgtattttttataggtcgttc

SEQ ID NO: 10615 - DNA, 225 bp, synthetic construct
  misc_feature 1..225: note = Description of Artificial Sequence: Synthetic polynucleotide
  source 1..225: mol_type = other DNA
ttgcgatcggtttttaatttgggtcgagttgcgtagcggggcgggcgcgcggggcggggcgggtcgcgggttttggggagttggtcgggaatcggagttcgcggtcgtttggtcgaatttgttcgcgcggcgtcggggaggagttcggggcggcggcgcggggcgcgcgttcggcgagggcgttttttttagggtcgtttgtagtttgcgggacggggtcgagcg

SEQ ID NO: 10616 - DNA, 1133 bp, synthetic construct
  misc_feature 1..1133: note = Description of Artificial Sequence: Synthetic polynucleotide
  source 1..1133: mol_type = other DNA
ggaggagaagcgacgtaagtgggtagttttttagcgtcggcgaggcgcgggaggaggagaagtagtggggaggcgtagtcgtttatttgcggggtagggcgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcgggcgtcgcggtagttgtttcggttgtcggtcggcggtttcgcgttcgttcgtttcgttttcgttcgttgttttgttgtacgaatttttttaatttttttt

SEQ ID NO: 10617 - DNA, 478 bp, synthetic construct
  misc_feature 1..478: note = Description of Artificial Sequence: Synthetic polynucleotide
  source 1..478: mol_type = other DNA
tgaattgagggggttcggcggtcgttgaggaggggagcgcgcgggaggaggggcgaggagttcggaggcgggcgcggttggtagtttagagggttcgggcggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcgattttggttttttcgtaagtttttcggattcgggcgttttcggtttttttttatttatttttttgtcgggtaggttcgcgatttttcgtttttcgggtcg

SEQ ID NO: 10618 - DNA, 201 bp, synthetic construct
  misc_feature 1..201: note = Description of Artificial Sequence: Synthetic polynucleotide
  source 1..201: mol_type = other DNA
ttaatgtgttttaatacgttttaatgtgttgtgataggaaaagagtcggttaacggtattacggaagtattagttggtatagaggttcggtgtaattatcgttttgtatcgtaaaacgggtttaggaagtttttaggagatattagcggtgttagaatcgagaaagtgacgatatagataatttatggatttcgcgtacgg

SEQ ID NO: 10619 - DNA, 208 bp, synthetic construct
  misc_feature 1..208: note = Description of Artificial Sequence: Synthetic polynucleotide
  source 1..208: mol_type = other DNA
gttttcgtcgtcgttcgggtcgcgttcgtttcgtttttaggcgtcggtttcggagttcggttcgcgagtagcggcggttgtcggagggacgatgagttgcgcggggcgggcgggttttgttcggttcgtcgcgttcgttttgttgatttgtagtttgtggtcggtacgggtagataacgcgagttaggagtattatacggcgtttatt

SEQ ID NO: 10620 - DNA, 210 bp, synthetic construct
  misc_feature 1..210: note = Description of Artificial Sequence: Synthetic polynucleotide
  source 1..210: mol_type = other DNA
ttagtttttcgggaagtagtaggcgtacggtcgtttggatttttttggaggtgatggtcgagcgtttgttgtaatgcgttaggcgggaagtttcgtcggcgatgcgttcgaagatgtcgttgataaaggaatttatgatttttatggttttagaggagatgtcggtgtcggggtggatttgttttagtattttgtatacgtatacggagt

SEQ ID NO: 10621 - DNA, 229 bp, synthetic construct
  misc_feature 1..229: note = Description of Artificial Sequence: Synthetic polynucleotide
  source 1..229: mol_type = other DNA
ttttaagatagggtttttttttcgttcgggttggagtgcggtggtacgattttcggtcgttgtaacgttcgtttttgggtttaagtgatttttttgtttcggttttttgagtagttgagattataagcgttagttattatagttcggttaatttttgtattttttagtagagatagggttttattatattggttattttggttttaaatttttgagtttaggtgagtta

SEQ ID NO: 10622 - DNA, 209 bp, synthetic construct
  misc_feature 1..209: note = Description of Artificial Sequence: Synthetic polynucleotide
  source 1..209: mol_type = other DNA
tttttttttttttttaatatttttttttagaaaaagaggaacgtaacgaagggagtttagttattatgttggagttgtggatcggttttgtgaggtttacgcgggagcgcggaggtttttgggttttagggcgtcggtagatggtttgtagcgtatcgttcggttttcgcgttggttacgttcgttagcgttatttttttttttcgttt

SEQ ID NO: 10623 - DNA, 255 bp, synthetic construct
  misc_feature 1..255: note = Description of Artificial Sequence: Synthetic polynucleotide
  source 1..255: mol_type = other DNA
gttatttcgtagcgagttaaagttattttttattttgggttcgttacgcgatttttgtcggttttcgttttacgcggttttagtacggcgttaaggtttcgtttataaatcggtttcgttttttcgtgttcgggttcgtcgtttattagacgtcgtttcggcgtagcgagttgagggtacgtttatttttttttcgggtttttagtttttaaggttttagtataatgttttaggaggaagattttaggttttttt

SEQ ID NO: 10624 - DNA, 297 bp, synthetic construct
  misc_feature 1..297: note = Description of Artificial Sequence: Synthetic polynucleotide
  source 1..297: mol_type = other DNA
tttattattgttaacgtcgtcgtcgcgttttttttattttatttttttttttttaggagaatttttagtttcggtttttttcgtttcggcgtttcgttacgtgatttcgggtcgttttttatacgtgatcgtttttttttttttttttattttcgtattcgttttttttttagttttttgtttcgttttgttggtcgttaggtatttcggggagaggtcgtttggaggcggggttttaggttttatttttcggagggtggagaggggcgggtaaattacgtcgagtgggcggggttt

SEQ ID NO: 10625 - DNA, 232 bp, synthetic construct
  misc_feature 1..232: note = Description of Artificial Sequence: Synthetic polynucleotide
  source 1..232: mol_type = other DNA
tagtcgttttaagtttttttttttttttttttttttttttttgtttcggaaagttagcgagttttcggtagcggtcgtattttcgtttcggtggtttgacgacggcggcggtcgtttttgcgcgttttttcgttttttttcggtttagtttagacgtcgtagtggcggtaattgcggtagcggtggcggttttgatttcgcgtatttcgttttttttttttagttagtttat

SEQ ID NO: 10626 - DNA, 247 bp, synthetic construct
  misc_feature 1..247: note = Description of Artificial Sequence: Synthetic polynucleotide
  source 1..247: mol_type = other DNA
tttttcgcggttttttttttttcgcgtttttttttttatatcgggttttcggggtagtagcggggaggggagatcggcgggggagggaggatagggaggcgaaggaattggggtggggggtgcgtgtgtggtggagggggtgggacgatataggtgttttgaggggaggagtcgggaggaaggcgaggaggtcgggttaagtgggggtgcggaggtcggggagataggaacgcggttgcgggcgcgg

SEQ ID NO: 10627 - DNA, 292 bp, synthetic construct
  misc_feature 1..292: note = Description of Artificial Sequence: Synthetic polynucleotide
  source 1..292: mol_type = other DNA
gggcgttgaggttgaagttggggtcgggggtgggattgggggcgttggggttgggtcgggggtgggattgaggttgcgggcgtttaattgggattgagtcgagggtagcggtggggttgggtcgggggagtaggggtcgcgtcgggtagcgtcgcgtgttggagcggaggcgggtgcggtcggggtaggtcgcgggaggaggaagcgtttggggagtaggagttgggtcgggcgggttcgcgtttcgtattcgcgggggtgaatcggagtcgtcgtagggggttcggggggt

SEQ ID NO: 10628 - DNA, 201 bp, synthetic construct
  misc_feature 1..201: note = Description of Artificial Sequence: Synthetic polynucleotide
  source 1..201: mol_type = other DNA
tgttgtggggtttagggttgtatggggtagtaaggcgcgggggttcgggtcgtagagttttcggggaggattcggaggggaggtagtggttcggcggttcgggttatagttcggtgtggtgggggggagggagacggggcgggagagggggtaaggttgtttttgaagggaattagttggttcgttcgttggtcgagttgt

SEQ ID NO: 10629 - DNA, 201 bp, synthetic construct
  misc_feature 1..201: note = Description of Artificial Sequence: Synthetic polynucleotide
  source 1..201: mol_type = other DNA
atttttgttttttatatttattttttattttcgttttagaaatacgttttttatatcgggttcgtcggatttttatattttttattcgcgttagaaacgcgcgtattttcgtggtttttttttgtcgcgcgtaaatacgttcggttcgcgtacgttttttcggtttggtttcgtatattcgcgttagaaatacgcgtggtc

SEQ ID NO: 10630 - DNA, 201 bp, synthetic construct
  misc_feature 1..201: note = Description of Artificial Sequence: Synthetic polynucleotide
  source 1..201: mol_type = other DNA
cgacgttcgagttagcggagttcggagtcgttgggtttttcgtttttttcgttcgttcgtttttttcgttttttcggtttttttcgtttcgtcgttttgcgtcgttttattataaaaggtgaggttcggggggagggggcgcgggattttcgtttcgcggaagcggtttttatttgttttttaatttgttcggtcgcgttt

SEQ ID NO: 10631 - DNA, 201 bp, synthetic construct
  misc_feature 1..201: note = Description of Artificial Sequence: Synthetic polynucleotide
  source 1..201: mol_type = other DNA
gttttattaagcggttttagttataacggcgtgtatgttaattacgtttgtaggttatcgttcgttttcggttgtcggattatttagcgcgttttttttcgagtttcggacggggagaggaggagttaggggaggaggcgggaggaagggaaggatggggaggataatgggggaagaagagggaggatggaggaagggggt

SEQ ID NO: 10632 - DNA, 201 bp, synthetic construct
  misc_feature 1..201: note = Description of Artificial Sequence: Synthetic polynucleotide
  source 1..201: mol_type = other DNA
tattatttcgttgtcggcggcgtttttttgggaagtagtagtaattggtggagttggagtcgtagtagtttgagtcgtcgtagtagtttttgtcggagtcgtagtaggaggaggaggaggcgggcgtcggggtgggcgtcggggcgggatacggagcggggttttgggacgattttttggaaaagtttttggcggaaacgg

SEQ ID NO: 10633 - DNA, 201 bp, synthetic construct
  misc_feature 1..201: note = Description of Artificial Sequence: Synthetic polynucleotide
  source 1..201: mol_type = other DNA
gggcggggtcggaggaaaaggggcggggcggcggggaaaatataaattaaaatttaaaaattagttaaaggaaggatggaagtttcgcggttttttcggcgtttagcggtgtttttgttttggtgttcggattttagttcgcggtttgtttgtttgttagtttcgtggatatcgtattgtcgggtagcgtttcggtcgtat

SEQ ID NO: 10634 - DNA, 201 bp, synthetic construct
  misc_feature 1..201: note = Description of Artificial Sequence: Synthetic polynucleotide
  source 1..201: mol_type = other DNA
tagtatgatgtcgtttttttggtagtggtagggggtcgggtaggcggtgggtttcgggtcgggttggggggcgtcgtcggtttttcgggaagcgtatagcgcggcgtaaagttatagcgttcggagtttcggcgggttgggtatttcggcggtcgggttattggggtatttggcggtcgggcgcggacgtacggcgcgatg

SEQ ID NO: 10635 - DNA, 241 bp, synthetic construct
  misc_feature 1..241: note = Description of Artificial Sequence: Synthetic polynucleotide
  source 1..241: mol_type = other DNA
cgaagaaaggggcgcgggggcgcgggggcgcgggggcgcgtggggcgttgggcgtcggaggtttggtaggatgcgcggtggggtcgtcgtcgtcgtcgtcgttgcgcgttcgttttttggtcgggcgcgcgtttcgtttcgtagtatttatagggcgtcgcggtttcgtttttttataggtttcgtttcggttagtttacgtttcgttttcggtttcgttttttgtcgttagggcgcgtag

SEQ ID NO: 10636 - DNA, 201 bp, synthetic construct
  misc_feature 1..201: note = Description of Artificial Sequence: Synthetic polynucleotide
  source 1..201: mol_type = other DNA
gtcgttgtcgttttgtcgttcggtgtgcgagcgcgttaaggtcggttgcgcgtcgtttatgcgttagtacggtttcgtttggttcgatcgtatgcgttgcgatcggttgttcgagtaaggtaattttgatacgttgtgtatggattataatcgtatcgatttaattatcgtcgcgtttagttcgtcgcgtcgtttgtcgtc

SEQ ID NO: 10637 - DNA, 201 bp, synthetic construct
  misc_feature 1..201: note = Description of Artificial Sequence: Synthetic polynucleotide
  source 1..201: mol_type = other DNA
agaggaagtgagaggtgtttaattcggttatgtagaacgtagttgggttgttcgaaacgaaataaagcggttatttcgaaggaggtgttgtttttgggtcggtttaggttgagttagagtagacgttatttttacgttaaaaatattaggttattgttttagggagttgggttatttattgaggttatttttattttattt

SEQ ID NO: 10638 - DNA, 201 bp, synthetic construct
  misc_feature 1..201: note = Description of Artificial Sequence: Synthetic polynucleotide
  source 1..201: mol_type = other DNA
gtatttatttttttgacggtttcgtttcgtagggagggtttgtgtcggttgttggagtttattcgtagatttatttttattattttcgagggttagaggcgcgatttcgcgtattcggcgtttcgtttgttgcgttagtatcgttatttggtgattttgttgttttggaggttcggtttcgtggtgcggagtaggcgcggg

SEQ ID NO: 10639 - DNA, 201 bp, synthetic construct
  misc_feature 1..201: note = Description of Artificial Sequence: Synthetic polynucleotide
  source 1..201: mol_type = other DNA
ggtttttggagttattggtttagggcgggttcgcgggatggggcgggcggttcggggcgtagtcggttaggtcgttgttatggtaacgcggtggaaaaacgggtttttgggtatttcgttgtcggtcggttggtaattttttagcggagggatcgggtcgagttcgcggattttttcgagtgttttttggggtttagtcgt

SEQ ID NO: 10640 - DNA, 201 bp, synthetic construct
  misc_feature 1..201: note = Description of Artificial Sequence: Synthetic polynucleotide
  source 1..201: mol_type = other DNA
ttaaaagtagtttttttgaattttatttgggttttgtagggttttttcgaggttcgagaattgggagaagggaaagagtttatcggtttgtttgaaggtcggcgggcggtgtaggtagttttttttagatttttttagtttcggttttttacgtatattagaagagtcgttttttttttttagtgattgaaattatttgga

SEQ ID NO: 10641 - DNA, 201 bp, synthetic construct
  misc_feature 1..201: note = Description of Artificial Sequence: Synthetic polynucleotide
  source 1..201: mol_type = other DNA
ggttttgttttagggttttgtattttcgagagttgttgtatgtcggggattggtttttaagtttgtttgagtttttttagtttttcgggtatcgttatgcggtgggagggtgagttttttttttttgttgaaatttcggcggtttggtaatcggtcggggggttttggatttttcggggagatattattgatgttttgtgg

SEQ ID NO: 10642 - DNA, 201 bp, synthetic construct
  misc_feature 1..201: note = Description of Artificial Sequence: Synthetic polynucleotide
  source 1..201: mol_type = other DNA
gtgtttttcgttgatttttagaggagatattggttagggttttttttttcgagataaattttattttggaaaggttgttagatcgggcgcggtgatttacgtttgtaattttagtattttgggaggatgaggtgggcggattgtttgagtttaggagttcgaaattattttgggtaatatgttgaaatttcgtttttatta

SEQ ID NO: 10643 - DNA, 201 bp, synthetic construct
  misc_feature 1..201: note = Description of Artificial Sequence: Synthetic polynucleotide
  source 1..201: mol_type = other DNA
gtatatttcggtcgggtgcgggtcggcggggtatagcggtttttacggttcgttttcgttagttatttttcggttttttttttcgttgttcgcgtgtttcgggtcggtttagtatttttcgagttacgtgttcgcgtttttcggcggggaggagcgtagtcgcgggggcgcgtttcggtgatttcgttttttagttttttt

SEQ ID NO: 10644 - DNA, 201 bp, synthetic construct
  misc_feature 1..201: note = Description of Artificial Sequence: Synthetic polynucleotide
  source 1..201: mol_type = other DNA
ttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggatt

SEQ ID NO: 10645 - DNA, 201 bp, synthetic construct
  misc_feature 1..201: note = Description of Artificial Sequence: Synthetic polynucleotide
  source 1..201: mol_type = other DNA
ggggcggagcggggaggggcggggcggagcggggaggggcggggcggagaaggatcgtagggttgagcggggcgttagcgttagtgttcggtattgtttcgggttgggttttttgcgttagaggaaggggagttcggggacggggtacggggttcgcgaggtacgggtgttttttcggggtttcggaagttttttttttcg

SEQ ID NO: 10646 - DNA, 239 bp, synthetic construct
  misc_feature 1..239: note = Description of Artificial Sequence: Synthetic polynucleotide
  source 1..239: mol_type = other DNA
gagaggaagggggaaggagatagaggaatcgagattggggtgagggagcggtcgcgcgtggttttcggagaggcgtttattatttgcgtggcgttttttcgcgtcggagtgcggttttgtttttagcgttagtgcgtcgcgcggttcgtcggtttcgtaggattggttatcgttttttatttatgtaatttgcgtgtgcgtgtgcgtgtgtgtgtgtgtttttttttcgttcgtttttt

SEQ ID NO: 10647 - DNA, 201 bp, synthetic construct
  misc_feature 1..201: note = Description of Artificial Sequence: Synthetic polynucleotide
  source 1..201: mol_type = other DNA
ttttttcgtgggtggttttcgtgagttttttggttagtttttttattttagttttataatggtttatcgtttgtaatattttttttgcggttatagtttcggtggatggaggtaggagggggttacggggtgggggagatggatgcgaagttggcggggaaagggagaaggaaatgggaagggatgggtggaaacggaaaa

SEQ ID NO: 10648 - DNA, 201 bp, synthetic construct
  misc_feature 1..201: note = Description of Artificial Sequence: Synthetic polynucleotide
  source 1..201: mol_type = other DNA
ttatttgaaattgataggtttgttttttatgataatagttgttattaattagttttttttatatttttttatttatcggttttagtattttgtatatttcgcggagaattcgtttttggttttttatagagtatagtattagggtgtagattattatatttatagagttattagttatttggtgtatgtttttttcggtag

SEQ ID NO: 10649 - DNA, 201 bp, synthetic construct
  misc_feature 1..201: note = Description of Artificial Sequence: Synthetic polynucleotide
  source 1..201: mol_type = other DNA
aaaatagtagttttatggaaaataatagaaaaaaattttattttagtttggtaattaacggttggtcgggggacgtgttcgcgttgtttttttttcggtcgttagggggcgtaggaagaagttttggaggtttgtttcgggatcgcgtattcgtttttttttttcgttagttttttttttattttcgttgagtttcgtttc

SEQ ID NO: 10650 - DNA, 201 bp, synthetic construct
  misc_feature 1..201: note = Description of Artificial Sequence: Synthetic polynucleotide
  source 1..201: mol_type = other DNA
gtttgacgaagttttttttgggggtcgatgttttttttcgggtgggaaggggcgttgtcggtgagggttattttggcgtcggtttgcgtcgttcgaagtcgggggggaggggaggttttcgtttagtaggggttacgttcgtttcggacgggggtcgcgcgggcgtttaggcgacgtattttcgtcggggttcgtgatcgt

SEQ ID NO: 10651 - DNA, 201 bp, synthetic construct
  misc_feature 1..201: note = Description of Artificial Sequence: Synthetic polynucleotide
  source 1..201: mol_type = other DNA
ttttgagaagtaatagatttcgattaatgtgtatcgttttcgcggcgtttcgtcgcgttcggaatcgttgtttatttggcgttcggtaaggaaggttgtcggagggtttataggtgtttttttcgttttcggagaagttcggtgtgggcggcgttattttagaaacgttatcggcgcgtttgtttcgagcggcgggggcga

SEQ ID NO: 10652 - DNA, 201 bp, synthetic construct
  misc_feature 1..201: note = Description of Artificial Sequence: Synthetic polynucleotide
  source 1..201: mol_type = other DNA
tttgttatttgtatttaagatggatttttcgttgtcgtcgttgttttttcggtttttttgttattattttttacgttttgtagttttgttttttgtttacgggttgttaagtcgcggtttggtcggtggtggtagtggcggagttagataaagttttcgtttttttcgttttagagttttttaggcgttttaagtggcggg

SEQ ID NO: 10653 - DNA, 201 bp, synthetic construct
  misc_feature 1..201: note = Description of Artificial Sequence: Synthetic polynucleotide
  source 1..201: mol_type = other DNA
ttttagggcggtcgtttttattttcggtttttatttagcggggatttattagggcgagggttgaagatttcgcgggacgtcgcgcgtcggggatagcgacgtatttatttttttagttatttgggaggttgtaggttcgggtcggagttcgaggtttaggggcgcgcggagtagttttggttaaggcgtagggcgcggggt

SEQ ID NO: 10654 - DNA, 201 bp, synthetic construct
  misc_feature 1..201: note = Description of Artificial Sequence: Synthetic polynucleotide
  source 1..201: mol_type = other DNA
ttttggggtcgggcggggcggggcggggtaggggggtcgggcgcggtttacgcgttttttcgagtgcgcggtgcgggacgggcgcggttgacgcgttttcgtcggtgtttgtgttttttcgtaggttaggagggtattttgcgttgttattcggatttggcgggtagcgagttgtagcggggtacgtttacggtcgagtcg

SEQ ID NO: 10655 - DNA, 201 bp, synthetic construct
  misc_feature 1..201: note = Description of Artificial Sequence: Synthetic polynucleotide
  source 1..201: mol_type = other DNA
cgggtttggataggttagtttgagagtatgcgaagtcggttttcgggtagataataagagatatcgtcgggaagtgttaggaatttcgcgcgttgttcgcggggtttttttgtagtcggggttgggttagaaggatggtaaagttgcgcggcgtcgttcgggttggagtcgtagtcgaggagtcgaagtttttttaggtcg

SEQ ID NO: 10656 - DNA, 201 bp, synthetic construct
  misc_feature 1..201: note = Description of Artificial Sequence: Synthetic polynucleotide
  source 1..201: mol_type = other DNA
gattcggagttacgcggggcgggggtcggtatcgagggtcgggaggcgcgaagggtacgcggcggcgggaagcggggcgattcgaaggtttacgggggtcgggaggttgcggggcgttcgggattttttttcgggtggttatcgtgcggtcggggcgcggaagttagaggtgtttagaggcgtcgatttcgtcgaggttgc

SEQ ID NO: 10657 - DNA, 201 bp, synthetic construct
  misc_feature 1..201: note = Description of Artificial Sequence: Synthetic polynucleotide
  source 1..201: mol_type = other DNA
tagtcgaggtagaaattcgtttcgaggcgcgggcgtcgggttcgggttttaaggatgcgcgtcgggttttttttcgcggggatagtcgagtttcgtcggcgttttaggtgttttcgtagtgcgttcgggcgcggacgtttttttgttttcggaggggaagcgggagggtttttggggtaacgtttcgatttcgggtttttt

SEQ ID NO: 10658 - DNA, 201 bp, synthetic construct
  misc_feature 1..201: note = Description of Artificial Sequence: Synthetic polynucleotide
  source 1..201: mol_type = other DNA
tataggtgttttcgtcgtaggtttcgtatatttatttatggtatttatataggggttcgaagaatatgttcggtttagttacgtggtagatgtagacgtcgtagtcgtagcggtttcggtcgtggtatagcgcggttttcgggggttgtttaggtgcgcggtagcgtcgtttcgattcggttcgggatagtttgtaggcgg

SEQ ID NO: 10659 - DNA, 201 bp, synthetic construct
  misc_feature 1..201: note = Description of Artificial Sequence: Synthetic polynucleotide
  source 1..201: mol_type = other DNA
agatcgttgtttggttattttacgtttttgagttttttatatagttagtttcgtgattttcgagtttcgtgattttcgagtttcgtgatttttaagtttcggaagtcgttgtaggtagcggtttagttaggtttcgttttttttatcggagttttacgcgttaattttagttaggtttcgttttcggtcgttttaggcgtg

SEQ ID NO: 10660 - DNA, 201 bp, synthetic construct
  misc_feature 1..201: note = Description of Artificial Sequence: Synthetic polynucleotide
  source 1..201: mol_type = other DNA
gtagtagtttatcgaggacggggattcgtaagtggcggaggttcggggttgggggtcgtcgggagggcgggacgcgcgcggtttgggggtgggaggcgtcgggtttggagttcgagtcgggggattagcgatgtagtcgggcgggcgtcgcggtatttcggggtttttgtatcgtttcgaacgttgtagggttgtagggtc

SEQ ID NO: 10661 - DNA, 201 bp, synthetic construct
  misc_feature 1..201: note = Description of Artificial Sequence: Synthetic polynucleotide
  source 1..201: mol_type = other DNA
attttgtaggtcgtatttttaattcgtattttatttaggttttcgtttggcgtcgatttgttttagtttaattttcggtttcgtagattaggtatttttcgggacgcggggtagattttgcgttcgggttttttttcgtagtcgggttgttcggtttttgcgcgcgtataataggcggtacggcgtagttttcgggagcgc

SEQ ID NO: 10662 - DNA, 201 bp, synthetic construct
  misc_feature 1..201: note = Description of Artificial Sequence: Synthetic polynucleotide
  source 1..201: mol_type = other DNA
aggatggcgatggtattggcgcggattttttttatggtgggtagacgggcgttttaggtgggggattgggtcggcgtgttttcggggtcggggcgggggcgttcgtagttttagttgtttgttttcgttcgcgtttagttgtttagttttgtagagtagaaaaaggagagaggtgggggggcgggggggtgatagggagag

SEQ ID NO: 10663 - DNA, 201 bp, synthetic construct
  misc_feature 1..201: note = Description of Artificial Sequence: Synthetic polynucleotide
  source 1..201: mol_type = other DNA
ttagttttttttgagggagtttagcggtgcgggttcgtttttttttagtttagtttttttgatatcgttttttttttggggacgttgtttgcgggttcgcgcgttttcgttttcgatttttttgtaggttttttcgggggtcggggtaggatcgtatttatcgaggattcgggcgttggagttagtagtagcggtacgagt

SEQ ID NO: 10664 - DNA, 201 bp, synthetic construct
  misc_feature 1..201: note = Description of Artificial Sequence: Synthetic polynucleotide
  source 1..201: mol_type = other DNA
taagtcgaagtttttgaaggaggttcggtgttatttcggtgtgatcgcgtttcggcgacgttgggtagggtgtagggagttagttcggtcgcggtttagcgggaggggagggggtcggtttcgaattcgggcgttcgggtcgcgggtgatttattgggaacgttaggttcgcgcgtttagatcggcgggcgacgtttagcg

SEQ ID NO: 10665 - DNA, 201 bp, synthetic construct
  misc_feature 1..201: note = Description of Artificial Sequence: Synthetic polynucleotide
  source 1..201: mol_type = other DNA
gggggttcggtttagggcgggaaatgggtggggaggggcggggtttgggttggagattggacggaggagtcgggcggagatgtaattggaggaagagggcgggacggggcggagaaggtttttcgtatcggcggagggagagggattaggagggggttgcggcgggggaggagagggggttttcggtttagagattgaggc

SEQ ID NO: 10666 - DNA, 201 bp, synthetic construct
  misc_feature 1..201: note = Description of Artificial Sequence: Synthetic polynucleotide
  source 1..201: mol_type = other DNA
gcgatttttgttttttttttgggtcgagcggtaggcgcgttcgtatcgttttcgttttttcgtcgtagtcgttgtcgatcggttggttgggttttgcggcgtgaggatttcggcggcgtcgtagtttcgcgagttatggtttagttcggcggggaggttcggttcgggtttaagacggcggtgtagattcgcgtcgttatt

SEQ ID NO: 10667 - DNA, 201 bp, synthetic construct
  misc_feature 1..201: note = Description of Artificial Sequence: Synthetic polynucleotide
  source 1..201: mol_type = other DNA
tttatgaatatttcggggcgcgggagttcgagcgttgtcggagggcgtttcgggggaggcggtcgttgatgtaagttcggcgggtcgttgggtttcgttcggttgcggcgggagtttcgggacgggtcggacgggtcggggtagaggaggcgaggcgagttcgcgggtggttagttataaagttcgggcggcgagatagac

SEQ ID NO: 10668 - DNA, 241 bp, synthetic construct
  misc_feature 1..241: note = Description of Artificial Sequence: Synthetic polynucleotide
  source 1..241: mol_type = other DNA
ttttatttttatatatttatattcggtcgtttttcgtttttttattcgtttgtcgcgcgcgcgcgcgatttcgtttatatatagcgcgcgcgacgtcggcggagatcgtttcgtttttttagatcgaacgtcgttcgttcgtttgttgaggagcggcgcgcgtttcggtttcgtttttttggcgtcgcggcgcggcgggcggggggcggcggtcggaggagttgggggtcgggttagcgcg

SEQ ID NO: 10669 - DNA, 201 bp, synthetic construct
  misc_feature 1..201: note = Description of Artificial Sequence: Synthetic polynucleotide
  source 1..201: mol_type = other DNA
ttttcgtcgttttttaggtttttagtgaggttttttagttggtcgtttattatggtttttattatgaacgttatggttttcgtcggtcggggtatcgggcgtttgttattacgcgttaggtatcgggtacgttcgcgtttattttagtattaggtttcgcggatagttttcgtcgcgggttcgcgttttacgtttggtatc

SEQ ID NO: 10670 - DNA, 201 bp, synthetic construct
  misc_feature 1..201: note = Description of Artificial Sequence: Synthetic polynucleotide
  source 1..201: mol_type = other DNA
gattcggtatgaggagttcggtatttttgttttttagttttttggaagtttttttttggattggtcggcgtcgttttttcgatatttgggggttgaggtcggtatttcgggtttgcgtggaggggcgagcgttaaggttgcgagagtcgggtttcgatttgtaattattttttttaatttttatggagtttcgtttcgcgt

SEQ ID NO: 10671 - DNA, 201 bp, synthetic construct
  misc_feature 1..201: note = Description of Artificial Sequence: Synthetic polynucleotide
  source 1..201: mol_type = other DNA
gcgttcggtagagagtttttagtcgtttcggatttcgcgtagtttcgtagagacgcgcgtgtcgttcgtacgggtcggtattcgggtcgttttcgtcggcgtgttaggatttcgtatagaagcgttcggacgcggacgtacgtagtcgcggttacgattttcgtcgttcgttcggttcgtgttcggttttggttagtaggg

SEQ ID NO: 10672 - DNA, 201 bp, synthetic construct
  misc_feature 1..201: note = Description of Artificial Sequence: Synthetic polynucleotide
  source 1..201: mol_type = other DNA
ttttttcggttttttttttatttttcgttttcggggtttttttttgttgagcgggggttgtcgggatttgggattgcggggttgtttcgatttcgtagtcgttcgcggtggaagttagttcgggtttggttttgagcgcgcggttggggcggtcgttgtttatggtgttggcgcgggtggcgcgtcggtcggcggggtttg

SEQ ID NO: 10673 - DNA, 201 bp, synthetic construct
  misc_feature 1..201: note = Description of Artificial Sequence: Synthetic polynucleotide
  source 1..201: mol_type = other DNA
tcgttcgcgtattggggttttcgaggtgtgatgttatttgttcgtagaatcggtttttttcgcgtcgtttttttcgcgtttttattttagtttttttttcgtcgttttcggggttaatatggtagcggcgtcgtcgttttattttcgtaatcgtacgattcggttggtagggtcgtcggttcggattttcgagatttatat

SEQ ID NO: 10674 - DNA, 201 bp, synthetic construct
  misc_feature 1..201: note = Description of Artificial Sequence: Synthetic polynucleotide
  source 1..201: mol_type = other DNA
tcgcgggcgcggtttttggaacggattttttttcgagtcgcgttcgtcgggtcgtttttttttcgttcgtagatttcggttcggtttcgtcgtcgcgcgcgttttttttcgttttggttttttttttttcgttttcgggtttcggcgttttcgttcggttcgagcgcgcggtttgtttcgttcggtttattatggcgcggt

SEQ ID NO: 10675 - DNA, 201 bp, synthetic construct
  misc_feature 1..201: note = Description of Artificial Sequence: Synthetic polynucleotide
  source 1..201: mol_type = other DNA
ggttaggttttttaggagtagttggggaatattcggcgattttggcggttgttttttggtggcgtagggagttcgcgtgtttgcgagtgcgtgtgtgtgcgaagtttttcgggtaagtgtgttagcgcgcgtttgggtgtgtgtaagggtgtgagcgtgtatacgtgggtacgggcgtgtgcgcgcgggggtgttcggttg

SEQ ID NO: 10676 - DNA, 201 bp, synthetic construct
  misc_feature 1..201: note = Description of Artificial Sequence: Synthetic polynucleotide
  source 1..201: mol_type = other DNA
tttcgtttttattcgttttttttatcgcgtcgttttttcgttttgttttgcgggtttaggcggaattcggaacggtcgtttttttttttcgtttttcgtcgtcgttttttttttttttttttcggttttttttttagtttcgggtcggagcggggtgtcggcggcggtcggttcgggcggcggcgtttggttatgtcgtgt

SEQ ID NO: 10677 - DNA, 201 bp, synthetic construct
  misc_feature 1..201: note = Description of Artificial Sequence: Synthetic polynucleotide
  source 1..201: mol_type = other DNA
ttaagttcgttgggcgttcgtttttgcgtatcgcgttcgtttttttcgtttgtgcgtttgggtttcggcgtacgtattgtatttgtcgttcgtttttgtcgtgtgtgtgtattgtcggggttcgttcgtttacgttcgcgcgtgcgtttttatttttatttcgtattcgcgtgtacgatttattcgtcgtcgttgtgcgcg

SEQ ID NO: 10678 - DNA, 201 bp, synthetic construct
  misc_feature 1..201: note = Description of Artificial Sequence: Synthetic polynucleotide
  source 1..201: mol_type = other DNA
tgtcgaatgaagttgagcgttttagtggaattagggattttaggggtgagcgatcgcgaggggagagcgacgaaaagggcggtcggagttggaggggcgcggagttaaataaaaaagggcggtcggagttgtaggggcgtcgagttaaatacgttatttttagatggggggttttaggcgagttgtttagtttttttgagg

SEQ ID NO: 10679 - DNA, 848 bp, Homo sapiens
  source 1..848: mol_type = unassigned DNA
acggggtcgcactcgagccggcggagcatccctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtgagtccgctgcgggccggcgccgcagggctggagcccggggtgagggtggggatcacgaacttgagaccccaagcccgttccctggactccccgcgcctccgcatttcctgcaggggcacctggggcccagcgagaggcgaggccacttacatcgaggggaacacaggaatgtgtgtcatcgtgtgtatgtgtgtgtgtggtgcgggggggggagtgcgccgcg

SEQ ID NO: 10680 - DNA, 1230 bp, Homo sapiens
  source 1..1230: mol_type = unassigned DNA
acgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacacccttccgaggggactccccgattcctgggctgggggcctgccgcctggccccacgtctgacgtacggggcgcgagggccactgctccctggacttctgtcggaaccggacgcagtgggaggggtcgcagggcgcccgcggggcaggaaggatgcgggccgcg

SEQ ID NO: 10681 - DNA, 1094 bp, Homo sapiens
  source 1..1094: mol_type = unassigned DNA
gcggcgctaaaaatagctggggggagggtgcgggggcggcggagtctgtaacctaagccgccccagcctccggggggcagaccccgcggccgccggccggcgtccggccttcccagcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcgggccgggagctcgttggcggcggccggcgtggcgggcggagcgggcctcggagcggaggtgagtgcggatgcgccgcctgggcgcgcgcggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggccgcggagcgaggggctcggggagcgggacctccgggcggggctgcggggagcggggcccgggccgccccattcatcgcggatcggagccgggggtgccccagccgtgccgccgcctcctccgggccgcccgcccgggcgtgctggccccgcggcgctccgagcgcggcataggcttgcgagtcggcggtgtcagcgccccggacgggggtgggagctttggagcccaccctgggggagaccacgccgcacccccgcccagccccgcgcacccccagaggcttttgcagagccgggaagttggctggacgtctagacccgtggggacgcggcgccccgcgtggcggcggccggaagggaaggccaatggggctcgggggactcccgcg

SEQ ID NO: 10682 - DNA, 1979 bp, Homo sapiens
  source 1..1979: mol_type = unassigned DNA
ccgccaccgccaccgctttcctcccagccaccccccacacccgcccgcctaccctccccctaacaccccccacacggctgcccgcattcctgcccctcctcggcctacgcgcgcctcctgcaaccccgacgcccccaggtccccagttcgccctccccctccggctcggagcccgagagccgcctgctctcatttcaaaacagcgataataatagggacgctgagaataacaactacgaccagcacggcgaaggcgcccctctcgcgggtcagaggtcggcgccccagctccgcagaacccggcgcccggccagcgccccctggcagcccctcccggcagcctcaggtccccaagacctgcaggcccgccccgaagccccccgtccgcccctcacggccgctccgagcccccgaggcccgccccggagccccctgtccgcctctcacggccgccccgggcccccacggcccccaggcccgccccggagcccccaatcggcccctcagagccgccgcgggcccccggccacccaggcccgcccggagcccccgtccgccccttacggccgacccaagctccgccgacctcccaggccccccccggagccccctatgggcccctcacggccaccccgggcccccaaagacccccggctgccccgaacccggacccgtaggcccgctccgggacccattattggtccctcacgatcgccccgggcccccaaagacccccgcccacccggccccgaccccccaggcccgcccggaggcccgcggcgcagctccgtcgccggggaaggcctgcaggccgcaaggccgcgcgaatgccccgtgcccgccccgaccaccgcccccagaccagcggcgcctctcaccgtgctccgagggctgcgcggctccgcgacggctcagcggcggggcgcgggcgctgcccatgcagcccgcggccgcgtttcccgggccgcgcggcccgagcggcaaggcggcggcggcggcggcgcgggctcgggcccggcagagctgcgagggacggcgggaggcgagcccgcccctcgggcgcgcccacggctcgggcgagagccgcggctcccggtgcggacgctactgatggggcgtctggccgcgggctcggcggcggcgcctccccggctggggccctcggtccatcgcgcaccgtctcagggcggcctctggctccaggacccagcggcggctgcggcgggagccggccgcatgagacgctcccgcccattggcccgccgtatccgccaccgccattggcccgccccggccggccgcaggggctgtgcacgtcacagcgccgtgagttagtgcgctaatggagtgaaggagagaggcgggattgacagcctctctggcggtccggaggcgggactaggaggacgtcccggtaacgattgggcagggtcctgcgtaagggcgcatgcgacactggaagtagcgagcaactggattggctgcctccgtcgcaaaggagggtgggtcttgcattctcgggcctgacgattggtctttccaagtgccggaagcaacagggatgtcgtctggaaacaaaatctggtattgaagcgcagggagacaaaacgtccacctctagagccgaggcggcggttgcctgtcgcgtgcccgtggtcttctgcctgcccccggacatctcgggccacgtccggcccggcctccggccgcgctgccctaacgggcgtcacggggcatgaagagctctgggcggctgcgaggggagggtaccggggcagcggggcggtcgctcggggctcccgcgcggtgactcttgctctgccgtcgaagagaacggccctcgggcgcgtcgcggccgcggctccagagcccctgggcctcgcgctctgagagcctgagccgcttgaggaggccaagcgcccacgaaccgcattccctgccttgctagttagttctccaacacgcgaaaaaggtagacg

SEQ ID NO: 10683 - DNA, 1930 bp, Homo sapiens
  source 1..1930: mol_type = unassigned DNA
ccgctcaggcagcgcgctgccccgggctccggtagggtggggactggtcgcgaaggctagagaaggcaatggcaggggaggtcagtccctgccgcgggccggctgcagagcggacgttccgccctgctcccggccccctcttcgcccgccgggttcgccgtgtcgaataactgctgtccggagctttcgtgacgcggagcttcaactgctgcgatccggaagaagcgaaaaggagtcccccccgccccgcaccctgagcgcccgggcgtgcaaacgtgggtggcggagagcggctgccctcccctcccctgtcccccctcccctcgcggcgctcccgtgtgtgcgggtgtgtgagtgcgtgtgtctccctcgctcactctcgcacacgttccggcactagtgcaggcggcgagccggcggctctccgctcgctcgctccggcagctgcgttcccgcctcgccccgccgccgccgccgccgccgccgccgccgcctctgcagtcgcagccgggcatggtgagtgagtgaggtccagccgccgcgcgctctcccggctcgccgccggaccccagcctcaaccggctccgtcccagggagccagcctgcggcgggagcgcgctgcggggccgggcggctgggggacccgggcggccgagctgcgcctggaggggcggcccgtgcgctctcggttccaggcgcgcagggccgcgggaccccgtcttgggagcgggctctacgcccctcccggctccgagtctctctcctcgagggctgcgcgcaccctccccgcccgcctgcccgcggttctcctcctgctcccggagcgccagtcgccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccggcgggggatggggctgcccaggaggcgcgccgagcccgcagggggagcgcggagccggcgcgcagcctgagagcccgagcagcccgcgccgggccggtccgtgcgcaccgcgcgccgccgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacaggtgagagcgccgcgtgccgcgcgccccggtctccccgcg

SEQ ID NO: 10684 - DNA, 3177 bp, Homo sapiens
  source 1..3177: mol_type = unassigned DNA
tcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcg

SEQ ID NO: 10685 - DNA, 2195 bp, Homo sapiens
  source 1..2195: mol_type = unassigned DNA
ccgccagctccggccgctaagcaaacattccctccaggagtccgagaagccggtgtgcgaggggaggaaccagcctgaggtttatcgctccagcaactccgggtgattcatagagtttagactcccggttgtcgtagaccgcggcaggcacgcaaacaagcagcccgggagataccctcccctttcccagcccccgctcctccaccttgctaccccctagcccgtgaccagctgcctcccctccccctcgcgggcgctcagggttgagcaaacactccgggccgcccgccccgccaccagctggctccgaccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccgtgaaggctaattaggacaagtcggagcagggaacggggacgccgggaggggagagcgcgctccgagttgggcagaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgccttcccgctccgccgcccggaagagtcgggtcgggacggcggggagtgggcgagggcagaggcggggggactggacatcctgcgggctggggacgccgcgccaactccgctcggtcgctgaaagttttcaaacccgagccggctggggactgggggggtgggggagcccggcgctgcggctcgggctggagggaggggaaaccactccataatcggggtctccaagaggagcccctccaccgcctgcctctcggtgggagtccgcggtcactctctctcgtgggtggcgtcctctctgccg

SEQ ID NO: 10686 - DNA, 2063 bp, Homo sapiens
  source 1..2063: mol_type = unassigned DNA
tcgaggagccgtggaatggaggatcacggcggcgtacggagcaccggggaggaatcgtggggtgcgtaggcgccggagcgcccgggttcggcccggaccgaaggcttgcgcggtgaaggtgtggtgtctgtgctccggggaaagggctgtctccccgggggactgtttcgcagcgaggcttgttttgctcgcagctgggcgctccctggggagcgactgagcgcaagggcgggccgggaggcgcgaggcgagcacgatgctccagggccccaaggactcgtgtgcgtgtgcgtgtgcaaagtggggcggtgcagggcgtgtgcacggcacgggcgagacgcgcgccggtgcgggcgccgggcgccgccgggcgcaattacagcataaagcccgggcgccgcggggcgctggcccggagaacccaccggacgcgcagaaccggatcggcacccctcccgccagcaccctaacgcggagccacagcgcccagggaccggagggcaggcggcggcggtaaaggacaccacgcaagtctccacgtaacccccccgagcagtgcaagctcccaggactggcgcgcgtcccggccactcggagcgcgcaccgctcgcaccccggcgcgctccccgcgcggtgcagggaaccacagcgcgggcgggtattaaggggaaaggaggaggcgtggcctggccgaggagccaatgggccgggaggggcgcgcgggggaggagctcaggtgcagagtgccgattggccagttcgccctccggtatgcagatacggtgggagtcacgtgctaggggccgggacgacttcctgttggaggccaacgcggggcggggaagggggcgcgagcgccccgtctggctgaagcggggggaggggggttcttgtcagttagagcaacaagatggccgcggtggcagctccgcacctcagcgcgacggccccgggagccgtagccgccgccgccggccccgccgccgcgcagtcttgagcgccgcccgggccgccccctgacagggcagtcccagcgcccgccgcgctcccgccgccgtcaccgtcgcagtagccgcgggcccgcccgagccggaggcggagggagcggagcggccccgcgcccagccgtccgcagctgccaccgccgccgccgccgccgcctaggacccggaccccgccggagccgcatcccgccgggcgtgaggaggaggacgcgtcgcggcgttgccggggccggacctggacctgccgggacgcgccgccgcccactcgcccgcgccgccgccgcagccgccgccgccgcccgcgccgggacctgagtccgtggcgccggcgctgagcgggcccccgccgcccgcgcactcccgaggccctcgggcggttgttcgtgccgccgccgccgccaggcccgcgccaccggagccccgcggagccgccgccgccgccggggacggagcccaggtgagcgcggcagtccgcccgctcctcgccgcagccgcaactttgccgggaggttcgcgggccctttgttcggccgagccgagccggggcgggcgctggcccctagcgacccgcgtgcggcgccaggccccgggccggccgggtttgaggggagcggcgggaagcggccggggccggggcgcgtgtgtgctagtgtgagacggggctgtgcagacgcccggtgtgcatcacaatcaaacgggagtggaatggagggctgaagatggatgtgccccctcccttttaaaactcatgcagcggtgaaattcggtcctttccgggcagccccccgcagattttgcactggtgatggcaggcgcgaacccgccgtgttttggtgcaggagcccggtgccgttgtttgggggaagagaaaaacccggggcgtgctgcgggtgggcggagaaggacccctgggcgctctgcggctctgaaatcaggtggattttctaacggtgctgcggactgcggagtaatgcgtatgaggaaaacgagccgtacaacatctgtcctgttatcagataacgtaacccgagcgcctggttgccgcctctgctttaagcg

SEQ ID NO: 10687 - DNA, 816 bp, Homo sapiens
  source 1..816: mol_type = unassigned DNA
gcgcccggagtgggaggaggggaggcgttgcccgacgcgccctttcaagtctccgcgctcccccccggcggcggctgcccgggggcggtggctcggcgtcgcctcccccgaccgccccctccagggcccctcctccgtgccgcggccaggctgcccggccggcggcgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggagccccgcgcctgccgtctcagccctgggagagggggctctgcccactttccgaggcttgggaccgctctcccccagggcgcccggagctctttgctgcg

SEQ ID NO: 10688 - DNA, 368 bp, Homo sapiens
  source 1..368: mol_type = unassigned DNA
ccgttttctccacacaggcgcgccgggaggcttcgctctttggccgcgcgactcgggcactcacgttccgcgcagcgtcgcggtcggctccgcgcagcagcatcacccgcaccacctcgctgtggcccatctgggacgcgatccacaggggcgctgtcccgtcctgcgggaagaggaggcggcggccgccgtgactggggcgcccggccccacccgctcacagaacgtctttaacaccaggggtctgaaagcgaaaactccgggaaggcactccctgaccgcagatcacactctgcagctgatccacaccgcccaggaggcagtgagaaaagagggggtgtgtgtagcccacggacgcagacggcacg

SEQ ID NO: 10689 - DNA, 1411 bp, Homo sapiens
  source 1..1411: mol_type = unassigned DNA
gcgggctcccactccgccgttaggagcctttcccacaactctgagaaccggggtgcgaagaaagaaagggcgaaagggccgctcaactcccagagagtagccagcgaaagactcgaggggccccctcccgcaggaccccgaacaactgcagcacctcctcagcccgcggggtccaccaaggagaccctcacaaacaatagcatctgcggcgaaggaaccacccccgcaaagggcagaagcgccagatcctaccagccaattacccagacgcgcatcgcgacccgcaagttcgggcacgctccgcccgggcgcaggcagcgggaggggccgggcacgcccgtgggggtggtctgggtacgggtctgatccgggggcgcgctcgggaggggtctgggtctgagccgggggcgcgcccgggggagtgggctgggtctggggcgggggcgcgtccggaggtgggggagtctggggtgggggcgcgcccgtgggggtggggtggggtgtctggcccggggacgcgcccggggaggcgtggtctgggtctgggccgggggagagccgggtgcgtgctctgggtctgcgcgggggagcgcgcctggtgcctagatgtttggtaccgagcgggtgggggacgccgggctcggagccggcggcaagtctcctcctggcaggtaacaagcctcctttgcagccttgaaggcgccttggccagggccatcccacggcccgggcccccagagcccccccacggccccgaatccgagcagcccctggccctcaactcgccccggaaaggccgccctcccctccaatgtgtggcgcgccccgatcgcctctcactcgtggaacaaaagagcagctcccgcggagcgggtccagagtctgcccggactgtccgatggccctcggccctctgagcgccgcggctgccgggctttgtgtccgcgcggggggcgggaaggacggccggggtccccagtgcgcgtcccgcggagcggcgcgcggcgcccgaactggaaagttgtcgccggcgcctgtcgcctccacgccgccccagtccccctccgcggggcgccccattcattagccaggagactgggcgcagggccgccggggcgggcggggggcttaccttgctcttgacttccactgcgctgcaatcgtagaatcgcaaggtctgagacttgtgaaaacttcggttcatggtttcggccccggtcagcctcgccgtcgccctcgctcctcaggggccgcagaaagactcccgggggcggcgcccccaggccccggccccggccccggcccgcgctcgcttggccggcgggctgctcccggtgctgcgggcccgagctgggctggccgcgcgcctcagggactccaggggccgcgcgcgggaggagcgcgggggacg

SEQ ID NO: 10690 - DNA, 1487 bp, Homo sapiens
  source 1..1487: mol_type = unassigned DNA
ccgcccctgcacctcggggacgtgaccccccccccaggctgacccgttcctcgctctgtcgtccccaggtggaggaggagctgacgcacctccagaagaaactaaaagggacagaggacgagctggataaatattccgaggacctgaaggacgcgcaggagaagctggagctcacggagaagaaggcctccgacgtacgtgtgcagggatgcgggagcccgcggcggggccaggccggagccccggggccgggaaggcggggagagccgcagggggaggaggaagaggaggaggagaaggcggcgcctcccagcgctttctccaaataagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggcggcgacgtgtctgctccaggcggcgggggggatggggggtggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccg

SEQ ID NO: 10691 - DNA, 602 bp, Homo sapiens
  source 1..602: mol_type = unassigned DNA
ccgcccggccaagctatcttctcgctagcaggtgaggcccgtgaacagccaagctccccttggcacggcggaaccgcagtggacgcgtggaggggctccgtagaggagggacctttgcttgggatgcggggagctgtagtctcttatctgcacccagcttgttagttgtacgcctgcaggactacaatctcagcacaaagcaggattgtagggcggtgcggatccctggagggagacagcgcggtgcgctcctgccggccatgctggctggggtggtgtcttaggcggttccagccgttagtcacagggcggccggactacaatcccagcatacaacgggagtggaggtggtgaccttgagagagggcctgtgctgtgcgcgcctcgcggggcatgctgggagcagtagcatcttagctgcttccggccgctggtcgcagggctgcgggactacaatcttcgcatgaaatggaagagagggtggtgcggatagcttgaggaaggtacggataccttgagggaggtatggatacgttgagggaggtacggatacgttgagggaggttacggatacgttaagggaggtacagcagcggtgcgcg

SEQ ID NO: 10692 - DNA, 628 bp, Homo sapiens
  source 1..628: mol_type = unassigned DNA
ccggcatccgccgtattacagcggatgggtgcatgcgggcggtgacccgagctcgcgcgggctgcggaaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacagggctgtcgccaaggccccaggaagggttttgcagacgcttgtgggggtgggatcgcggctgacataaaagcgtgtaagtgggtcctatcctcctcactgtccgtctctactcggtctcgaaaagtggcccctgtctggcgttctacccagtgtagcgttggcaaccacagcagccgcaacctaacggcggacgaagactggacgccggaagtcccgcccacgccgctacgggaacgcccctctgcgccttccgtctatggcttggggtcggcttccgtcccttgtagcactgccttctgggtaatgtagtttgacggaatccgggtggtacctggagcgcactttctgttctcggtgaggcg

SEQ ID NO: 10693 - DNA, 215 bp, Homo sapiens
  source 1..215: mol_type = unassigned DNA
acggagggacgggccgtgcagtgcagccggcggggccagggccaggccgagggcgcgaggtggcagccggcccggggaggcggaggctgagcgagcggtggtgtttgtggagctgtcggctgcggtggaattatgaaaaatagcaggcatcggagccggccttcagcttcgattaggggagatgggacatgacaggtgcgatcaatacgcagccg

SEQ ID NO: 10694 - DNA, 2638 bp, Homo sapiens; identical to SEQ ID NO: 5191
  source 1..2638: mol_type = unassigned DNA

SEQ ID NO: 10695 - DNA, 2172 bp, Homo sapiens
  source 1..2172: mol_type = unassigned DNA
acgggatgccggtctcggccgcccccaccaattgatccatgatcggcttggccagggcgcccggcagcgagagcgccgccgcgccgttgggaggcagcgtcagcgcggggaagaacggcggctggtgacccagcaccgcgctcatggcgaagtccggcgcccggtgaggtaggaacggatggtaggccatgcttgtcccaggaatgaccggatctctcatggagaggctcatccactccaggcggggcgctgggctccagccggggacaagtccgcagctgctgtgttttgttgtttttttgttgttgtttaacagcagcacataattcaaaaggggggaaaaagcaaaacaaaaaagaaagaaaaaagaaaaggaggcagaaatcacaactaatgcacttcaaagggaggaggggaagtgtcttttggagaatgggaggccgcttttaaagagggcaaggcgaaaaatcagcaaacatagtcgcgcgggtgaccgtccttgtgccttgcgtttttaaaaagccgctcctgaacgtcggtttcagaagcgagaggagcgagcagggtctcgactcgcgcccgagccctgccgctgagctcgaaatagacactccagccctgcgtcccaggaatctctctccagcccctaggtcttttgttgcaaatgtgaaaggttctcctagaagactttttacctttctttttcttcttcccccgccccctatctgtcttcctctccctctttctcgctggtggcgtctgcagctgtgctagacccggctttaacagggagcgagagagcggaaaaagtctctctcctttaaaaaaaaaaaaatctgatttaaacccccttctaccagcgctatcaaaacttgaattgcaaactggcttccgttcgccgccctcctcctccttcctctgctccgagcctccggagggtgtctcggtttcaatccaaatcttgctgggctcttctcccgtgcctctctctcttccttgtcctaaaacgtgagcgaattcgcttcctaaatctgtgtccaggcgcgcagggcagggaggatttagagggggaaaaaatggaacagagggaaagagagggaggggagagagagagagagagagagagacggagtcggagagggagggagcgagagaaagcgagagctcctcgccaccctccgccgcctctagaattcaccgggcgtctgctcggcggctctagaaggtcgggctgcgctgtgggctgcggggagccggaggcctcttgattggctctttgacgctttcggaccaattgtgttgctgcataggcgtggttttcacaggtcgagtgctgggggatagagctgagttataaaaagaaggtgtcggaaactgtaacgtcgcagcgccgcatcggtactactgcctgtcctgtgaatatgtcaacatgatcagagggcgggcgggagccactggggagcgcgcgcgcacagagtcgcctctaggtggcttatcgagagatcgctgcagcccctgagctcgctcgctcgctctggttcagcccacgtctgaaatgcctcagtcatccagccggggatcgagggaggaggcagggccaaggaggaagggggagggagagagggagggagccagcgagcaggcgagccgggcggggaaggcggagagcgcgcccgggcgccgggcaggggcgctcgcctctcttgcactccgctcgcctctccgaccgccgcggccggttctctctccagctctccttcttctccccgccccgggcgagccgggcgggtggccgagcctccccgcgagctgccatccggccactcggttctacaaaagccggcggcagccgagaagcgagcgccgagactccaggcttgcgtgctctccagccccacgtggagccaagctccgcccggccgccgctgaagggctcccgagctcgggtgtctcggtgctggtctcccctgcgtctgggctgggggagcacaaggatgcggccatatctcagcacacgcatgtgtgggcttcctctccactgcgccccacccgcagccatgtgcgggtacccaaacacccccggtgtatctgtactcgaacacgcgccaacacactgggactgaaacacacaccgaaaaacacgtacacacaaacacgtacacagcctgcgcg

SEQ ID NO: 10696 - DNA, 2548 bp, Homo sapiens
  source 1..2548: mol_type = unassigned DNA
ccgggtgggcctcgaaggcgaggatggccagaacatgtccctcgtgacaccccttgcccctttctagggccgtgcggcgagaggcgtccgagcactgccaatgtgacgcgggcccacggccgcatcgtggggggcagcgcggcgccgcccggggcctggccctggctggtgaggctgcagctcggcgggcagcctctgtgcggcggcgtcctggtagcggcctcctgggtgctcacggcagcgcactgctttgtagggtaagtaggacccccaggccttgcccagctggggtccccggcgctgggccccgcacctgccgggttgtccggcgggcgacgcgcgggaaaggtggtctctgctgccccctggcggcggccggccccgggcttccccatctcaaggcgccgcgcccgccccgccaggatgccagcccggagggggtggcacggccgggcgagttcgccccctctgggacgggacccctccccggcccgccctccgtgcccccaggtggagaaagcccggcatgcgggcggaggggcagggtctccgaggggcctgcggggtgtgcccctgtccttcctgcgtctcagctgccgctcgacccgcagcgccccgaatgagcttctgtggactgtgacgctggcagaggggtcccggggggagcaagcggaggaggtgccagtgaaccgcatcctgccccaccccaaggtgagaaggcagtccccaggcccccaaggctgggcaccgcacccccacccgtgcttccttgaccctgcgccgcctccccctcctcagtttgacccgcggaccttccacaacgacctggccctggtgcagctgtggacgccggtgagcccggggggatcggcgcgccccgtgtgcctgccccaggagccccaggagccccctgccggaaccgcctgcgccatcgcgggctggggcgccctcttcgaaggtactgggcgtgggtgagccggcgcgtggtgggaagaactgggggtccgaggtaatagagtgtagggaggccgggttgccttggaaaaatgctgcctgctctttcaaagggggaggaatcaaggggggtggtgggaaggggaccctcaaggcggggctcttgccctccaaacctgagccttccaccccttccctgcagacgggcctgaggctgaagcagtgagagaggcccgtgttcccctgctcagcaccgacacctgccgaagagccctggggcccgggctgcgccccagcaccatgctctgcgccgggtacctggcggggggcgttgactcgtgccaggtatgaacccagtctgatgagaaaaggccggctgagccttcccagggccactacggcctcttttccttccacgtctgtctgtcactcgacttctctgagcctctctgtcctcatccctaaaatggacacaagtggcaagctcacacctgccaggcgtaaggcaggcgtcatagggggcaggtgaatgcagcgtcctctctcttggccccgcagggtgactcgggaggccccctgacctgttctgagcctggcccccgccctagagaggtcctgttcggagtcacctcctggggggacggctgcggggagccagggaagcccggggtctacacccgcgtggcagtgttcaaggactggctccaggagcagatgagcggtgagcgccctctttccaatgccccgtccccagtgccccaacggacaaccgtgggacaagcccgtttccacccggcccatgcccattcccagctcccttctgcctcgggaaagcctgtctccttccggggaaggagtgagggggctagggccccaaacagagggtgagctgacccctgtcccgcccgcagcagcctcctccagccgcgagcccagctgcagggagcttctggcctgggaccccccccaggagctgcaggcagacgccgcccggctctgcgccttctatgcccgcctgtgcccggggtcccagggcgcctgtgcgcgcctggcgcaccagcagtgcctgcagcgccggcggcgatgcggtcagttctgttcacccggacccggacggggggcagaggggagggggcctggccagcctctgaccgccgctccgactcctgtccggtccgcagagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggtaccccgcgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccg

SEQ ID NO: 10697 - DNA, 919 bp, Homo sapiens
  source 1..919: mol_type = unassigned DNA
acgggagccgctgcagggtcaggacgcaaagactccgaggcccttcaggccgaggggacgtcgccctcgccccacccctgcgcccggcaggcccctggtctcgctagcacctgtcgttcagggctggacccacgcggcgggcgggtgaggggtccctggcgcgcggccaccgctcgctctgtgccaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctggtgagtgccggcgcgcgggagggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtgggtgaggcccggggcgtgggaggatcgcccgctctgtcgcccaccccgccgcccgcccgcttgaccacgtcccaccctcccccgcagcgctcggggagccgccgaggagggggccgccgcgcccccgggaccacctgcgcctgctcatctgcatccagtcccggtgccagcgcaacgcgtgagtgtaccccggcccggaccccacacccgcattcgctcggcctccacaagctggaggtggttaaacaggcactggacggggcttccgcccgttcacaccccaccg

SEQ ID NO: 10698 - DNA, 2488 bp, Homo sapiens
  source 1..2488: mol_type = unassigned DNA
gcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccg

SEQ ID NO: 10699 - DNA, 513 bp, Homo sapiens
  source 1..513: mol_type = unassigned DNA
acgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttccagccgcctttataaagccggcctccccgacccctcctcctctctgcagctctcccctcctcccttgggggctgggaggggacggggcgggacgctggcagccgggagagtggaaaaggctgcacagagccccgtgacaagcccggccg

SEQ ID NO: 10700 - DNA, 1766 bp, Homo sapiens
  source 1..1766: mol_type = unassigned DNA
gcggatggccggcccaggcgcgctcccctacccggggccgcctgtgctcggtgtgccgtgtccgcgggtcaggggcgcggcgggaagtcctcgcccgcccgccagccagcggggtcaaacaggtcatccctctgcggacggccggcgccggagcctccctcccgcccgcccggacccacctccgcaagcagcgctggggctggagccgggcggtccggaccagccccggctcacctgggcggcgctcgcggccgggctcacgccggggaaggctccggccgccgcgagcccccgcccgagccccgcgtcccccagccacccacctgccccccacgccccactcaccagcgcgcacggccccggcaacctcacccggagcggggcgccgccgccgcctctgccgcagcccggccgggccgctgggcgcaggggactccgcgccgccgctgccgctgccgccgccgccgccgccgctgccgctgctgcatcccccggcgagcgctgctgctcctcctcctgcctcctccccgccccccaacgccgccgccaccgcccccggccccctccccgcgcgccgccccagccaaagtccggctccgcaccccgcccggaccgctcttaaatcgccccagcccggccggccacgctgccccagccagccccttggcacggcgctaccgccccccgctcgcctgcccgccggcctccacgcaggggaggcgggcgcgctccggggcggggagcgtcgggccgggagccgcggacggctggggcccggggcgcggggggcccagccgcggtgccctcctcgagccctccgcgcgctagcgcttttacctccggcctgggggacgcgcggcccgcgacccggccctgcctgtccccggcgcacggccccggccccggccccgaagtccagctccggacggggcagtgaacgcagagctggggtcccggcggctctcgacctcccgatgcctccggactcggctggccgcgctcccggcgccgagcgcgcaccctcgccgggacacacagacgcacactcactcgacacactctcgctcctgctcgccctcggcggagagttgaaacagatgtgggattcgcccaggagctggaaacgagggagggaagcgagccagagccttgtgtgcacgtgtgtgtgcgtaacacacaaaccagggggcatcgctaataaatcaaatatcgtgataaattcaggagggccatcgatcaggtccacttggctggaaacgacgtgaatctgcctcttttccgctttcttcttctcctctctcggagctggagggagccaaatgttccgcggggagtgcgacagccccggccgggcgctcccctcgtaatgacacgttaataaatgttttcttttatctgctttcacaggactcgccccggtctgcaaacactcgactgcctttgccgaaagcctcgcgctcgcctccagccacacacatttgccattggagaggccggcgccggccgcgacccgcagctcaatcgcagggcaaaccgagctgcctgtgcgcgcccgagaactccccgagaaattaacttcggctcaagtgaaaatagcagctgttgtccagaaatggcccgggagtagcatagaaaggagaaaccggcttcctccgaaaggggaggaattggactcaagggggtgctgtctaccgtggtttccgctgtccctcgcgccacagaagaggccggagggggaccggcctgacgcgggtgggcaaagagcg

SEQ ID NO: 10701 - DNA, 6511 bp, Homo sapiens
  source 1..6511: mol_type = unassigned DNA
gcgaccccgggggctagcagagaggagaggctgcgggaggactcgctgcgaagggcgaggggtggcgctgggtgggacgggcgcctggggccgtgcagggtggctcctgggtgctgcccgggctgcctgtcgcccagtactggcgcaggaagacgggtccgcgcagcgtctggcaacagtggcctgctccacgcctggaggcgaccaagttctgagttaaaggcgccgggcttagccgggaagtgtatggcgacccagaacacggagcggagaaggcctcaggggacacgaggctaccgccttagtcctcgggcctgcgctccgagcggttagggtgcgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccccggcctttccaccttgcttgatcctggcgggtctgccacttactgaggtccctaccggcgctcacgttgtcccgagaggcgggacaaacgtccggcgcgtggcgcggagtctgcgaaagcgctcgggggcctccatcttctgctcgggagtcccctccctggggcgggaagaggagtcgcagatctgcccgaatcttgctctacccgcctggccgccttcttccgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtgcgtattggggaagggtctcccgtgccgagaagacagaggatttgttctagctgccttccgtacagagggcgcggaggttgcgctccagttcgaacgcttacccattggaaagagggcagcgccggggtccagggaagctccttgggaatgaatggcctttgccaagcggttccggatcctctgggtcctttgggcccacggcacggtgctgcgcgagccctcagtgcccatcggctcccttcgcctcctgcgtagacgctcccaggcggggaggcatatcggttcctccgggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacggagggaactgggcgtctctggcgcactggggctccagctgcatgatcccagctcagaccttaagcctcagtggggtgtaggtgggatgggatgtgtttttaggagatgaggagaccccggttgttgagtcgctccccaaatgcgcagtttcttaactccaggtgacatccgtcttttggaggaacgagtgaaggccgtttaggcgaaagaggggtgggtttcagtatttggatcccttcccccagctctgccaatctcaggtgtgtttacggtggaggtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtccaaaggggtcagatgaggctacctgctagcgacaccttggcggacactcctccaaggccggcttgtcacctgccccgctacctcctcggggaagcacgaaaacaaccgaagtttggctttcaaaagaagtgggggctggggagtggtggtgggggtgcccgaggccagatggggccgtaagagctcgcgagtgctccagcctgtcggacaggttgagctagagtttcggagagtgggagggaagaaggaggcggcgagcgggaagaggaagaagacgcaggcagcgctaggcgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtgcgcatttcccgcgccgcgcactctatccgcgcctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcaggtgagcggcgctgcggctcctgaccggacctgttcaccctacg

SEQ ID NO: 10702 - DNA, 6511 bp, Homo sapiens; identical to SEQ ID NO: 10701
  source 1..6511: mol_type = unassigned DNA

SEQ ID NO: 10703 - DNA, 338 bp, Homo sapiens
  source 1..338: mol_type = unassigned DNA
ccgccttccgcgcatgcgcccaggccggtccgcaggcctttctcgccccagccggcagccagctcgttcgcgctggggtcaccgcgagccggtccgcagcggggtcaccgcgatccccggcgcagacacagaggccgcccccagccccgccgcctcgtggtcccgcccccgctgcacgctcccttacccctcggacctcgcagggccgcggcggacacggcccgatcggggacgtgaacgcgcagaactacatttcccagcgtcccgctcgcgctggaactacacttcccggggggctcggcggtgcacccgccggggtcgcggattggaggtttccg

SEQ ID NO: 10704 - DNA, 936 bp, Homo sapiens
  source 1..936: mol_type = unassigned DNA
gcgtcctgcccgctcattgggcctcccgccggctcatttgcatggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcg

SEQ ID NO: 10705 - DNA, 2184 bp, Homo sapiens
  source 1..2184: mol_type = unassigned DNA
gcgcgttcccttaacccccttgcgttccagctcccccggctccagcaccttcgtgacctgagcaccggcgggctcctgctcactgtccagcacccgacgcacctgtccccgccgcgcagtcccttccccccggcctgagcttccctcccggcgcgcactgcccttgtgaccctttccctccccggccacagatgcagctctcggccagaagctccacttccccgaggccctcgcccctgccaggcagctcccctgcggcgtcgcccacccagagttctccccctggacgctccctcagtgcccccctagcagccccggcggtcttctccccaccttcagccccctccccggtcccccaggaaggggccagactccagctcagcacccagcgcttcctggtctttcccttctgggcgccctcccgacagttccctttagggaagttggcccgctgcgcgctcccacccccggccgccgcctggacagaggcgcgcaatccggagggcgcaggctccggcccggagaagggggtgccgccggcgttccgatttctcaggaatggggaaacagaggcacggtggatccggcggcggggctgggtctggggctggacgttgacctaggaccccgcccctgcccgccctgcgccgcgcccctcccgggccggccttgaccgagcagctccacgcgggcccggggctcgtccacccgacaggagcggggggctgcagcccacgagcccacgagcccgcagcgacgcacccggagtgtaacctcgcagagtcacggagacactttcccggtgtgggcgcctcgccgcgcttcctccccgcgggctgcggccaccccagggcaggacagagccgagatgcccgggtgggagcgatgcccgcgtgggggcgatgcaacgggggagatgcctggggggagggtggtaaggtgaaacctggtggagaacaatgggggtgggtgggcgattcctggggaggtgcccggtgtggggtgtttctggttcgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtgggcgcaggagaaccaggggtcctgcccgcatgcaggggtttggggtcggtgtggccgaatgaacgcgcgggttcagacgagcctgtgatgcccccgctttccatctcctcgcgacctggccccagaagacagtctgagaggccggtggccgcggatcctggacgcgcttccctcctgcctgtggtttccctttattccggcagcgctgtgagtccacccttcactcataggagccacatccagaaccttctcctggggccacagcgtgggcttccgatacctgtgtgaccccagctctgccccttcagggctgcgtggtgaagccctcaggaccctccgcgtgggttgggcgggtgacgtggatgagggacaacgtggtgaggtccccgtcgtggcg

SEQ ID NO: 10706 - DNA, 413 bp, Homo sapiens
  source 1..413: mol_type = unassigned DNA
ccggggcgtgggagttgcgctcgctctcctttcccggcgtcccgtggagaccgggaggctcagcgcctctcccagctctcagcgccgccctcccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccg

SEQ ID NO: 10707 - DNA, 403 bp, Homo sapiens
  source 1..403: mol_type = unassigned DNA
tcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttggggttcgcatatttgaaagcgtaaacttgaggaatgacggcggggtgatgggtattttatagagtgggactcaatcgtgctcagcaacagatttctccaaattcccttttaaaaagagcctcccagagctgtcgaaatctccgcggggtgaaagctaaacttttggagtcgctgtgtagccgggtagaggacacggcggcgcgagccg

SEQ ID NO: 10708 - DNA, 675 bp, Homo sapiens
  source 1..675: mol_type = unassigned DNA
ccgttcttaaacgcacgactacttccctagctttccagcaccaaatccagcggccccacccggccacgcccccacgccaggccatgacccccatatggctcactgcgcaagctcacacccagtcccaggaagcgagccccacgtcgccccagctctgcattcacagccgccaagcggtcccggaagccgaatgccggataggtcaaagacagcgccgctgctccggcactgccgccagagggcgcggagtcgccgtgttggcctgcacctcccttgtcacgtcagccgaacggctacggcaatggaggattttgccgtatgcgacgacaggatgactgcttcccctgaagcttcaccaaacacggagaggctttcctgtccctgggagacgcggtgatgtgacgcagcggttgcagcgaaggtttcttgtaaaagatggccgctgcggagttgctaggtgtctcctggcaggcggcggccgcaccacaagatggcggcccgccccagggtcccacacgcggggctgcggaggcggcggccccgagggtccccgccccttgctggccctgtccccgcgtgcggggctgcgacctgcctttgtgtgcgggtggaagtgcgggccgccttggggccgagttgcaacttcgcgacactccactggagtgcgatgagacg

SEQ ID NO: 10709 - DNA, 580 bp, Homo sapiens
  source 1..580: mol_type = unassigned DNA
gcggtggccgaggacgccctttctggcgtccgggggcaccggaccgcggctcgccgggatggaggcaggcaggcagcgtctcgggagggctctagggagcggcccggagctgctcggcggggcgcccagggcgcagcgggcagcgcttaccgagggcgcgcaggtactcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctgcgggaggatccattgtagcggtcgctcctccccgcttagcgagggcgggcgcaggggcgggggatgtcgaagggtcaggtttgtccaggccgcgccaccttcgtttcagacgttcagttcgtttcccctacaaaggaagaggagaccggagacgggacgtttgctttgttggccgaactcttcg

SEQ ID NO: 10710 - DNA, 858 bp, Homo sapiens
  source 1..858: mol_type = unassigned DNA
tcgggcacgctgagttcaccgagaactccaaggagtcaacgagggcgggtgcccctacacttccccagggaccagcgccgcccgaccgcaattctggggaagaccccggcggtcctggagaggagggacaggcccccactactcacctggccagccccgcggaagggctggtggatgaatgaactgcccccccgccggccgagcctcgcgggacagcggcggaccgcggggtgctcacctgtggggatgctcgagggcttctccgagtccgcacccagacagggattccaggggtggaggacgagcgccaggagcagcagctgaggcttcaccgtgcatccccccatattcggccctcgagggccgcgcgggctcaggcgcccacggccccgcagcgccgcgcttctcgcgagaacgcagagacccgggtccgccctgagccgccgattgcgggcgggagccggcgggcaaggcgcgcggccggcagccggagcggcgcgtaacgcagctgagtgaggtcgtcggtggaggcacggagcagcaggcgcccggggcgctgcggaggccttataggctccccgaggggaggcgacggggcgggccgcgccctggctattggccgccggctgacccgccgccgctgcgcgcccggtgcggtcgcctcagctcgccctcctgggccccacgtctggactgtttgctcagcgcggacgctatttaaggagctgcctgcggctacgtgtggaggctcacgcagcgcttctggctggaacggggaagcctgcacttagctttgggagtgggtttgggagagggaggaggagccgccgggagtctggcgggagggcggtgttcccg

SEQ ID NO: 10711 - DNA, 5715 bp, Homo sapiens
  source 1..5715: mol_type = unassigned DNA
ccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgtagccgtcgtctgcccccaggttgctgctggagctcctgtgggagccgatctcgatgtctccgtagtcctctgggtaggggtggtaggccaccttgggagaggacgcggggcaggacgggcagaggcggcccgcgctgcccgagaaggtggcccgcatcagggtgtattcatccagcgaggcagaggagggctggggcaccggccgctgccgggctggcgtggtcagggagtaggtcctcttgcgcagccctcggtccaggtcctgggccgcgtcccccgagacccggcggtaggagcggccacagtggctcaggggcctgtccatggtcatgtacccgtagaactcaccgccgccgccgccgtctcgggccgggggcgtctccgcgatggactcgggcgtgttgcttcggtggctgcagaaggcgcgcaggtcgcctgggctggagccgtactcgtccagggacatgaagccggggtcgctgggggagcccgaggcggaggcgctgccgctggagggccgctggccggggccgtggtgcagcggatgcggcagaggcgggtgcgggccgggcggcggcgggtaggagcccgagccgtggccgctgctggacgacagggagccggggctggtggcggcgggcggcgagtgcgccacgggcatggacatggagcggctgtgttgcagcgcgccccctgccggcagcagcgccaccttgctcccgcggccgccgcagccgccgctcagggtgtgcgagcggctcaggggcgcgcgcaccggcccggggctcagggggctcccagccaccgacaccggcctggcgcccgcggccgccgctcccgccgccgcgccgccgtcgccctcgctggcggtgcgcacccggcacgagctgcacttggccgccggcggggtggcggccaggctgtcggtgcgcgagcggcgcaccaggcccgtctggctggggggcaggttgaccaggtggtggtggcggcgcgcgccggggacgctgatggggtgcgtggccgacgaccccgacgattggctcttactgcgcggccggaactcgaagagctccttgagcgccttcatggcctccaggatggtctcgtggatgttctgcgccaccaccgagtcgtccgcctgcatccacagctcgccggggcctgtgacggccgagcggcccacctcgatgaagaagaagctgtccgagtggccgcagcggcggatgttcatgagctgcagcgtcaccgacggctgctcgcagttgagcttcacgaagccgatggtgcgcgcagacaggcacagacggtacacccccgtcaggttcttgctctggcccagacccttgggcttcaggttcacctgccacacctcacggtaggcggccgtggcgggagccaccagcccgtagctgtcctcggccccggcggcgccggcagagccgcccagggcgccgggcagggaggcgctgcaggacgcggcgggcgcggcggcggggggcgcgtctccggcggccgcgcggccctcgctgaccaggtcggtgagcgcgcggtaccagccctcctgctcctgctcgttctcggcggccacggcgaagtactcgtccttggtgtagagggcgatcaggtacttgtgcttggcgtcggcgcgcttgttgatgttcaggcagcagtcgagagcgatcacccgtttcggcgcgcctgccttgctccgccactttttctcgctctcgtagtactcgagccgcggcggttgcggcgccgaccccccgcccgccgtcgcctcgtcgccgcccgcgccgggtccgcgcagcacgaagaagcgcttgtggccatgcttctgcttgcgcaggtagccgcacttgcgcacgctgtggttgttgttgttgttgttgttgttgaggttggggccgtctccgctcgccggcccgggcggcccgtgccgcggcgggctcgccatcgcgggcgcttcaggccgcgcggcccgggcccggcgcccaggggttggggcgaggggcggagggggcgcgggcgggggcggctccctcccacccttgcgcccggccgcccgcccgatcacgcgtccctcgggcccaggcggtggggaaggtccggggaggcccgcgggggccagcaccgctcggcggcgccgcgccctccgcgctctggggctcctgaggatgcccggcgcgggcggtggccgcccccctccccggctgcctgcggccgctgcctcctcgggctctcgggcggcgccgggggacgcgctcgctgggccgggagtcggggtccccgagccgcggggccgagcctaaggcgcgcgcggccgcaccggggctgctgccgccgcgtcgcgctccgggaagccggggtgcgcccgggcgctcggggtccgcgccgccgccggggctgctgctgctgctggtgttgctgctgctgctgccaacggcgacccgggctcgtcgcggtccccgccgcacagtgagtaacacatcgcgcaccgagtgactgaactaagaagagcaaaacaacatgtgactcggcgttacgcaggcacacacagcgcggccgccccgccccgctgcctcgcattggcgccgcgccccccgacggacggcgcgctcggccaatcggcgcggcgctcgcgggggcgggccgcgcgcccccgccccgcccccctttctccccgggccgcgtttcccgccgtcccctccccctcccgcgaaggccccggcccggccgggcggggtggggcggccccggcctcattaatcagcggcttgttgtggatgccggcggaggagatgccacccagggcgggaaaaggggcgcggaagaggggcggggcgggccacggcgcgcagggcccttccctcccgcctcggactcaattaattgggcttgagcttccgccggggagggggcgccgggcggggccgcggctgggcggggcgggggatcgggatcggcggcgggggctgcggccttgcagtggaagcatgggcggcgagccgggccgtgctctcggggcgcggggtccccattttgggcgagggcggccgctcccgcgctcggggtgggcgcgccccatccccgtcccccgtttcccgtccccgtctcccggccgcatctccgtccccccgcagccgcgaaacgcggggaggttccagggcccgcggccgcgggttcgcgagcaccgcgctccagatcgagagcggcgcgcgcccttccgtggaggacagaggggcgcggagggggcgcctgtgtcccacccgctcgcgggcgctttacggggcgtcctctgcgccattcacttgtcagcttgtcgggaagttgaaatcgcgtttgggaggtaataggagaaagagatcggggacggcaggcggagaaagtgcggtttccatagcgccggggagagggcggacccgcgagccagcggtccctgagccgggagaccgcgcgggcgtctctccagcccccgcaggagcgccgccttccttccgcaggggcgtcctctccccccaccgctgcaggagcacccccttccttcctcggaagcgtcctctcaccacaccgcttcaagagcccccccttccttccacaggggcgtcctttccccctccgaggcaggagcgccccttttccccccacaggagcgccctccccaccccaggagcgccctgcgcccagcagacgggcaggtgggcgggcgtccactacctgtgtgcgcggtgcgggcg

SEQ ID NO: 10712 - DNA, 858 bp, Homo sapiens; identical to SEQ ID NO: 10710
  source 1..858: mol_type = unassigned DNA

SEQ ID NO: 10713 - DNA, 247 bp, Homo sapiens
  source 1..247: mol_type = unassigned DNA
ccggaaccttcggggaggattaacgccggcgcaccgtgcggccggggcggggcgccgcccaaactcaggccctgtgacagcgactgtggcggtctggaaagcgtgggcctcggtcattgggcacgagcggtcacgtgacagcgggttcctccaggccagcgctggtggttgagtgatgtaatcacgtggggtctgaagtcttcgtgggtgtaggtttcttcgttatgctgacgacaggcagtgcccg

SEQ ID NO: 10714 - DNA, 224 bp, Homo sapiens
  source 1..224: mol_type = unassigned DNA
acgcccgcccctcttccgggcagccccttccacccaggcgggatctgggtccccgctggactcagggccgccttcccgcaggcggggccggcccggcgcgcaccttgtctcggatgccctggcgcacggcctcgcgctccgcctccatcttggcgtacttggccttgcgctcctcctccgcctggcgcagcgcctcctgccgctcctcctccttcttggcggcg

SEQ ID NO: 10715 - DNA, 1174 bp, Homo sapiens
  source 1..1174: mol_type = unassigned DNA
gcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtttctcattaccgacttttcttccagccggaggggaggaagaattcaagtgggggagggcgcgggaaggggacgtggagggaaacggaagggctgggagtggggtaggggggcagtggcgacctccggggggggagggtggcggacaccagaccccagggccgacagcccgggagggaccgggttccaggaccccagctgcacaaagccggcccggggagggggcgataaggagcgagcctcgggtcggcccggcaccgctgcttcggctcagagtccttgcaatcgcttggcctacgaacaacctaaatgaaatttagggttttattgaaaaagtcccctggggcctaatttagcctctcgactccagcctatatgcttacaagtcctcaggggactccggctaggaagtcaggagtggggcccgtgcgtccccggcaggacctagactgcctctcggcgcaggcggccctaacaaagaagcccacgaggcggtcccgggcgcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcg

SEQ ID NO: 10716 - DNA, 8657 bp, Homo sapiens
  source 1..8657: mol_type = unassigned DNA
ccggaccctccctcgggtctcccgggcgctccgcctccccggggctggctctccctcccctcccgggcgccgccggccgcgggccgcctacctttcttgggctcgtagccgccgcccggggaccggtagtgggactcgagcgggtgcgcgcccgccttgcccgcgtcgctggccgcctttggcgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcccgggcccaggctcggctgcttgaggtccgacgtggcgatctcggccagcgaccacagcttgggcttgctggcggggggcggcgcgcccggagacgtccggctgccctggggcgtcttgcggccaccgcggggcgcggcctcgggcggggggctcagcagcggcgcctccaagccggtaagcggcgacgaggtcacgggcttgggcggcgccaggccccgctcgccctcctcgtcgtcgtcctcgtcgtcctccaggtcgtcatacttgtccttgcactccgagcccgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtccggcgggcaacgtcctccccgccttagctctgcgccccgcctgggaagaaagcgccccgagaccttgcgccggccgctgcccgctcaccttcgtcctctgccgaggtctccgtgccctcctgcgccttgtcgggactctcgtccttgcttctggtagcgtcgccctcgtcctcgtcctcatcttcgcttttgtttctcggggcccaggtcatcttgttctccttcttgaggcgccggcgcgcgttggcgaaccaggtggagacctgggtgagggtcatcttggtgatgatggctagcatgatcttctcgcccttggtggggtaggggttcttgcggtgctcgttgagccaggccttgagagtggccgtggcgtcccgcgtggcgttcttgcggtacgcggggtcgttgagctggtacgggtaggccgcgctgccgtacgggtggtagctgatggcgccggtcatgccggtggtgtgcgcgtcgtagggtgcgccctggaaccaacaagagcctgtgagtggagtatgcggagaccccgcgggcaaccagccagaggatgccacccctccgcccgcccacggccaccgttccccccgtgagtctggctctggggctgcgcttcccgccgcaaaagagcaggaaaaacgcagtgtgattcgggaccagctgttgatcacaaaaagtaccggagttttattctcgaatttctgaactatttcactttcctaaaatgacccatcttcccctaagtgttccggagccgctcgtggcaatgtacacaaacccttgcacgtgcgcgcacacaggcccacaggtagctctttgatatctaaatttctgcagatgcttggagtgcggctgcctccccctactccctcttcccctcccttatatggttaaaaaaacaccccagagcccccaattcactattcactgctctaaagctgggcaaatccaatttgcaactcagaagccagtcaccgtttcgaattcttcaaatacgccgtaattagcattttaattcatcctttaacgtttaaattcgaggcatttgcagccttcgccaaggccccagcgactcggtcgctgcccagaaattccgccgagggccggcagtcgcgacaaccccgtaatggcctcaatcgcccgtaacgtgcttcgccgcggcccgggcctggcccagctcagtaacctcgagactcgcgagccgcccccaggtcgccggagcaggagctgcgctcgggccacggaggactcaggcggcccttagcgggtcacgcgcccgcaagcacgatatttgaaagcatggtccgctggacagagtaaggccgaaacctgggcgcctcgggccggactccggagccgcagctgaatgctcggctcctgggcctaactcggtgacccccaccgccctgagccccgcgagtgaatgcgaaccgcccggccgtcggctcagaggccgcagtgacgcggaccctcgcgccccacgccaatgcaggcgagcacacagcccgctccgaacgcctccccaggctgcggtgcggaaaccagggacaaacggcgccagaccccggccccggcggagacgcacttcccaggctctcagagaaaatcagccggcgagccgaggggacgcgcggggggcgcgcgggtcccggccgggctcagggacgtccccgcctgccgcgctgccctccccacccggggcccggctcagcctgcggggcggccaaccgagccggcgactcctgagtcgccagccgcgccacattcccggcggcccccgcccgccgaacccgagccccgctccgcctgagccccgtctgggtcccggcgcccaggagtcccgcgtcccgcccgcgcccggttaccatgtaggacgggaagccggcggcggcggcggcggcgtcggccgagtactgcagcgggctcccgaagccggtggccgcctgcgccgtgaaggccgccgagcccgggtaggggctgaacgccgagcccgacgccgagcgcgccagctcctcgctgcgcggagccgccaaagccgacgcgccgtaggccgggcacgagtagagcgccagcgagccgggcgcctggtacaggtagccctgcgggtaggacatggtgggcgcggggcgcggggcccgcgtcacgccgagcagcgggcagggcgcgcggcgccctccatccacgcccggccggggcgcggcgcggcggcgggcacccggacggccggcggaggcaggccggcccgggtactagcctgggcggcccgcgggccggggcggcggcggggtggcggtggcggcggcagcagcgcggagccggtgggcgcagccgcgcgccaggccggcggtcggggtttgggggagtctggagtcgggagtgaggagttgaggaaggagcgctcgagtttccgagggacattggaacgcgcagctgtccatcacgcgctcatctgcatattcgggggcccgcccctcccctgctccgcccgctgcagcctccgggccgcggccgggggaggggcagagagacgggagggaggcgggggagggcggaggcgacggaggcgggcggcgggagggaccggcaggcttttgtggcgcagccgcctctctagcagctccggccccagcccgcggctcgcggacctgcagcccagcccggccgcgctgcgtgccccggcgcgcacccctcccactcccatccactcggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcccccaccactcttcctacaaaccacacccccatcctgcacacatcctcttcaggccatctcaacacacgcacacgcacacacacccacgaccacctctccctccacccacagacaccccgttcccacaggctgggccccctgcaacgacccagcggggggtttcaaccttgttgcgactccacatgggacatcctaattcagtccaggacagatatttttaatcaattactatagagctgaaaaacagagagagagagaaagcagccgggttgggcaagccgtcgacagtctgcgacatttttgcgcttcctgggagggaattcctccaagaagaggggtaaatgagaggcccacacgctggatggcaaacacaaacactgtcagatcagatggcaacctttagggttcctttacgatcagatcagtttaaatgaaaaaaaaatcgggtgtaatttttatcaccagggagcactggcctggagtatttccatttctaaagagcggttcccgctgtggtttcattagcatttggggctcatcctccctccccctcccttgacccacccccctccccccgccggacctctgccaggggcagaagagaaaacagccagttattatacaaacatcctcagtttggagctggagtgtctgctctggatacagtcgattctgacatcaattaaatatataaccagacacgtgcagtggcggggagggtcccctcacccagggtgcatctccagaaacgccgcctgcccttccccctctttagctcagtgttgggagtttgaagatggcctcttcccgtcctgtgtgtattttccccttagcaattatactcctccactgaaatctatatgttccataccgctgctgcctgttactaataaaaaccgtctaccttgcactattaaacagtcgactcttactacatgccgtttttattggtagtgactgtagcaaattaaaatgcctacgcagggacattaaaaacttaacactcgtcattgttattgaaatatataaactacgttttgctttaaagctctctgatattaaagaaaaaaatcacattccttcttcttaagttaaagttggcttggtcttcttcttaaaaaaaaaaaaaatcaatcatgagaaaacatgctgccagcgtggagtcttggcgcggcggtcccggcgaggctgcctgagagggtggcgggctcagcccagactccgtctcggggccacgagggctgcaaggccgcggctcccgaagaggagggcctgggatgttttgctcaagggcgaggcggggtgctcaggcctgtggggtcgctggggagagcccggcacttggcttctgaggcttttcagttgccgtccgagcaggagggagggaatgagcaggcacgcagggaaaacccagtaactgctttgcaaacgcgacccctggtcacaataacccaggcgatgggggcagtttcaggttcctggtgggccctgccccctttcctaggtgtgccctaggaggtggggaaaaaattaacactgtttctatttttctttattgtccctgcaacagccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggtcgggagcccctcgtggccaggcgtccgcgcggctcaagaccgaggtccgccacgctgggccgctcgtgggcggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcg

SEQ ID NO: 10717 - DNA, 1059 bp, Homo sapiens
  source 1..1059: mol_type = unassigned DNA
tcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccg

SEQ ID NO: 10718 - DNA, 1663 bp, Homo sapiens
  source 1..1663: mol_type = unassigned DNA
ccgcctcccggcccccgccccccgctccccgggtggtgaacgcctgaagagggaggcgtggtcccgcgcaccttgtctccggccgcgccaccggcactcacctggctgctgccgtgctcctcgcccgtctccggggcccgagactccgcgggactccgcgccggctctgcgggaggaggcggcggctccagcagctgctccaggcaggcggtgcccggcagagaggagctcttctggtggcacaagtgcgccccggggccctgacgccgtgcaccctcatctcgggcgcggtcccccctcgggggaggctggggcgaggaggacagggaggatgaggcggaggaagaggaaggagctgagtcgggggagcgtccgccaggaggcgtccctcccgctgctcccgaggccgccgcgggcccctttacggcggggagcaaatgctcgcggatccggcggcgtagcgtggacccctgctcggctctgccggcgccgccgggctccaggggctccggcgacgagcagcacaggttgggctgcgaggaggagaagactcggtccagcacttgcttccgcttcttgaagccgctccacctgctgcctgcaccactccccctggccggtgcattccctgtgcccaccgggggtggcggggagggcgacggggtgtccgcagtgcggcgctctggacccccagcgcgcccgcccccgccgcccttgctcctgcccacccccagctgcaggttcttccagagccgggcctggaaggaggaggacgccgccggcggctctggctcgcccgccgcggcagcccggggctccatcctccaccccctgctcctcctctcccctcctcctcctcctcctcctcctgcttctcctccctcttcggctgcacctcctcccgggtccccgcggcgctggcggtggcggcggcggcggcggcgggcgcagcagcagaaaccgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccccaggccgcgccctggctccctcttctctctgaccgagctcgggaagctgcacgcaccggggcgtgcgcgtccagctgcgccagggaccgcacccggcgccctctgggcagcacctgtcagcggcgggggcggctgcctccaaattgggcgcgcacgcggctcacacaacaaggcgcgtctggctggagactccggggaccagcagtccccctggggcgccccgggaccatcctccagctcctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcg

SEQ ID NO: 10719 - DNA, 2065 bp, Homo sapiens
  source 1..2065: mol_type = unassigned DNA
gcggaccgcggcgtccctagggaacacacccacctagcaaccgagaccagagctggagcgctgcgcctttaattctggggcgggcggggggcggcgggaatttctgctccggttccctctgcatcgcgggggcagctgtcacctgtaaggcgagcgcggcgcgggggatggaagcaggcgcccattggacagaatacaaaggcagaaacctaccccgaaggccggggcccggcggggcgctgggggtgggcgctccccgcggcccccggcgcccttcgccccgagacgccccggcccagcggcactggcgcgaccgaggtccagcttcggggacacgcccggctggccgcggggaaggcaccaggtgagcgcggccgcgcctcccggaaccccgctcccgcgcgtcccgcggcgacgcggcgcccacccgccccgggagccaggaacccagggccccaccatggcgctggccgccgccgccgccgctgcggctgccggggtgagccaggcggcggtgctgggcttcctgcaggagcacggcgggaaggtgcgcaactccgagctgctgagccgcttcaagccgctgctcgatgccggcgacccgcggggccgcgccgcccgcagggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggagctccgcccttggtccgggtgccgcggccagtggagccgccaggggacctgggtctgccaacagagccacaggacaccccgggggggccggcctccgagcccgctcagccgcccggggagcggtccgccgacccaccgcttccagcccttgagctagcccaggccaccgagagaccctccgcagacgcggccccaccgcctagggccccttctgaggcggcatcgccctgctctgatccgccagacgcggagcccgggcccggggcagcgaaagggccgccgcagcagaagccctgtatgctgccggtgcgctgcgtcccggcccccgccacgctccgcctccgggcggaggagcccggcctgcgccggcagctgtcggaggagccgagcccgcggagctcccctctgctgctgaggcggctctcggtggaagagtccggtctgggcctcggcctgggcccgggccgctccccgcacctgaggcgcctgtcgcgcgccggcccgcgtctgctgagccctgacgccgaggagttgcccgccgcgccgccgccgtccgcggtgcccctggagccgtccgagcacgagtggctcgtgcggactgccgggggccgctggacccaccagctgcacgggctgctgctgcgcgaccgcggcttggcggccaagcgcgacttcatgtctggcttcacggccctgcattgggccgccaagagcggcgacggcgagatggcgctgcagctggtggaggtcgcgcggcgcagtggcgcaccagtcgacgtgaacgcacgctcccacggcggctacacgccgctgcacctggctgcactgcacggccacgaggacgctgccgtgctgctggtggtgcgtctgggtgcccaggtgcacgtgcgtgatcacagcgggcgtcgcgcctaccagtacctgcggcccggctcctcgtacgcgctgcgccgccttcttggcgatccaggcctgcgaggcaccacggagccagatgcgaccggtggtggaagtggcagtcttgctgccaggcgccccgtacaggtggccgccaccatcctcagttccaccaccagtgcatttctgggcgtcctggctgacgacctcatgctccaggacctggcccgaggcttgaagaagtcgagctccttcagcaagttcttgagcgcctcgcccatggctccacgtaaaaagacaaagatccgcggtggtctgccagccttctcagaaatctctcgtcgacctactccg

SEQ ID NO: 10720 - DNA, 3487 bp, Homo sapiens
  source 1..3487: mol_type = unassigned DNA
tcgagagaaggtgagctcggcgggcgcagcgggttgggtgggtgtggcccgcggctccgggaacagacccaaggccccgccaccgccggctagcagcccgacagcccgcccgcctggcgagcgcaggctcttcttccagaaactgcgaggatccgagcgtactgtttgtgcaccacaaggtcaagtcgggaagtggagccggaggaggaggggcgaggaggcgaagggtggggagaggggcgccccgcttcctcgccatgtgccagcctttggaagttacccctcggtttttaacctttcggggtaatgggaaggaagagcaaggaggaaggggtcgccccggggcaaaatcctgctggggccaggatgtgcaaccacccacccacccgctcatcactgccttctccaccccccggaaatgcggggcagcgctaggcgccaggaggcacccgggaggggggagggggcgacgagcccaatggggaccctctctacggaccgcccctcttttcttgaggtcgcctacaatttcaagttcccccgcccggaatgttagttttccatttggagtgggtgcggggaggagggccgcgccccctccccaagactcgcgttcgcccctccactcccctcctgccagcactttctgctcacttctggtgctgcaaaacgccacgcaatttattcgattcgcattttaaaaccagcgattcagaagcagggcctagggcgagggtcttccagcgctggagccccggggggcggggtgctcagtgcaaacctcgttccctccgcgagtgtcgcctccaggctgttatttgcaaagaaacgtctttttgacgcagggagaaatggcaaattttaagtacgtcattaatatggcgccaaaagatttttttaagtataagctcgcttttttttttttttaaggttgcggggggcgccgcccgggtctggggcgcgtagggggcggggtgtgagcagaaagtgtgagtgaaagagtggaggggcggggtatgtgtgtgagtgtgtgaagtgtgagcagacctgatgggacttgcacgggcgcagccgccgctcgggcccggccctggggacagggcgggctaggggcgccccagagtccatggggagtccgggcccagggtgccagcaggcgtggtggtggggctgcgagggagggcacccttcccccacggggcccgcaacgctacctggactccccgccggagccaaacaactgggcggggggttgggggggcggcgacgggggtgtcgggagcggagatccgagtgaataagaaaaaagtggctactccccctccctcgctcctcctgcccgcccccaccccacccccaccccaacacattttttttttctaaagagatcacaaggaagtcttggtttaaaaagaaacagaaacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggccgcctccctcgccgcgaccccggatggatgcgcgccccccgccctcccgcgccggccccaggagctcccggcttcgggagcatccttcccgcgccggtccctgcagcggcgcgtagccgagggcagcgcccgtcaggggggcaccgcggagcaaggtaagatccagcccccggcggatgggccctgcgcatctccacgacgttatttggcgtttttgcaacagatctgccagcgctcttcgctccctcgctctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaagggtgagcttggcgaccttctttattaatgactgcggcaaagcgcccccgggccggcgagggggcgcgggcgggcgggggcgcgccagggctgcaacttccccgcgggctccggccgggcgtaggggctgcggcgggagatgggtacggtggggaggtcgagcggcccgggcgggggctccgagaacctggagctatctgccctcctgtctccccgagtttcattttgttgatacgcagcacgtccgggcgccgaaccgggctgagccggtgcacatgacctcgcgctgggctcacgtgcagccggtccggtcccagacaccttccgggggccaccgcctccgccctgtcgccccctctcccggcccggtgcacgcgggcgctgcacgcgggggcagcatgctcggctcctggggttggaggctctgcacaaattagacagtttttttggaggggcgggggacaccctttccaggtgagtgtggagggtgcggagcctcggcgccaggggtgaggactggggtcgggggcagcctccacctccggggccgcgcggtagtccagctggggagaggcgctgggagagtggaaatgtaccggcggcggccggagcggcgggtgcgcgcccgcggggcgacggcagggggcgtggcccttgtttaccttctcccaactctgccggttcgcgtcccgcttcagggacggatccgcagtccccagccctctgcctagggccctgcaccatgggtggtaccaggaagatgccggcttgtggcggaccccgtttgggacgcacacacctgactctcaaatgagtgacattgcagcccccgcccccacctagcgctgctgcagtccctttgccggatccccggccccgccccgcccccggcagtggcatcttcccggcctcacctccttcctccctctccctcccttcttcccacccactcgcctgcgcctgcggagcggcgcccgcccgcctcctccccgcctgggtgcagacttgtggctccccatggtttcttcccgcccatccctgggtcctgagacatcctctcctctcggccaagggacgagaggggtcaacttggcgattcgcagctgttctgccagaggatggggttgcctgcgagacagccaggaaggcttcactctagcttccagaggcccagccctgtcccctactacacacagctaccaccccacccgcccctggggctcggctgcccttcccggtgtctcttaaacccctcccccgacctgggtgttaagcccacccacctcccggcgccgcccccggtcgaacagcctcttgcccttccttcgcctgggccggagccccccgcagcctcctccggctcctcctcccggctccggcggtcggaatcacgccggcgcgcctccagcctgcggtcccgcggactgcctccaggggcgggctggaggcgcgcg

SEQ ID NO: 10721 - DNA, 847 bp, Homo sapiens
  source 1..847: mol_type = unassigned DNA
ccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggccggcgctgccccgctgcgcatcgctgggagtgcccaggtgcggagcgccccctggccccgctggcccgcgggccgggttggggacctggggcgagcgcaatggggcgtggcgcccggggaggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccg

SEQ ID NO: 10722 - DNA, 909 bp, Homo sapiens
  source 1..909: mol_type = unassigned DNA
ccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccg

SEQ ID NO: 10723 - DNA, 2150 bp, Homo sapiens
  source 1..2150: mol_type = unassigned DNA
acgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgtttgctccgcgccgcgcggcttgcgctctccccggaacgcccacactctcaatcgctacattgttgacattcggcgctgacgtcacccgctccccattcacaataactttacgggagccgggcagcgcacctccccggccgctggggcgcggtacgcccggcgactagcgtaagccgctccgcgaatggcgctccgggggctggggcggggggcgggggacgggggcgggcgcgcgcgctccgctggctcgcgggagggggcgcgcctcatgccgccgcagcagcagatctccccgctttgtgcggccgcgcggcccggagagccccctcctcccggcccggctgaccgccccgctcggcctggccttcccggccacgaaagacg

SEQ ID NO: 10724 - DNA, 506 bp, Homo sapiens
  source 1..506: mol_type = unassigned DNA
gcgcccgctgtccccgagctccgggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcg

SEQ ID NO: 10725 - DNA, 1503 bp, Homo sapiens
  source 1..1503: mol_type = unassigned DNA
ccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccccgctgggcgtggggtcggagacccggacccccgcaactttgggtgcccgcggcccaacagctgaccggccctcctggaccgagggtccactgggcccttttcccgccgcccctctgccctggccgtagacggtgaccttcggaccggccctggtcgagcctagtgcttgggtagggtccagggcgcacgggctgcgcgcgggctgtggatgcatgacgccgaatggtttgggaactgacttggagaggagtccccggtggctaagtccccgctccgcctccttgtcgcccccagccccacctcgcgagctcgggcattgctcggggctgggctctgggagaaagtcctctcgccttgcccagctcagagggcgtcctgagaagcttcaggtgttgtagagacgcccggtcggaggcggattcccggggaaagcctatttctgggtacccaggagcgcg

SEQ ID NO: 10726 - DNA, 907 bp, Homo sapiens
  source 1..907: mol_type = unassigned DNA
tcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgaggaaaggaggggacggcgctgcggcttcggaatctgtactgcgactttggcagagtaaacgctgcacttgcagcttcgaattgaatttcctgcctctcccccctcccttccctggccacgctcttccctcctcccctcactattttaccttaattggctctaaacgagggtgaaagttgagtctgaggatgccgctgccatagaaactgcatagcaaccaagggctggggaggcggggggggggggcggcaggtctttcccccccacccccagcacgcgcacacccttccccacctccccagcccgccgcgcctccccggagacccacaccgccacctcccgccgcagaacgggagggacaggaacacggacggagggaccgggacgaggggagggctccacgcagcacagctgctttcctgcggagcgttcaggagactcgggcacctctggaagcgctgcggactgagctgcccgcggctgcccccgccccgagggccgggacagcacctcaggagaagagggacgaagagggacgacagacaaatagctggggagaggcgggggggggcggcccgtggggtccgctgggccctacccagccctgcccggagctgcccgaaacagcactcaggcctctgcgggccaggatgaaaggcacgtgggccg

SEQ ID NO: 10727 - DNA, 1925 bp, Homo sapiens
  source 1..1925: mol_type = unassigned DNA
ccgtcggccccaagcaggaaggcgcccccggcacaccagcccctctcagcgcccccagcgggcccggcgcctggagggttaaggcgggcgcgtcccgcgggtgggcggggggggggggacgggaccggtgccgggagctccgctgccctggcgtcccctgggtccaggcccagtcgctccttgggcctctctcgcggggccgcctccgcctcctccttgccgagacgggcgtggggcacggggtcgccgcccggcggggagctcatccggcggcgcagacgccccgcggctccggggagggacttggcctgggccccggccccgcgctcctctggggaggagccgagaggctgcagctggcggcggcggccccgggcgggagggggtcccaggaagcggccaggccggagccccccactcggccgcagctgctggcctggccagaaccgagcgcgccctcccggtctccgccgcttccctctgcaaaccgcgggcaggaggagccctctccttagcgggcccggagctcagaggcgtcgcggggcgcggccgaggggaggaggaaggagagcgggagcgcagccggcccgggcccagccgtgactcgtggggcggcggctccgccaatctgtgggcgctgacgcggggggcggctccgcggcgctcgatatctgcccgcccgggacgcggggcgccgagaggctcggccaggcgggagctgcgctcggggcggccgctgcacctgcccgggaccccgccggccgctccccgcgcccaccccttccgcccttcgccccccccttccccccagccccggtctcccgggcgcggcgtgagagcagagcccggcccggaggagccgccccttccccgcccgcccgcccggcgcctggagaggagcgcgctgaggatcgggacgcctgcggccgccgccaccgcccaggcccgtcgcgccccggccgggatggacccacacgcccgatgagccccgcgccggcggctgcgagcgccgagcctccccctgctgcggccccagccgccccccgcgcgcccggctccgcggaccaggacccctgggctccccggctgagggcgcggccgctccggagaggccgagcggggacgggcccgagatggcgcggggacccagcgctccggcggcgggcgccctgcacgcggcccgggcccggggacagccccggagctggtagccgcccggcaccgatggaccttgacccgcgaggcggcgccgcgctcgtgcccagctgcagctagaggggcgcgcgggcagaacgcgctccaggcccgggccggcccgcgcggccatgaagatgatgctggtgcgccggttccgcgtgctcatcctgatggtgttcctggtggcctgcgcgctgcacatcgccctggacctgctgcccaggctggagcgacgcggcgcgcggccctcgggggagcccggctgttcgtgcgcgcagcccgccgccgaggtggccgcgcccggctgggcccaggttcggggccgccccggggagcccccggccgcctcctccgccgccggcgacgcgggctggcccaacaagcacacgctccgcatcctgcaggacttcagctccgacccctcctccaacctctcgtcccactcgctggagaaactgccgcccgcggccgagccggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtcctgttcaatgtgaacagcgacaccaggctcagccccaaagcggcggagaacccg

SEQ ID NO: 10728 - DNA, 1287 bp, Homo sapiens
  source 1..1287: mol_type = unassigned DNA
ccgtggctcggaagtggaccctgtccgacgcgggggtggtcgctggagggccgaggatgcctacacaggcccctggagggtgtgccttcggagtctgtctcgccctctggacccatgggggaccagcaacgccgtcacaccctcctctgtctctgccagccgctcccccgctcccttctcctggctgaggctggcaaaggcaggcaggcatgggggggcggggcctcaggagggaggaggggctggtgggcggggcctacggacacctcgccccgcccccagtggggctccgcactccccacaccccgcggtccccctaggtcagggcctctcaccaccgcgcccagaggccgggccagccgggcgtgcatcccaggggcgctccgtcccccgcggcctgggactctccagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggcccgcggggtatcagctgtattttcgaacccctgtgcttggccggggagttcccaaggctccactccgccttggagggggctgcggaagcccggaggtgacccgggctctgggaggggcgtccccaacgtgggggaagggagacaggggccttcgaagacagcgcgagactcggagggggtccccccgacctaagacgtggtaaactgaggccggcgaggagcgaggctgagtccggggaccaggcggcccctcactgctcctccggcccgtcgcccccctgcgcctgttcgtacgggcagggccggcggccgagtccagcgggctcggggccaggcctgggccccgggggcggcgcctcctcctccgcgccgtccccatgctcgccctccgcgtcgctctcgtccgagttgtcctcctccaagtagccgtcaccgcgcaccttgtgctggggccgcgggatgcggggctggcgcggggccacgccccgccgcagcttctgctccatccgcaggtaggagaccgcggccaccaccagcgtcaccagcagcaccgccagcttagcctgggcgtaaggagagggatgccagggacccgcggccgcctcgccccgcaccttctccgcctatacccctcgctgagataggcccttccctcctccgggagcctcccgggccacgcg

SEQ ID NO: 10729 - DNA, 2906 bp, Homo sapiens; identical to SEQ ID NO: 5279
  source 1..2906: mol_type = unassigned DNA

SEQ ID NO: 10730 - DNA, 2146 bp, Homo sapiens
  source 1..2146: mol_type = unassigned DNA
tcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcg

SEQ ID NO: 10731 - DNA, 865 bp, Homo sapiens
  source 1..865: mol_type = unassigned DNA
gcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgcgggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccggcgcggggagggcccaggcgcagtcggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccg

SEQ ID NO: 10732 - DNA, 865 bp, Homo sapiens; identical to SEQ ID NO: 10731
  source 1..865: mol_type = unassigned DNA

SEQ ID NO: 10733 - DNA, 1463 bp, Homo sapiens
  source 1..1463: mol_type = unassigned DNA
tcggggggccgcgggacgctcaggaagcgaagcggggaaggctccgggcgcgtcgcaggacccgcgctggagatgggtttgaagccctgtcctgaaaaagccggcccggagtgggctgtccccggtgtccctcgagttctcatgctgtcattcaagcagcagaggaagaaccgggtctggctcgggaagggtgggcttagggccaggggtgcaaatccctcggtaaaagccggcaaactaaaagtcgcacacatcccaggtcccggtccaggccccggcggggcagggtccccgaagtcccggggcgcgcagacgccggggcccccgggggccaagggaacggcgggacccgacctccctgccctcggcctcccgggccctcgccctccgaccagccgctgagtcgggggctggggtcgccgcttccgcccgcggcccgctgcccctccccggcgcgcgccatccggccgccggcccctcctcccgcggggggctccgtcccgcgccccgtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtactgggcggctcggtgtggtggcgggggcgacgcgggacccagtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcg

SEQ ID NO: 10734 - DNA, 1437 bp, Homo sapiens
  source 1..1437: mol_type = unassigned DNA
tcgcaggaaccgaggagccggccggcccaggcctccaaggtcacggggagggggtcagggcggaaaaggcagtggagtgagggtgccgccctcgggccgtgctaatcccgctccgctccgtgccgccgaggcggggtcctggccacgcaggaggtgcgcctcggaggagggcggcgagcggctacggggtggggagcaaggggcgcgcgggcggcaggcatggaacggacgcggcgcatctcgcccaccgcgggacgcccggacggcggccggcgcgcgcggcccgcctcgagcccgagagggcggggagacaatgcctgtccggcggggcagtccaggccgcacgctcccgcccgcggacacgggccgctcctacccgggcgagagggcagcggcgggaaggcgccgggagcgatggccaccccggccccgcgaggcgcggcaggccccgctcgccctctcccgcgcccgcctggcgtgcgcttcacccggcaagtcccggggccacagacccacctcctcctccagggcgccgccggagcccgcgccggagccggtgccggtgctgccgccgtgctcgccgtccggcttcaggttgctcatggtgcgggggagggggcggcgggaaggaacgcgagggcgagcgcggcgccggccccgcgggaagtgggaaggggcgcggggagcggtgcgctcgcgggtgcggagcgggtggcgggggacccacggggcagtgagaggggcagcctccgcgtcgggccagggtcacatcaagtttggcgggtgcggaaggtggggagggggtgcggcgggggaggcagtgggagccggaggggccgccgcctccgccttttcactgcgaccggcgagtgcgccgcggcggcggcggcggcggcagcggcggcggggggcgggcgccgggggagggggcgggcgccggcggcggggggcggggccggaaccggcctcagctggggcccggccagccccctcccccgcccgccgcgcggtctccgggggaacgcgcagccaatccccaccgcccaccgtgggctcgccccggccccggccgcggggcgccggcctccggccgggcctttcccctctctctcgcctgggtcagcgctctccctctctcctcttcccccgcgcccttctccacggcgagtttttaaactttgatgaactcgcccggcgaactttcttaaaggggccgcgcgctgcgcgccccagcccgcgggaggtggagccccgtgccccgcacccagcgccccggtccctgggcggccctgcccgggcggcctcgcgcttagggcacccgcagcgaggtttccgggccgtcgactccccttgtatcttgatctagggttttggggttcccgacgcactcattctgcccctaaatccagtcgcgcagacctcagctccgggggaccg

SEQ ID NO: 10735 - DNA, 717 bp, Homo sapiens
  source 1..717: mol_type = unassigned DNA
gcggcaggggcgggacccggaggcggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccggctctgcaacagctaggcgaggcacatggggtcagcacgcccgcggtccccgtgcaggccgctgcgattcagggatcaagtccagggtcacccttcaccacccatccgggaagcaggctcacccctgtgaagaaggccatagccgtgagacgctgcgggtcgtccgcgctgcgaagccgagggagcaagtctgcgaagaggcctcgcaggtggtggtcggcatgtgccaccatagcactggggtgggtggaaatgggagctctcgctccgtttggcggcctttctcctcg

SEQ ID NO: 10736 - DNA, 1713 bp, Homo sapiens
  source 1..1713: mol_type = unassigned DNA
gcgctgcagactcgggtttccttctcagtctacgcgcaagccgggttcggcccacacccaccacacccctccggtccccgcccagcgccgctcctcctcccgggcttctccagcaccgactcagcacctatcagcgccgcccccaggcccctggcccagcccatcctcgggcacgtgtgagtgtgtgtttgtgtcagtctgtcagtcccaccggggaccgggctcgcttaccgagagagaagcgctaacttctgctccagcatcatctccagcttctggccctgtttggagatccagtggtccactccgtgcaggcggtagcacgtctccagcatcaacctgaagtccgccacgaactcggtgatgcccccgtactggccgctggcgaacttctcttccatctgcagcagacacatgccctgtccgggctgctgcgggaaggcgcgaccgccccggcccccgctgcgcggcccttccgccacctcctcctccgcggtggcaacgccccccaagggctgcagaaagggggcggtgaggccccggtgcttctcctgcaggaactcgcccaggatgcggtagccctgctgtagctcgtaggtcagctcctgctccttgcagcaaccgcctccgatcaccatcgcctccatctcttcctcctgatcgtccgcgtcctccagcgaggaggcactccttccgtgggccggccctgaggtctgggccgccgctgccacctcctcctcgtcgtcctctccttcggccgccggtggcggccgctcttcctccccagccggctccatcgctcccggcgtcccgggcacactcatgccccggcaggcctaggctgggcggtgtggaacagccgctcgaggtgctgggggacgcgtgagcgcgagccgcttcctcacggctcggccgcggcgcgtagcccccgccacatcgggcctggctctcctcagccgccggctcggctcggtgcgcgcgggggtcttgagctcaccgccggcggggcggggttacatggcgcgcgaggaggggggagagaagaggagagcctaggtgccctcctctcccctcccccccggcggcggcgcgcgcacggccctcgccggcctcacccctccgcaccccgcccgcctgctcttcaccggccaggccctgccgggtcgccgcggcctcggcgccccaccccctcccgggccagcggggggctgggagggggcgaggaggaagggggttctcctctcccctccccggagggggccgcagcggcggctccggctcctcctctccctcacaccccctcccgcccccctctacctgcgggggacacgggcagaaggaggcggtgcacggacggggcccggcgacaactgtcagttagaagccccgctgggcggtgaggggggagaaaggggaggggcagggagagaagggggagggcactcagccccccggctgggaagagctgtggagagaagcaaagaaagaggccctgtcgccatccccggtgcgcatgcgtagtagaacaattcccccctccccccccgccaccatcgtgccccgccccgctacgcaaaaggaagagcttcggctcagctacaggcccagaagcctgctagggttgcgcggaccaatgatgtaatcaatcgtaggccaatcgaacatgttgatggagggggaagcaaggcgcctgcgcagcttaattcgctaccg

SEQ ID NO: 10737 - DNA, 699 bp, Homo sapiens
  source 1..699: mol_type = unassigned DNA
gcgcgctcggaaagccggcttgggtcctgctaattattctgaaggcaaagtacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtctcgctcgcactcacaggcacacaccccacgtctccagcagctgccgctcggcctcacgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcacgattccagggatccagggtaaagcggttcgcgcg

SEQ ID NO: 10738 - DNA, 1191 bp, Homo sapiens
  source 1..1191: mol_type = unassigned DNA
tcgacctccaccaagcggatggccaagcgccacccggaagtgtccactggtgggggcgggaaggcaccgtagtccaaggtatccgcgggcagggagcgggccagggcgtgcgcgaggtcgggggtagctgggaacggaggaggaggggcccgctcgaggctccgcctctcaccggctgcggcctcggctacagccagggcccagagggctccgagtcccgggagcggaggccggagtcgggttcctgtagaggctgctcctccttgtccccgctcggacgtggtccccgctgctcgaggtgcagctgcagcagggcccggcggtacatggcttccagcttctcaagtcgggccctcagggccctggggctgcccggctcgtcctctcggccgctgtctctagccctccggttcgtgctggcctcttcagggacccggcgtgcctccgcgggcgtcccgttgccgccttcgccggggagccgcaaagcctgacggaagaggctgcggttctcgcgcttcagccgccggttctcgagccgcagccgggcgttctcctgacgcagccgcgcgttctgccggtcccactcgtcccgcgcacggatggcctccaagtggctcgccgccaggtcggcaaaccgctcctccagctgctgtcgggcgccgtccgcgcggcctcgccagcccacgccgccgccgccgccgctggggctgcccccaccacgagcccggccggagcggcctggccctcggccgtccgcagcaccgtccccgccgcagcaactcccgcgcctagtggcgccaccacgcatgcgccacatcggtcccatcccaaccgcgccgccagccccgtgggctgaggggccgcgcggccaggcgcgggcaagttcggggctggcagggcggccggggtgacgacggaggaggagaggaggtcgcgggcggcggctgctggcttagagccaaaggaggccgggaatttgcccagactgaggcgtgtcctgtctcctgtggtggagctgccccctgggcctgctctctccaggctgcgctgacacacagttcccccggggagtgctttgctgttcagccctccggctgcgcgggaaaaagcgtgtatcctcagctgagttgtgccagggcgcttccgtgcaggcctgggcactgcaggaactagccgtcctcgcccgctccg

SEQ ID NO: 10739 - DNA, 536 bp, Homo sapiens
  source 1..536: mol_type = unassigned DNA
ccgcctcctacgtgctcgcgggggggggcggggtcggtggactgggcgtgagttaattggctggggggcggggcaccacgggttggctccgcccaggcgctcgcgcggatcccgggtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccg

SEQ ID NO: 10740 - DNA, 728 bp, Homo sapiens
  source 1..728: mol_type = unassigned DNA
ccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgaggtgagcgcggagctggccgagaaggggcaaaggagcggggcggagcggggccagagacgtggccctctcctaccctcgtgtccttttcagatccacgtggttcacctcagcaccgcctttgccagagttgacgaggccttggggcgcccgggaggcctggccgtgttggccg

SEQ ID NO: 10741 - DNA, 1431 bp, Homo sapiens
  source 1..1431: mol_type = unassigned DNA
tcggtcggtcctccctcccccaccccctgactccggccgctccacggaccgcagggactgtcctaccgctccccttcacgcaaccatcagagaatcctctcaaaaacacagacccgatgaggagtggcttccccgcctttcccctgtgccgagaagggatcccggtcgccaacaacaaagacgcttcccgctcccctccccccgccggcccgggctcgtccctcccgcgctgcggctcccggcctagcgccccctccccgagccgggctgcggcgtccccaaaccccgaggccgcacgcacctgcacctgagcggcccgggccgaagcgccgggcagaaggggtcgagagagaaccgcagccgacgcgctgtcctccacaaggcgagatccgcgctccgggcgccgtccgactctctccgcctgcagactggcccgacagaggagcggggaccagggctacagcccccggcgccggggcgaagaaggacggcggcgccccaggggccccgctcacgctcccgagtctcgcctcgcgccggccctgctcctccacaagagctcgcgttctgctgactaacggccccggtgcggggcgctggagcggccgccgctgcccgtcggttgctctcgggcctcacgtcccgcgcggccgtggtcgcagccgccgccgccaccgcctccctttctggcactgcagacgccacccagacctagccaggtcttccttctctttaatcctgctttctttgctcctcctcagcctgccaagcgcgaggctcgttccggtagcgggaggaagactggaggggaacggaggggacgagcacaatccccactgagccaggagttggccactgactggaggaaggtgccaaagctgaccccggctccagcctactagcgggcggggggagagacggagcccagccttgcctcacttccaccaatcagaggccgcccggcagggtgggaggcgctctgagctcaaggagaggctgagctcgctcagcaggaggcggggattgcggaaaagaagaaccaataggaacaaaggttccccgcccctttgatttgatggactacacattcgggccaatgggggaattctcatttcgaagaaagtgggacttgttctccgggtttgagaaagaggctgcgcggagccggaggggtcgaggctgcgccgcgtggagtggcttggcttaacagcagggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcg

SEQ ID NO: 10742 - DNA, 588 bp, Homo sapiens
  source 1..588: mol_type = unassigned DNA
ccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcg

SEQ ID NO: 10743 - DNA, 1203 bp, Homo sapiens
  source 1..1203: mol_type = unassigned DNA
acgcccaaccctcgagtctgcacggtgcagtaccgtctattttgggtccagggtaacctgggtgcaaacgctcctgcgggcggaccgcggggtgggccccgggcacacaggaggatcagcagcagccggtcggtaggcggagcgctgccagaggcttgggcctcacaacaaccctcacaggaccaaaacaaacggcgagacgggctgcgcgcacaatagcatacccgggcggctagccgagtcgggggtctcggctcgcggctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggcccgggcggactctcatgccgagagaccggagcggaaactggggaagctgccgcgcggagccagggtcagcgaggcccggcccggcccctgccgctcatggcccggcctgccgccggccgctggctgtctggcgaagcggcctcggcgctgccgggccaggggtgccgtcaccgtcactgtgcgcgcccagagccgcacacgcgctctgaggcagtgaggggcccggtactctccatccccagctcgtcgggcctcctcggccctccccgctcggggcgctgctgcgacggcgacggccgccgccctagaacccgcaccgccgcggccccgcgcttccccgcctcgcggcggcgcccaacgccctcgcgcgcgctacccgctcccgcgcgactggctgccctccgcgacgtccgcgcgccttgaaggccgcagcgccagccggctccctccgccggggaaaggagtgcggccagggcttggcgcccgcagctgggcagatcctcggccgctcctgaggcggggacgaagggcgcgacccgctgcggccacagcgggttacgggctgcgggctccgttctgggcctggggagcagattcgagccgaccacgccccgggctccaggccgctgggaggcggacttcagagaagcg

SEQ ID NO: 10744 - DNA, 5370 bp, Homo sapiens; identical to SEQ ID NO: 5329
  source 1..5370: mol_type = unassigned DNA

SEQ ID NO: 10745 - DNA, 1691 bp, Homo sapiens
  source 1..1691: mol_type = unassigned DNA
gcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcg

SEQ ID NO: 10746 - DNA, 1223 bp, Homo sapiens
  source 1..1223: mol_type = unassigned DNA
gcgctgtcacggagactccggccgccggagaccccgccgcagcgaggccactgggctccccggtcgcggggcgggagcggcgccgacacggggtgccaggaggacccaccgggcggaggagggggcctgtctacccttccgcattttcctgggtctctctcccgggcggtgacgtgacgtgctgacggcgggcccgtgccggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccggtgagtcccgggtgccgccgcggccgcggggcctagtgcgcgcacagcggcctggtctcggcctggtcggcggcccgcaaggcgccctcccgcgctaggccgggcggcgtggcgcgcggcgccgagcaggccccgaggaggccgcagttaggcccggggaggagcccggctgccccgagcggcggcggaggcgcgctccgtaagcgggcgggggttgggggagggtcgcccggttgtgccggaggcggtcgaggggccccgggtcggctccgcggccgacctggggcaccgcgccggggtgaggcctggcgaggaggcgaaggctgcaggcgtgaggtgaaggccgcaggccggccgggccgattttcgctatgtaaatatcggtgagggggggggagggacgggggacaagatggcggcggctcggcgcctgctgcaggggacgatagagggggttgccgggagggggagccgccatcttggaggcggtgtctggagagaaaattccgctacagcccgtgagggggggtgggagagcgggcggcggcggcagcggcgccggtgacgggccccggaggcccggcgcggcggcgtgtgcgcgcggaggggcgtgctcgctccccgtggcggccattgcccttgccgccatgatgagcgctcgggctccaggcgctcggcggcagcgccaccttcctgccttgcctcccgcagccccgtgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccg

SEQ ID NO: 10747 - DNA, 1103 bp, Homo sapiens
  source 1..1103: mol_type = unassigned DNA
acgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagggagggggcccgaggcgcccccggcccgccctcctcccggtcttcggatccgagccggtcctcgggaaagagcctgccaccgcgtccccgcagccaccctctccgcgtgcccggccctctccagtggcgggggcacgtgggcgcgcggggtgcgtggcaagccgcccctctccccacgcccgtccggccgtctcccgcgcgcgcgccccgcacacagcctccgtgcagtgggcagagcccggccccgcgcgcgccccgccccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcg

SEQ ID NO: 10748 - DNA, 616 bp, Homo sapiens
  source 1..616: mol_type = unassigned DNA
acggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcg

SEQ ID NO: 10749 - DNA, 206 bp, Homo sapiens
  source 1..206: mol_type = unassigned DNA
gcggcgggcggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcg

SEQ ID NO: 10750 - DNA, 1141 bp, Homo sapiens
  source 1..1141: mol_type = unassigned DNA
ccgcagtctgggagcgcgcggccccggggatggggagggggccgggaggaggcgtgcggctctgggggcgcgcactgcgggagcgcgcggtggcgaggatagggcgggccggggttcgcggggcgaaggcgcgcggtgcccgggggagggcgggccggggcgcgcgggccggggcgggggcgcgcgggccggggcgggggcgcgcggggccggtcggcgcgcgggggcggcgggcgcggcgctgccaatcgcagacaaaggccgtcccagtgaatcatgtggtgccgggggaggaagtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgagtttcagagaggctcctggaggcgctcacctggcggggtggtccccgcggggcgcccgaggcaggggcgatggcagccgcgggggcgggtccggccctagggctgagagtgtagggagaaggcgccggctctggggtcgtccgaaccctgtcctgtttgcgggcatttgtcataggaaaccccctgccattcccaaaaggggcaaggagaaggcaggggagggctggaggccgccgctcactcgctgcccctggctccgcatcgtgcggtggattcggggcgcttctccgtgcgcagcgcgaagcagcagcgcctgcacacgccagttagtacg

SEQ ID NO: 10751 - DNA, 1819 bp, Homo sapiens
  source 1..1819: mol_type = unassigned DNA
gcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcg

SEQ ID NO: 10752 - DNA, 1813 bp, Homo sapiens
  source 1..1813: mol_type = unassigned DNA
gcgcccagtttcgagagcctatcacagctcacgtctgggcgcgcagtacccccccgacactgctcctgttgtgtcagatagtggcagtgttgagcccaggaatacgcgcggagcccgcggcgatccccgcggccgctcagtcttcgcggcggactccggcgcgcaggagccactgggccgcaagggcgccggggagcgggaggggcgctgggggcggcaaggggtcccagatcccaggccacgaactgttttccttttccccgggcaagagccccgctcccttcaactgacagaaattcactggggcaggggggcgagtggggagagaggtcgctcagggctcgctactggctgcgcctcccccggctctggtctgggaagcggctctgggccctccgggcgagcagcttgggcgccggcgccccctgcgaggaagatcgcggggtgacggtcggtacccgttcggctgggccgcgctgccgctccgatccacctcccttccgcgcccgcgccctcccccttcctttcactaggagtccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccggtccgggcgaggttgcaggagatgggcgcgattccggcgggccggcgggtgggcggcgatgctggctcaattggagtggctcgttggtggcggcgatggtggaagctttgggctggagggctgggagcttattgagtttcgcctaatctgatctaccccccctccgccccccgccttttgcaccctccctcggtcctgcagccggctggcggggctggcgggtttggcgttggtggagtggactcg

SEQ ID NO: 10753 - DNA, 1872 bp, Homo sapiens
  source 1..1872: mol_type = unassigned DNA
gcgccttgccagtcaagtcgggcagccagggacccacggagcaaagacctaagcgggcatggctccgataaagagtgaggtccgtttcctccctgttgcttcgccagttactaaagatgagtgaggcggaaacacgacggtggggagcgcggggaatggaaaagccagaaggtctcgcaacaacccggtgtcacctgaatgtctgcaaaacgtgccggcaaaggcagccatgcccccaccccgaccctggcccagctgcccgggacacgcgccacgcggcggtcgttaacactcaggggacagacaacagtcacactgcactgacagcacgcagacaacaccggcgaggtgcacacccacacatccaacgacaggctccgccactgcgaggcggctgccaacctggagggaacagggaaagccagccgggtcccagcctccttcctccgaagcacgtttacctaaacgtcgcagtttgcgtccaggctgctcccgctccaccctaaagattatgtcaacgcaggaactgtgggtgcgcgcgggcggcccggcggggagcctccccttctgggtcccgtcggttttatttcgggagcgggagggggaggagggagggctggaggaggggaggggaatcccaaattaaaataaccctcagttatgaggacgttcggtggcatcggatattcacaccagcaacagtcacatcacattcgccttcgccagatggcggcgggttcaacttcccgggatctcgcaaactcaggctgtgcgcccgagcgcgcgccggagtgtgggcacgcgggcgggctggggactgcgggagcggcgcggcgcggcgcgagcccggggcgagaacgggggcgtggggttggggggcgccgggctcaccggttccggacgaggaggtctccgtccccggggagcggcaccgggcagtcccggctcagggtgacggcctcgcggaagttggggctcagccgggtcaccaccagcttctgcatggcttggggaatggcggagccctggaagtccaggaagtggcgggcgtacgacatgtccacgatggcccgggccccggtgggcaccagccgcagcatggcctgcgcctccgcccgctctctgcgccgacgctggccggggtcggcccccgcccgggccgctcggctcggctgtgctctgctcggctagggcgggcgggtccgcccctcctccggccggcgccctccccctggctccccccttccccgcgtcgcccgctcccgctccccccgcctccccggcgccggcgcagcccccgcgaacccgggcgcaccaccccgggtgtcccggcctggggaccgctgccgccccggccgctgctcctttaatctttttgttttggtttgaatctgctcggcgcagactggccaaggatcctctccgccctcccccttcctcctggcgcgggagaggcaccggatatccccaccctccccgagctctaaaagccggatttgactcctctcgggcaagggtggcgggggggacggcgggcaaggggggacgggggactcgcgcgtcccgcggtcgtctgcggccccgagccggcggcagccccgggcgtccccggagctgcgcggcggccggcgcaggcgcctccccttcccgtgcgaagcgttcacttccttgcaaggtggtacgaatcaaccccgagcgcggcccgggcggcggggcacgaccggggaccccgggcagggcggggagcccctgccgccgctgccgcacgcgcacccgtaccgaccgcggggcggggaaatgtccagtgcctcccgctccccaggctggtggcttcctgtccccggaaccccttgcgcgtgctttctgtccacg

SEQ ID NO: 10754 - DNA, 652 bp, Homo sapiens
  source 1..652: mol_type = unassigned DNA
tcgcagaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgagctggctggtgattcatcctcggcgaggggctcgcgtgtgggccacgtcgccgtctccaccgggaaagcg

SEQ ID NO: 10755 - DNA, 722 bp, Homo sapiens
  source 1..722: mol_type = unassigned DNA
gcgttcactcacggcgcgtgcagggccccaggcctagggagcgagcggggcgctatgggggccggagtctgggtccaggccgccctcctcctaacctcccttgggtccccccatcccgcggccctcttcggagcgtggctcaccgggcgtgaagagcgcgatggccttgaggcagccatactcggccgagtcgacctgcaggcggcccagcttgtccacctgctcctggaaggcgcgcacctggtccatgaaagccacggcgcgctcggcggccataggcgcggcgtggaggccggcggcggccagtagcggcgccgtgtgcaggggcagcgccgcctgcgccgcgttcagcacgaagagctcgctccagctcaggcgcagcagcgccacctggtcggccaccggcagctcggggaagaagggcgcgtggcgcgcccactccacggtgctgaagagcagccgcgccgccagctcgcacacgttgtcgatgcccagcaccgcgcccgccgcgccgccccctgcgccgaagcgtccggccgccgcagggtagggctcagcgcgcagcagctgcgcgatcagttcggacaccggctgccccgggaagaggtctccgccgctcgccactgccgccagcgccgagcccggggggctgcccgaggaggcggccacggcaccaggcagcgagtgcgggatgcggccgcgctgcaccgctgcgggaggcg

SEQ ID NO: 10756 - DNA, 858 bp, Homo sapiens
  source 1..858: mol_type = unassigned DNA
acgatcacgtcaccgtagaccagggtcacacgatagaccccgcccctactcaccgtcctgagtccgatcaaacagcacccacggcacacactagggtctccgtctctcacacacacacaccacaatgacgtcgtaaacaatagcactaaccaccatcgtccgcagctcccgcgtacagaggcctcaggctcccggctccacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccgaagaaggaactggagggccgggctgggaaggcctgaagcgggtacagcctttaggctggggagggtcgaggggagaactcggagcctgagtcgggcg

SEQ ID NO: 10757 - DNA, 598 bp, Homo sapiens
  source 1..598: mol_type = unassigned DNA
ccgaggttccggcgggtccccgcaccggccccagctcctcccccgcacctgcctggccggcgggtcccaccctctctcctgccaggggtagaccctgggaccactcagctcgctctcgcaggccctgagcgtctgacgcctgcgcactgagcgcgggcgggcgggcactcccagaaacctccggggcgctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaaggtaggagtgtccgggatgccggagcggacacgcgcggagaaagcgtcgctggggttactcgtgtggccgtgtctccg

SEQ ID NO: 10758 - DNA, 1281 bp, Homo sapiens
  source 1..1281: mol_type = unassigned DNA
tcgaaagcccaaagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcg

SEQ ID NO: 10759 - DNA, 1788 bp, Homo sapiens
  source 1..1788: mol_type = unassigned DNA
ccggccaggcccgccggccgctccagcccagcaccagggcgcccgcgcggctgccaaacacccccgggagttttgctcgcaaagggaccacgaggcagctgctggcgcgtcctgcgcgtacccgcccagaggctccccggcttgctcctcgcgggtctgtcccgaaactgacgtgaaaccgatttggtgcaatgcgaatgagctcccgcccgcctccgcctccatcccagccgccgccgccgcccgtcgccataacaaccggcccccaccccccccaccccacgccttgcccctcgggtcccccgggccacaggccacagcgcgggaaggcgccccgccctcggcgccccgcatccggccgccgcgcacccccgcccgcccggcgcttccgagccacgcagaggcgccccctcccgccggagacgggaaagccccggcgcccccagactgggctccgtttccagctcccggaggggctggggctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaacgtaagtggggaccggggaggcgagggtggaggtggccgcggcaggggctgcacgggcagctccagctgccgccgccgccactaccgcggcagaaacccagcctgtcaccgcgtcctcattgtcccgttctcggcgctgcggagcccccccgagcgcgcccgacgcgtgggcctgcgacccccgggtgggcgccgttcccgggagggggagggggcagcgccgggctgtcagggagcagcccacgcgggcgcgcgacttcccacttctcctgccaccgccgccctctccgctgccttctccccacgcgtgactgtgggctgagcatggtggggatggctgtttaccggctgtgtgcgtttactcgccgtgtgcatgggcgcaccgcgttggcgagacgtggtcacgagaagatcagcctccagtcgttcccatttctgtccttacatcatgtatttctatggaattggcatctgcacgtacgaggtgtaggcaagactttgggtggccacgcgaggatggaagggaagggcttcgcagtgctcagggtcacacgtgggcagagcctcaccggagggtctgtgcatttcacgcgggctcggccgcacgcgccggggagcgcgtctccaagggagggtctgtgcgcgtcgctgcgcgggcggtgctctctccgggctgcatcg

SEQ ID NO: 10760 - DNA, 626 bp, Homo sapiens
  source 1..626: mol_type = unassigned DNA
ccgttcggttctccgcgcagccgtgggatctcgaggagggcgtccattaggccgcgtgtgaccatgtaaggtaaacagggggctcatgaagtcactgaggaccaatggggagcccggagcagagcctggggcggggcttggccctggcggcgggcgcggattggcacgctgcggatctccctgctgccttacaaggcggtgcgaggcgagctatttttagagggctatataagggggctgaggcggccgcccggcggccgggcagcgcgagcgcaagggacagggagggtcgtggcgacactcgcgccagctcccgggacggctgggctcgggctggtcgccgacctccgaccctccactagatgcctggcagagcccggcgcgtccggagcccgcgcccctcagagggaaggggtcgcgcgtcgccgcggcggccctgaggctgacggtcgggaggtgaaaggccggagtgcggggtcaggacgcctcctggagggggcgcggcgcagggggccgcggggaagccgccgagggcgcggagcgggaaggaaggacagtggccaccccgcctccgcctgggcacggggcagggacccgcgcgaggcggtgccggggaggtcctcacg

SEQ ID NO: 10761 - DNA, 1037 bp, Homo sapiens
  source 1..1037: mol_type = unassigned DNA
acgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttgggagaaacttggagggcagcggagaagcccgacgggcggctggaccttacggacggttttaggggcggcagagccgagaccttggaccaaatcaagggggactgttgctagcgggacgcggaagtcaggcccg

SEQ ID NO: 10762 - DNA, 977 bp, Homo sapiens
  source 1..977: mol_type = unassigned DNA
ccggacttgacggagcaatgcacgtgggcctttgactcgtaatacacccagtcaaagccggcctccactgccaagcgcgccagcagtccatacttattgcggtcgcggtctgatgtggtgatgtccaccgcgcggccctcataatgcagggactcctctgagtggtggccgtcctcgtcccagccctcggtcacccgcagcttcacaccgggccactggttcatcaccgagatagccagcgagttcaggcggtccttgcagcgctgggagaggaatgtgcgcgaaatcaaccagagcgaaatcagccggaggagccggccgaggtgcaggtgtaggcgcagcctcgcccagaactctcccgccacacccaagggagctggaagcccgggagggtgctgtccctctcccttaggaacagagggccctgaagtgctccctccctagcatacagccgcccccggggatctggaccgcacggcggtatcacaaatctggaggaggcatggaggcaagcgccctggcggcgccttcactggtaggtggaggtcccctctctcctgtgctgtcttcagctccgggtatccatccctccacagacaggactacacctttcagcgcccggtccctctgtgcctccaaggcaggagggccagccagcggccgggagggaggagtggcagcagagccgactgcctgcggccggcctgcgaggcgtgcaaggcccgaggtgcccagtaggtgtcaccgcagcctcagggctgaggcctggggacgacaggctctggaggcgcggcaggtgcagagcgtctcggtagcttcagggggtgtgttggaggggaatcgccggcctgcctggatccctcgagcaccaccgaggattcccgccgggaccctcttataatcttaaaccggcccacaaccccgccagagatgacagggccagggaaccagaaaccggcggattagcgccagggccg

SEQ ID NO: 10763 - DNA, 6206 bp, Homo sapiens
  source 1..6206: mol_type = unassigned DNA
tcgtcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcgataccctctgcggggtgagaatgcgggcccgcccggctcctcccgtgaggccagggcctcctgttctcctagacaccccaaggagccaactcctccgcagaagttccccgcttctgctcttatttccaagcttcgcgctttctacaaactccctgttgccttgactttgatttccagccgtggtgagggtcagagtgaaccccggcgcgctccccgacggcatccccgcacaccaggataggagaaattggagggcctggggcctcgggctccgcagtcgtcggaggaagaacccaccgcggggtccgcaagggaaagtgaagaggcccgggatttttccaaagcgctggccaggaccccgaaggaaggggaggagtcacctgaagccggggaaggccccttgggtgctctgccttggatccttatgttcactgactttcgcgaagcccccctggaggggggcaaatccgcgctgtttcccccaacttaacttcacgcggcccattctccgaatcgcgtgcgccaaggccggcgtcgggggcgcactgtgatggcgctttgctcttcccaggcgaagacaaatatctcgacccgatgtccccatgcatgcgggtgcacaggttctgagaaaatcacgcagaaggcggctgcgatccacggcccgggctgggctacacctgcttggaggtcgctggtgtgtgcgtgcgcgcgtgcgcagcctaactccttccagccccgggtggtgaaattagtttccaatactagtacctttcaagtttccatttattttgactgtacccgtctgaaagcagatttcatttacgctagcaagactggaagccacaaataaagaaaaagaaacggattcattgaatctcagtatctcagtagcgtttaatagattcccttggctaaattcagagccctgtttgaattcactcacgcaggagttgttttgttttttttgttggtagaggtgccggtttcccatccccacggcttatttacaattatgggtgttgttatttttaaaggattcacaaggtgactaactctctgttatctgttgaatggaaggagtgttacatatgcaagaccgaatggggcaggccgagcccccgccctatgctattctacaatccagatgggattcgtgattagaaaataaaattggccaaagctgtctcggaatccttttcccacttctaatttcatcagcactattaatcagagctcaaaagagcaaggaaataacatcagttacttttagatagaaatatgtttataaattttagataaactcattttaagatttctaacttttggggagactagcactcaccacagcatttttaaaactagggtgagacttttcaaaatatatttcactatatgcattcttcccttttcagtgtgtgagttaaaatattacaaacataaaattatcaaatatctttcccttgattaaccaacctgattaaccccttaattaattaagcctaacaactgtccccatcacaacttatgactcatgtggactctatttttacatgtttaatttctacgccagggtattttcagagggaaaatccaaaacaattaaataccttcagtggaattaagcgtaagtaaaactcagcaaaatctgtctggtatacaaagctttgcagaaaaatgtttccttctctttcaataaagtgacattttcctcacagcatatgacattttatgtggcttggctatttgttccccagtgttggacgatcagggccactacgcactcgtggggttctctgccctgtcccccgaagattctgccttttgtgtttcctcggggctgggctggacagaggatggaggcaggcggcccagtctgggtccaaacggaacggcagcggaggtgggggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgcacgaggccgaccgcgcgtttcgggcttcggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccccgcccccacccaatcagcgcgcacaacttccccctcggctccggctcgcggattgaaccctcctgacatatttggggccattcttctcctttgttgctattttgctagcgacccgcgggtaatccccgcgcgggaggggggcgtgcattgtcgcgctgatggacgggcccatttggcggctccgcgccccccggaggagagacacaaagcccaggcacgtgcgcctccccatagagaagcagcagaccgtgaagggaggcggggccgggcgtgtgcctggaccgggcggggcggcggcgccgggcggggcgaccaggggcgcgcgcgggggccccgcgccctcaggtacatctgccgcacctaccgggcgacccccgagtcccggcccccttttggccgccccatcgccctcccaccctgccaggctgaggagctgcggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacg

SEQ ID NO: 10764 - DNA, 574 bp, Homo sapiens
  source 1..574: mol_type = unassigned DNA
gcgccctcctccttgttcgcgtcctcggccttctcgctggctcctgcccgagtccctagcccctctgcaccacaggtttctggggcttcgtcccggacccggccattttccaggctcggagtagtcgccgtggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggctccgccccacgcgcccccctctcggatgtgattcgccggggtctcccgcagccggggcgagcggcttggaagcccggaggaggggtacggaactgcccgatggggatgcgaccgcgggcgccagacgaactgtccccacattcgttggcgctggcg

SEQ ID NO: 10765 - DNA, 3438 bp, Homo sapiens
  source 1..3438: mol_type = unassigned DNA
tcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgtcggagaagcggtcctccacgctgccgttgccgcccgccgccgtcgccgaggccgtcgcgtgcggcccgggcccggggtggctagtgggcagctgttgcgccgggctagcggcgctggacggcggcggcgacgcttggtgatgatggtgatggtgcgggtgagcgtgcgggcccagctcgtcgtgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgccgcgaccgcccggcccacggccggaaggcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccccggagggcagacggggagaccgaagcacaccgcactaggcatccagactgggcttgggagccgcgcaccctccctacccagatccaggatggctagaattaacgggttctttctgagacctcggctcaggcgccgaaaccggatagatcgcgaattcgctggacccggagacccgacccgcctcccgcgtcaccttcttctttctagctttgggcgcgcgcagcgaaaggcaggagaggcgcgcactgggtgagtgagtcccggccgctgtctgcgctggaccagcccgactgacctcgcgcgtaggggtcgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaataaaatgagtgtattttaactaaaacttaactcaatcttgtggggtggcaaattaaatgctggaagagcgcgtctacaaccctcttcgagaagcgtgctctccgcagaaatgagtcggccgcctggagagagagcctgggcggtgccgctgcgcagcccctgccagtagctgggggttggggactcgcaccttgtaaatgtcctcgtcttgtttgaacgcagtgagagcacactcgtttccagatcactcgggaccgggtgtctcggatctgtgcagactatgtatggctccggcctcaggcggccagggcgggacaagcacg

SEQ ID NO: 10766 - DNA, 4088 bp, Homo sapiens
  source 1..4088: mol_type = unassigned DNA
acgcctcgagcaccgactccacagccacggccaccgctcctcggctcccgtgacaccggcgcgcctgctgcttcgagcaggggaggctttgcactcccatcgcacttttctcgtccgaagatacgaaactccgtccgggcgtcgcaaataattcgaattcggctctctgacacctacctcggcgggcgcgcgccgctgggagggcggggtgggtggctggaggtaaggaggcgcacagcaggggtaagcgccgccgtcgcacactttgcacgccgcccagggctacaccactcaccgaaaattgggaggcaggtctgggaggcggggttgagcgcccaccgccttgggcgcgcccgcgccccccgccatcgcggcccccgcgcccccggcccacgcccgcgcggtcccggcaccggcctgcacccccagggtgcgcggcggcccatttgggtgcgtccccggtgggccgatttttcgcgcttccccttcggtttataggggccgctgctatgggtcggtcctctgaagaggctggggcgtcatcggggccggttagaagctctgctccccggcggggacactcagtcgcgtcggcaccgcggagcgggctgcgtcaggtggctggccggcgcggcgctcccctgctctctggctccgggctgcggcgcggcggctggagcgagcccctgtcccggcgcggggcggcggcgggcggccggcaggcgctgccttgcgtgtgagtgcacctcactcacatgtaagtcggggagcgccggggcctcccgcggaagtgcgagtcgcccggcgcaggcaagagccgccgggtccgggacaaggcaggggcgcccgggcgccgctgccttgccccggggcgcctccgggcaccccccaattctctctcttttctcttctccattggcgtgcccaagagccaaaccaaggagcgcctgagggtaaacagactcctgccatccgcgcctttgcacttttctttttgagttgacatttcttggtgctttttggtttctcgctgttgttgggtgctttttggtttgttcttgtccctttttcgtttgctcatcctttttggcgctaactcttaggcagccagcccagcagcccgaagcccgggcagccgcgctccgcggccccggggcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgccgccgacgacgacgagggcgccgaggagggcgccgtcgggggcgccgaggagggcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcgctccggggccagaggcgccttcggctcgggccatggcgcccggcgccgggggcgcgaggagcggctcatctagtcagaccccccaccccgccaccgccaccagacaccaccatcgctgtgtagtgtgggtttttattcgtgttcgtgtgtgtgtgtggacacattttccttttcggttgctctgtcctttggttcgtgctcgcctcgctttttccacactcctgctctctggctctctgtgtctctcgctctttcgaaaattttcctaagtccgggcgcgcgctccctccccttccgcccaccccagcccctcggcggcgcccgcgggagggggaggaggcctcgggggcgccgggcgacgcggtccggggggtggagcgttggcgtcgtgcgaggggtcgtcactggcgcggagacgccccctctcccccctcggctcagccgggctgctgcccgagcccggggggtggggggcgtctccccggcccgtcccgtccccggccgggcgcgggcggagggaccccctccccgggctcccggggggccgcctccctccgccggctcccgccctcccagccgccgccgccgccgcggccgctcctcggccctcctcctcctcctcctccttccacccccctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgctcccgagccccccgcccgttcgcgggctctgtctgtggggggcgaggccggaagggggacccaggggcgcggattcggccgggcgggggctcaaaaacggggcggggggccgtggcgacgcgggcgcgggtccccctcccccggcctgcccgctcagtgtctctctcttgctctcgctctcgctctccccctctttctctctttctctctttttccgcgaggcctacacgacgccaggggtttgggtgcgtgttggggagggggagggggagcccatggggctccggagactgcgacaaaaagagggtttcggggacaggaaaccgggtggcgggtagagggagggggacccgcctccgtggggtgtgagatttgttgggagagggaaagaggggaagaaaggggcgaggagaggagggggtgacgctggggggcgccgtggtggcggagggggcctcgccaaagggaggctttggcggggagaagtggccgaggagagtgggggggctggtgacatcagcccctcggaaaggatcggagcggtaaaggtggtgcagtgggggggagggggcgcaagggagtcgtggcgccggagtcgggaggggggcggcgaggggaggagggagggcggttgccgctgggcgcgacttggtgcgtttcgggcaggaccgactgactgtgtgtgcgcggagcagacgtgtcccgggccaggccgggccg

SEQ ID NO: 10767 - DNA, 522 bp, Homo sapiens
  source 1..522: mol_type = unassigned DNA
ccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcg

SEQ ID NO: 10768 - DNA, 2260 bp, Homo sapiens
  source 1..2260: mol_type = unassigned DNA
acgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatttcaggggccgaccaggggagggaggtgcccggggacggggagggaggagggctgccgggatgtgaaccggggaaggcagctggggctggagagcagcgcggaaagggggcccagggagctggaaagagggccaagaggagggcaaggaaggtggcgggcgacggggagaggaaagaaaaagggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgtgggcggccgccgactcggcgcttccccgccgcccgcccagggagtccctgcctggcaagctggggctcggggaaaagtccagcagcgagagggccgcgtgtcccgggacggttccaggggagcccgcgcggaaacgcggaccaggcgcttcggcccggatgccg

SEQ ID NO: 10769 - DNA, 1502 bp, Homo sapiens
  source 1..1502: mol_type = unassigned DNA
ccgcgggacggagacagggagttgggaggaaacgcaacgcgcctcccaggcaacagactccgagctccggttcggaaacgctccgaggcagaagcaagggcttctaagggctccgcttcccagccttgggtccctactactaccttccccctagactcggtgagcccaggctgatggaccgtgcagtccagtttgagccagcccagcagccctcaatcgggcgggcagggaagaaggcctcctactgccgggaagaggccagcgcgctccaagttccccgcaaattccgcccttcccgcctggcacggttcccttgcaccgctgtgctccgctcccaggtttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggccgcgcgccgccgcagtcctgtcgcagcgcgtgccctggtccctccggaccgaaaaggccgaagccgtcccccgcgaccgaccccgcgcaactggctcgggtctgcacctagatggctgtgggccccacagggatggccgggcgggcccgttcggccgctacctcagggtcgccagtccccgcgcgcggccgcctcccgccaggaagggtggcgggcccggaaggccagagatgccccagtgcttcccgcgccgctacgcacctagctgcccgcgggtcccacatggctgcggccggagggtccgcaccaggaccgccgccgcctggggaagcgcttccctgtgggcagggcgcggcgggcagtgcggaagcccgaaagctaccggagcccggggcaggggcggcgcgatgcagaggcggcgttcgggggcccccagctgcctgcggctcggctacccagccgcgatcagagggggcgggggacgcaggaaccccggcgtccgggcggtgtgcagccgcagacctattccaagtttccacgtagttgcgagagcccaaaaactgtcacgtgcacgtcgctgctgagtgggaggaggtgtttgtcatcgcgttcaaaaggggcgtttcggtgtctcccgtcatgcaagcaaatggtatggctctcggccgcctttgaataaacgagtgcttcgaaccctttaccaggagggactaggcgcacaaccacctccgacactcctcgggcatgcgagaattcggctttccttagtggggcccatcaatgttgtccgggaggtaaagaaagtgatcggccaacggcctcagcgtgggttttctccttccctcgttcctccctccaacaaaggacgtacggagaacaagccccctagctcctacagatgaggagctcaggagtcgggcgaatatcaagtacttactgtgtgcttgcccctccactctggggaggctgggggtccgggagtgaagggggcagcgagaccgcgggctgctccacgctcaccgtcg

SEQ ID NO: 10770 - DNA, 510 bp, Homo sapiens
  source 1..510: mol_type = unassigned DNA
gcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacg

SEQ ID NO: 10771 - DNA, 940 bp, Homo sapiens
  source 1..940: mol_type = unassigned DNA
tcggggcgcaggcaggaggcactggaagcggaagcgagtggggagtccgggtagagggagtcgcccacctgaccggcttcgccccctccggggtttgctgcagctgagggccccggaccagcgattctagaagccggtccggggccgggcagtccaatagcttctcgcggatttccctccgctggcgcgcagcagcggcgcgtggattcgcgcgcgggctcgggacggcgcgagcccgggcagcgcgagcccctgcgcggcagggagtggcgcatgcgcgggcgtcctgcgagcccgctggggcgagccgagccgcggcggcgccgggagccgggcggcggagctgtgaagaagcaagcggcggcacgggagcagcggcgacggacaggtggcgagccttcgcccgcgccgccaggggctgctgggccacccgcggagcctcgcggtccagacgtggcgggggtggcggcggcatcccggacggcctgtgagggatgcgccgcccactgccccgcgccgcctgaccgtccccgcctcgactcgcggtgcgccacagccgggcccgcggccgtccccgccgcgttgtcgcccggtcgccgcgcccgcggggccgcgcccggcacggccatgtggacccccacggaggaggagaaatacggcgtaggtaggtgaggctcaggcctggccgtggcgggggttctgggggacgcgcccagctcccggccccgcctggattcgcatcctcgtgcccccgccactgcccgcaggctgcgcggcctcggcgcggggcgagcgcggggtgggggcaggtgcgggtgcgggtgcgggtgcgggggtgggcgcgggtctctgtgcagagagggcggcagggggcgctggcggtgcggccttggcaggtgcggcccgcgggaggggtgggcaaggcccgggcagttgcccg

SEQ ID NO: 10772 - DNA, 2718 bp, Homo sapiens
  source 1..2718: mol_type = unassigned DNA
ccgccgttagttatgattcatgctccagcagcgctgggaagtgggccgagggaactgaggccggggtgggtgcggaggtggctctgacggggagcgccgatccaggatctggtccggaccctgagctcggcaggacctgtgcgcacgcaggtagcgtcgcgtcctcccccaggctgcgagaggttgctctgccatcaggccatggaccccgagccgcccgtgctgcgcgcgcgcgtgtgcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcggagcgcccgggccgccgccgcctgtcgcctgcgccccggctgggctccgggaccgcggggccgctcaggcacgcccgctcgggcgccgcgtcgccgtgggctcgacgccggggcgctccccgtgagccgggccgagggcggggccgcgcgaggaccccgggacctgcccccctccccccgcagccgcgtcgccgctcgctccgggcgcctcctgctctgcacttacacgctcggcagctgcggggagcccggcagccacgctctccggcgcgccgcccgcggagccaccacggccgagggccggctgctgggcgccgcggtccccggcgggcgcgcccgagcagcaggcggcgatgcgggcgccgaccccggctggggggcgcccgagctgccgcggctgcgccccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacg

SEQ ID NO: 10773 - DNA, 2661 bp, Homo sapiens
  source 1..2661: mol_type = unassigned DNA
gcgcggccctgctccgcgctttctctagccagcacccacgtgtctctatttactctactcaggttaccagctctatcgcccgcagcgggccagaagacccgataaagcgccttccaccctgcaggactagtgcccggcttccgctgcttctccgcctttcttctgcgtagatttaaggcctgatccggtcccaaaccccaaataaaagttgtgggtttgtttccaagtgatggcggttggagaaaactagagttgggggcggtacagccagggtgtacccttgcggtgggtcggctcggcgcacccacagctcccagctgctagcccaggcgctggggccgcagggactgaaccccgcaccgcccccgcagcccgggtgcgcgccccatcggccggcctgctccccgcggcccggctcaccggtggtagggacggccccgcctgccccagcccacgcccgcctccccttcctcccgcctgtggctctgctcgtctccacctaagcctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaactgatccatttggaataagttaccctgcccctctacctcccatcctacacacacacacacacacacacacacacacacacacacacacactgcggaccgggggcccagctacgcacacaccccaaaacaaacgagggatctactcgggaccctcagccgggcggccgggcgccttcgttcccttcctccctctctgagtttcccagggacccgccacgcctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggtaactcaagggtgggggaggaaaggagagttggaagggttcgtgcagcaggacagcgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggttctggagggagcacgcctccccaaagtgcagaggagggtccggcggcgcgtctccgcggaaaccctctccactgtagttaccccggatgccgacttagtagtttgttttccgagaaaagagaggggatctgggcagaagggccccgtttgccccaaaagaaggtgcaaggatcagaagataacgaaacgtccacttcctgaagggtgggaaaaaaagaaaaagaaaaaggagccacccacgctggagatgtccgttttagatcttcttattttcttccctttcgcttcggtttttcttctcgaggctcatttaatctgctagagaaggaggaggagcagaagatgggggccgaggaggaggggaagagaaagagaagtttgccaagaataaagtttttgccggcaagcgcggggactccgcagtggagggcactgcggagtctcggggagtcacagcgggggcctcgggcccaaatgcctctgcccggagctcgagccgacacacacactcagtccgacccctctttgttcccggctcgagtttctcagcctggctcgccggctcgccgctctgcacgcctccgccggccagctctgtcaaagcaaagagctgcgccccttgagttcgcccggccgaggggaggggacgccccgagcttggccgcgtgcgaggctccgggcgcgtcctggttcctcggcccgagagcgcgcagcccgggtccctcctccgcgccctgccccgcaggtgagcggctgcgcctccccactgcttctcctcctcccgcgcctcgccggcgctgaaaagctacccacttgcgtcgcttctcctccctctcccctcccccgcctctagctctccttggctgcccgctggaggggaggcggggggtgagggggagtcggcgagaaggaggtggtgattgagggcttttttttctttttcttttcccagatcctgtaggacgagtcttggttttggggtgtgtgagtgtggtgtgtgcgcgcgcgcctggagggaaggatcaggcaacttggcgagagaaggaaggaccgggcgctgcttataacccaccgaaaggcacgctttgcccgcg

SEQ ID NO: 10774 - DNA, 801 bp, Homo sapiens
  source 1..801: mol_type = unassigned DNA
gcgaggaaaattgacgttctattcctccggatcctgctcgagaagctgggggactcgggtccggtgccgaggtgtggcccgagcctggcaccacccacgccggccgggtgaccccggccccttggggctcccgcgctccgtcagcaggcgacgctgggaggctggggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccgcccgggccctctaagctgccagccgcgcccgcctccgggctcctcgcccctcctcccgcgcgctcccctcctcagcggccgccggaccccctcagttcacttctcccagttaacgcgttcctcggacgctgctagtttgagcgcacaggcattgggcggggctcacgggggagccgcttaataaccg

SEQ ID NO: 10775 - DNA, 311 bp, Homo sapiens
  source 1..311: mol_type = unassigned DNA
tcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccg

SEQ ID NO: 10776 - DNA, 1048 bp, Homo sapiens
  source 1..1048: mol_type = unassigned DNA
acgggagcaggccgggctgtccacgacggaagcctcgaccctggctggggctgtcggccgggcagcgcgggagagccagggccagagccggggccgggaaccctagtcccgccgcctacgcgggatgcagcgaccaccgcccgccgcccccgggccggcactcacctccgtggaggggcagcggcgccagcacctggccgcggacctcggccttgggggagtcaagcccgtagcgcccgcggtcgatgcgaaacgtgagcggggcgccgcggccgggctcctgcaccgtcacgttgatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagcgcgcgcgcgcggcctgcgcggggccgagcccgagcgcggccctcctggacgccgcggccccgccgctcgccgccctcacgtccactgcccgcctgtggggacgcgcccatgggccctcggcgagggcggcgtctcaggtcgcacgcgggcgtctcttcggggtcccaggagggttgtagaagcgtgccccctccatccccccgggtcggtcccaccgaatgggaggcgcctcgcaaggacgcggcgggggaggggaagggcggcacgggaggaagcgccccgaggagggtcagcggaacacaaagtccctctcgcgcggctgccgcctgaggcgcgtgtccgccgccgccccgcccccccgctggtctagcggcaacgcgcaggcctaaggcgcagtcccgccccgagcgcatgcgtgccagggcctgtccgctcccgcccgcctgcacgagggcccgggcagccgggtcagccgctggtgctggttgtttctctgtcaggcgtgatagccgcagggcgtggagcccgggagatttgcgaggacg

SEQ ID NO: 10777 - DNA, 301 bp, Homo sapiens
  source 1..301: mol_type = unassigned DNA
gcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccg

SEQ ID NO: 10778 - DNA, 1395 bp, Homo sapiens
  source 1..1395: mol_type = unassigned DNA
gcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccg

SEQ ID NO: 10779 - DNA, 766 bp, Homo sapiens
  source 1..766: mol_type = unassigned DNA
tcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagcccaggtgctagtggagcctgggagggacacggtgcgaccgacataagacggggtcg

SEQ ID NO: 10780 - DNA, 691 bp, Homo sapiens
  source 1..691: mol_type = unassigned DNA
gcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatggtgagtgcgcggcggccagcgcgctcgcctcccgccctcgtcccggagcgcgcggcgggccggccaaccgcgggccgggcgtcgccggaggaggggacgggggagcagggcggggagcggggttaggcctgtcgggccacccctgggtctgggaaaagctggcggcgccacctcttcccggtctcggcgaggcccgagcacctacgggcggcggcgtgctctcctggccatgtcggagcctctgcccgcgttcttcgactgcttgttggggctctggctggggactcggaccccgcctctgcgggggctggtcgccg

SEQ ID NO: 10781 - DNA, 1024 bp, Homo sapiens
  source 1..1024: mol_type = unassigned DNA
ccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcg

SEQ ID NO: 10782 - DNA, 1339 bp, Homo sapiens
  source 1..1339: mol_type = unassigned DNA
ccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctcccgccgcgccctcccgcgctcgcgccgcgcgcccccgcctgcgcagccgctcccgcgccccagcacgcccggccggcgcgcgcgcccggcaccggctctacctccactccgcctcccgccggcccgcgaccaagcgcggccattgttcgcgacgcagctcccgccccctggcggctgccgggccccagcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcg

SEQ ID NO: 10783 - DNA, 2273 bp, Homo sapiens
  source 1..2273: mol_type = unassigned DNA
acgcggtggcactggtggctgccggcagctgtcgtctgcagagtgggtgagaccgagtgtggcagatggcttggtccgcggtgctggaggggactggcggagcagaagcgccctggcgccgggtccttgctttcctggagctggggcttggggaatggggtcggtcattgcagggacagaggagagggcagggtaatgggtgcgcaggggtcccttccaaaggctgcgggtggccaggggtgtgcgggggcgctgaggtgcggtcgccgagagattctggcctccagggtggtcgggcctggcatggactctaggggatggtgcacacaccggaccggacgggcccctcccttacccccggatcccccggctgggcagcggccagggagaggggcgacctacgggggcgggtgtggggacgccggactacgcgtcaggagtcccagatgggcccagacccccattccccgccccgggccgcagtgacgtcagggcccggacgttcccggaacggcctcttgggggcgttccagccccacggacccgcagggagtccccgccgcaatttgcatggggctcatttgcatgaccccgccccgcgcgggagtcgggggcgccggcgactggaggagccactgtcaatccccaggggaaagtgggcgaggcgatttctgggccgctcacctcactccaccctccagctcgcgccgcacctggggccctcccccacctacgccccgccagggcggggccgcgggcgcagacactcgcgggcacacgcacgacgacgcgcacacgcggtcgcacgcggccccccgagccccctgcggcgactccgattcacccccgcgggtgcggggcgcggacccgcccggcccagctcctgctccccaggcgcttcctcctcccgcgacctgccccggccgcacccgcctccgctccagcacgcgacgctgcccggcgcgacccctgctcccccggcccagccccaccgctgccctcgactcaatcccagttgaacgcccgcagcctcagtcccacccccggcccagccccagcgcccccagtcccacccccggccccagcttcagcctcagcgcccccaggcccagccccagtcccacccccagtcccaacaccttcaggcccaccctcggccccagcctcagccaccccagccccagtcccggcccagccccagccccagcgctcccggccccgggcccagccccagccccagccccagccgagcacccccggccccgcctgcccggcgttcccttttgtgcggcgctctcccgtccgcatccgcccgatcctctggaactccccgcggacgccggggtccctggaggcggcttcctttgtctctgctcccgccctccctccgcggcgtcttcgcccctcactcacctccccagccccgcggggacgaggggagctggagggagcccgggacccggcgcggcctccgcaggcggcgctttcttctcgctcccgacgcggccgcccctcctgcctgcccgctcctatcgccgcttccgcctctgccggggacggggacagcagaccctcggcgcccggcccccgcgcacctgccgcgcgcaccgcctctccggcctgcgcggctccgggggctccgggaagaccgagcgctggcggccagcccggggaggctgtgggcagcaggggtggctgcgggctcccagtccctcctccgcctacctcggagcccacatttgggatttctactccgggagaattctgccctcctcccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactgtaggtggccgcgggcggggcgtcgcactggccaagccccaaccccgaggcccctgcacatagaggctggaggccgcggcgggtccgcggggctcccggcagcttcccggggatgggatgggtcactctgcggacccctcggtccctggaggccg

SEQ ID NO: 10784 - DNA, 5586 bp, Homo sapiens
  source 1..5586: mol_type = unassigned DNA
gcgccggctgctggggctgccaggtgccaggagacgcctccctcgggcctgccccggcgcccgccctcaccggcgtctgtcctgccgcccagctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccggtgagtccgtggacggcggggatggggtccggcggcctccgggcccctctcaagccgcctcctccccctgcagggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgagggtgagtggggggccccggggtggggaggcccggctagtagggccgcagccaaccgcgctctcctcttcgcagagtgcgcgcgcaggatgaagaagtgcatcaggtgccaggtggtcgtcagcaagaaactgcgcccaggtgggtgaggctctgcgcccccaacacgcctcctgctcagctggtggcccgcgggtccccgtcccccaccccttccctcccacacttccgcccatggcccttccccaggttacaccccgccctcccaaggctcacacccggccccccagcccccagcccccagccccgcctgctccagatcacacccggcccacagccccgcctcaaggtaacaccctcctcccccatcacaccccagccccgctggatttcacggcccctcccagatcacactccctccatagccccaccccagatcacagcccacccagagcaccgcccccccatcacaccccggcccagctcacagcccacctgcagccctgactccagcccgcacaccaccttatgcctgatttccacggctcacctcctgcccgcacccgggccccacctctgcctccaaatcacccaccccgccagccccccttgcaggtcacaacccgtcccaggtgacaccccgcccccagcctcgcccccccgcagctccctgctccccgcattcccccacccggcctcccagctcacacccgtcccccaccccgcagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttgcctctgctgtctgcctgggggaccgggcgcctctggggtcctcccctcgggacacgcgggcgagcctgggggcgaggagggggggcccttccctgggtccgccccgcccgccccaggctctcgggtccagactcccgcccggactgcggccttcgggccaggacacccttcaggcgcgggcacggccgcctcccgccccccaggcccgggtccgacggggcggggactcctgtgtctgcccccgggcccccctcgctcttccgtcctgggggcggccgcggggactcgcgctctgatccaaggggcccgacactccccagggctgtggggtcccgtcccagcagggagttagttggggggcgtcccaggcagggtctgggggccgggcgcacgcaggcggggtgacgagctgggggggcggggggcggtgtcggagcaaatacggcggccaggcccagcctctcgcgctttccaagaaccgcccgcggccgccgccagctgcttggcgctgaccccgttggccgggctgccgtcaccctgggcccgacgccggcgcggaaaacggggagggacgagacagacacaggccggtctggctcggaatctcctgctcctctgcccaatcccccacccccgccccgcgggacgccggtgcccggtctcggtcccagcccagagccgctcgcgcctggacgccggccgccccgtcgaacctttgggtctccgagctccccgcccccgcccccaatcaggaccggtccagacctccaggcccggcgcttagctccgtttcccgtccctcccgtctccctctcccctttgctggggcctagccggggatttaggagccacacaccctccacctcacgcgctaccctccacggggcttcccgcagccagggcccgccccttcccggctccccgggagaccctggcaagttccctccctccgccccgcaacctggcaccctccgcggcccttgcctacccacgcaccccctccccgcctccccctccaccgccccatactcactgccacgtccccatccggccatcccctcccagctctcggggacactgtcaggcgagcgacgcgtctcctgcggcccagctcagctgcctgggccaggatggagactccgctcatgtggggctcaggggttttttgaggattccatttgggaaaaaagccaccagatcactcactgcccagcagtgggggcttggggacccccactgctaccctttcctaagcgggagccctggcgctgcccttcccgggctgcctggggccctcttcgctcccccctccgaggaccccgcccagcaggccatgcccaggcctctgcccctggcccacgggacgcgggtccccatgcccccggctggagacagcaggcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcaggtgagcggcgggggggaggccaggtgccgggttgggggggtcctcacgtctgtgggtctggtctatcggggggcccgcaggacgtgtgcggggtgtgcggggtgtttgagggtccggatgtgcgtcccgaggtcggagggttggacgcccctgtgtccagttgttgggaggggtgggaggcctcgccctgctgttcagccccttcccctccactgggccgcgttcccagggacgtgcaacagggcgctcaggttaggagacccgaaaccacaggcagacaggacccgccacgcccgctcccagccctgggcacccccacccccgtttccttccagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggtgcgccctggctgggccccgggggagggggcgcggccggcgcccgctgagctcactctccctgcaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacggtgatgcccacggggccgggacagggctgcgtgggagctgggccttggccatggtcggggctgagggggcactgacggggctctttcccccacccggagcagaattccccttccccacggtggccaccaccccaccgccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcggggggggctgtgcctgcaggagacgccccgcccccctgcagctggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccg

SEQ ID NO: 10785 - DNA, 1264 bp, Homo sapiens
  source 1..1264: mol_type = unassigned DNA
gcgcggctcgggcgcagttccggcgcagtccccgcgccgagcggctccgcgccccgcaccagcctctgcccggctccgggtgacgtcgcatcctccgattggaccacgcggcctggggggcggggtctggtccggtgagctcaccgccgcgccccgccattggtccgggcggcgcactcgggcagtggcggggagaccgcggtacccggagccccgcgagtcgttccagctgcggcgagtggagctgagcgggcgcggggccgggctgggccgggccgggcggggccgggcggggcgcgggagccagtgagcggcggctcggcgcaagcctgacgagcaggagccgagctcagcaggtccgggtaggtgcgcggcggcgcggggctaggcggagggcgcgtgcggtcgagggcggcggccggcgggggcgcgcgcggggcgggggcggggccggggcgtggggacacgcgtgctcgcgggccgggggcgtggtgcgcggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggagtgggtgggagacacgcgtgtccatgccgcgagggtgtgtcgacgcccgagcctgcgtggggcccggggccgtgtgtctggagtggccgagggcgtgaggggcgcgcgtgtttgtgcgaggggcgtgtgcggcgggtgtgagccacgcgtgtctgggtgcgcgcgcgggccggatgagcttctggagtggtgcgaggacgcgcgcgtgtgtctgtgtcggagcgagggcggggacgagcgtgtcgggcgcgcgcgggcggggctggggcggcgtcggggcgcgcgggggcccggcccggccggcggcgagtgtgttggggcgctcggcttctcctcaacacgggtttttgggacccagtgccgcctccttcccgcggcggggcccgcggagctcccggtttccctgggcagacaggtgcgaggcgaggtgcgggcacagccctgcgctcctcagcgggtgcgggatcgggcgacgggggactgtctctaactacagaccaggggagcggagggacgctcgattcacccgcg

SEQ ID NO: 10786 - DNA, 716 bp, Homo sapiens
  source 1..716: mol_type = unassigned DNA
ccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcggatcggagccgccggggcgcgggcggcccaggtaagcgggccgggtgggtgggggtcgcgtccctccgtccctgtccccggtgcacacaggtgacagcgccggcagtgctcggccggagcctgctcggtcgccagccgggacccccggcgcggcgcccctggaggggcctgcgggtggggggtgcggtcctcacgccctttgcgtcccagtctcttggtctctctccccggagtcggggagtcggcaggtccggggcgagggctcagtgaggccggcggagggccgagtcccagcccgggagcgggagccggggacccggcgcgcagggcggaagctcccgcacaaaaggccggagtcccgcacatggatcgaattaaagctccggcggcgcccagcggtgaccccggcggccgccctgctcggctgcctgcggagggtcccgcgtttccggagcccgggggcgctccaggccccttttcctagccagggtcaggcaaggggagggacgggtcccggggctgctcctctctgggcctcacgcgcccgtcg

SEQ ID NO: 10787 - DNA, 619 bp, Homo sapiens
  source 1..619: mol_type = unassigned DNA
ccgtccgggactcggggggaggcgcgctgggtggtccggcagccgggggcgggcggtagcctgcaggcgtaattggcatgcacgccgttgtagctgagaccgcttaataaagcattacatatctcaccgcttccatatttcattacctcacgcggagcctgtgagagggccctaatgggagtcagctgtgtttttactttctgttgtcggccgggacgggtttctctgcggattctttgaaatgaaataatgtgatgcacgccgcgataagggccggcctgtaatgaggcccaggccgccgggcggctgctattgctccaggtgtcgcgtatttgggctgcgaggacaaggaggaggagggggcggcgccggaggatcgggggggagggggaagtcgcgaggggcagggggtgggagaaggcggagggaggaggcagggggcagggggcgggcggaagaggggaggaaggagggggcggcgggccgcggcaggccaggcgggagaagccggagacagagagaggacggggacagtggcggcctgcagagccctaggaacccgggttcaaatcctgcccgccagcgtgagagagcgtttgcccgcccaggcggtccaccg

SEQ ID NO: 10788 - DNA, 293 bp, Homo sapiens
  source 1..293: mol_type = unassigned DNA
gcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcg

SEQ ID NO: 10789 - DNA, 2748 bp, Homo sapiens
  source 1..2748: mol_type = unassigned DNA
acggcagggggtccccgtgccctccgagaatccaagaacccgccccgcttctacgcggaaagctgggagaaaaactgcttttcctttatttccccctaccccccactcatccgcccctggagctccgctcgcagatacctccccctcccgagccagaaatagacacactatctctcccccacctccctccccgtgcgcacactcgctcccctcctcctgtttgctccccgccttccccttccctccttcctctgctcggagctgcagcctgcagcctcgactcgggctggctggctggctgagtgcggccggggcgctgcccggcagtgcggtgtccacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctgggtaagtcctgccgccccgccccgccccgcccctggctttctcctaaccagctgctggggaaggtgtggggaaagcgaagccccctccccttgcgccttcccggagggccctcctgttcacgatcaggctgtgatgggcattgcgcccagatgtgctgagctggcccacctccagatgcgcatggctcaagtgtaccttcttaaagacattacaggcgggaacccgggctcgactctggcctgcccgaggtgaggctggacaatgggatggggggtgagggggttacaggctctcagaaatagagccagaatcccaatatggcaaaacctgggactggtggaaacctccgttgtggtgtggcctgcgcttgacaggagcatcccgcattgcaaggggagcgtccagcgagagcccggatctagaggacagatgtgggagagcagatgtgagggctgattggccccggaacacagctgaggctccacttcctctgtggatcccgagtgggagcgcaagtcggatttccccgcggtgtgaggattctggctaaaagaagcgtctagggccgggggcgggcgggctgccagctgtgcgcatctgggcgcatgtccgatacctcagccccggctctggccccaacccctacacccgcaggtcttttagggcgtgtcgaaagctctgggcgttagcgccgagactcctgtttgaccgggaagcctttgccctgtggctaatggaagccgagcaggcgggaagggaggaacaaagcttgctcgagtggaggaagcgcgcagagctgttccattgttctccgtgcctgaagagtctatgcaaaaaaacccgaagcgggccccggaactgctctttctctccccggagagcccctgccctcagagaggaatagatctgggatgtgccggacgccaggcggccatgcctcgggaactggcacgggccctcttggggccacggaacaaggacggtggggcctggtgcccaggcgagctgctttggctgcgcggacttgttgcggtggctgggttgtgggtcctccggcgccgagggacccgagcttcctgggtacccggcaggctgcccgcccgctgggggctgggaaggggcgtgccaatgcgcgtgtgaaagggcggggccgagtgacgggcttggcgggtggggaacatgcaagagctcgccgggcggccctggagaatgcgaagccggaggagaccggttcg

SEQ ID NO: 10790 - DNA, 433 bp, Homo sapiens
  source 1..433: mol_type = unassigned DNA
ccgtcccggcgctcccaccgccgccgccgccgcccaatagagcccctggggcggtccccaccgacggtgcagcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctgtgagtactgcccgcctgtccccgcctggtcctgcgggctgctggctagcgcccagtcccg

SEQ ID NO: 10791 - DNA, 1376 bp, Homo sapiens
  source 1..1376: mol_type = unassigned DNA
ccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcg

SEQ ID NO: 10792 - DNA, 3393 bp, Homo sapiens
  source 1..3393: mol_type = unassigned DNA
gcgggtgcacagggagcgccaggactccagcgtcttgccggaccagacccacacgcccgaggtgatgcccaccactaggcacatgaagtacttgagcatgaagacggcgtagtcgggcctgcgtgcctggtcgggctgcaggtcccgcaggcacgggcagttgtgcgtggcctcccagcgcgggcggttgtgctgctcgtagaagaggcaggcgaccaccaccgcggcgggcacggtgtagagcacggtgaacaggcccaggcggatcatcagcttctccagcttgtgcgtcttggtggggccgtcctgttgcttgatgaccgagcggatgcggaagagggacacgaagccggccagcaggaacatggtgccgatgaagaggtagatgaccagcggcgccagcacgaagccgcgcaggttgtccaggctctggttgcccacgtagcagatgcccgccaccgggtcgccgtccaccgagctgagcgccagcaccgcgatggacttgacgctgggcacaagccacgcggccaggtggaagtactgcgagtagccggcgatggcttcgttgccccacttcataccggccgccaggaaccatgtgagcgacaagatcacccaccagatggagctggccatgccgaagaagtagaccagcaagaagaccacggtgcacagcgcggggccggtggtctcgtagcgcacgtgctgctccaccgcgcccagctcctcgtactcgccgcgcccgcccgggccgcccgcgcccgcgcccgccgcgcccgcgcccgccgccgcgccgcccgcgcccccagcgccccccgcgcccggcgcgccaccgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagggcccttccgcactcctttccgccgctccgggggtttgaaggcggctgcaggcgcgcgccacagtccgtaggtccgctctgctggccccgggtcgcgctcagccctcgcggcgcagagcggccgggcctcggctcatcgtcccgcgctcgctcgcctcctctccgcgcgcccgaccacttctccccgccgcgccgggcggcggtgactccgccggacagagagggcggaggcgccgcaagtttcctctggggccgcggtgcgcagtcaagatggctgggccgggccgcttgccgcgccgggtcagccctggcggccaccactcggcccccgggggctcatgcccgcccccaaggccaagccgccgccgccgccgccggagttggggacccgcctcggcccaggccgccgccctctttctccggcgtccgtccttcgtccgtccgccgccgggacagacggacccccgccgcctggaaaagtcagcgccgcgctccggccgcagtcgggcgaggtgcacacagtctccttcctgctggacacccaggagcaaatccagaccggaaggcggagcggacacctgagtggcgcggcccgcgcccagccgccgcctcctcctcggcgggagcagcgcccttagcccaacttcccggctccagccccgctcgcgccgcgctgccggctcatgaatatttatacagcgcggactcggtctccgcccccagccccgcgagccaatcgccgggcggtagggcggagtccacgcgctcccagggctcagccttccttaaggcagtccccgagtgtccgcactgctgtgcgcgctctctgcggatggagagttttggtaaccttgggattgaccgcagagacagagtgttggccatggctgtccccatggcgctgagtgcgtcggaggtcttggtccccttaccccgagtctgcccttggggacagggacggggtttggtgcagcgcgcgcctccccggcgcgtttcaaaccagccaagcccctgctgccaccctccgcaaatgtgggtgatctgcaggcggctggggtctcgtgctcctcggggcggcaggaaggtctcgcagcaggcgagcgccggggaggcctgccggggctcggcgctgcagaagacccgggaaagggtgtcctccttggggttctcagaacgatggtttctgagacttggagatgtggggggtgtggagtcattctaaactggggctggacccgggacggcccgggtgagatgccccggagcccagccttgggcgcgcgaggggcgcgggggacaaatgcccgccagagactctcctcccgcctccgctgcg

SEQ ID NO: 10793 - DNA, 1381 bp, Homo sapiens
  source 1..1381: mol_type = unassigned DNA
ccgcggcagcgccagctgcacttctttccaaaaatcggaggaaggagtctgggggccaggtcggggcggtttgcaggtgtgaacacctcggaagcccctggcgtcctggcccccaagagcacacctgcggctgcccacgggttccacgccctgcgacagctattccgtggctccgggggcctcaagggcggctccccgcatcggggccccaggcagcggaacctccccccagggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccacccaaccccgcgcgggacccaccggaagctgtggctgcaccaggcccggctcaggaaggcgtccgaaagcaccacgatgaggcgtcggcagcggctcaggttcaccaagaggtcggcggagggctctgcgggagggcgggcgtcggcggcgcaggggcgggggcgggggagggcggggccggaggctcaggggcggtgccggacgcagagctctaagggaggggcggggcctgcggggtgggcgggtttttgaggcggggcctcgggtgggcggggatgggggcggagctcgatggtgggggtggggccccgggtgggacggagcatggggcggggcggggcgggccctccgggtgggcggggcacggggtggggcccgggataccagcgcgcggcaggaggtcgcggtcgtccaggaagagcttgtagccccgacgccgctccagctgcggctttaggatgaagttcacgaacttgcggtcctcggggcagtcgctgtaggagacgtaggcgtcgtagagcttcccgtctgcggacggcggccagtcaccccgatggctcccgaggcctcacaccagccctcggggtccccaacacccctaaccatctcccacgtgcacaggggcagacccgccccggactttaaccccagccgggccgcacagagcacccgggggctaacccctccccgccgcacgcctccaaagccgagctcagcagcgcactctcagggaggccgtggcgacccctcctcgcgcccacgcgggccccacgcaccgtttatctccacctccccatacgcgtcctggtaccagagcagcacgttgagacg

SEQ ID NO: 10794 - DNA, 493 bp, Homo sapiens
  source 1..493: mol_type = unassigned DNA
ccggacccgggggaaatggggtaccaacggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggaccactcaccgcggccggcggactggcgggtctccgacaggtgcgcacactcggcgcaggctgtcgctgagcccggaattctgcaccgggagaaacttttcagcccgcagagcaaccgcagggcagtggacgggggccgcgcgaggacaaacagcggcggcgggtgcaaagccccttctccaagccgcggggttggccgggaggtgccggctgcacaacggcgcccacgtgacccaggtgcagccccaggcgcgcccaagggcagctcg

SEQ ID NO: 10795 - DNA, 922 bp, Homo sapiens
  source 1..922: mol_type = unassigned DNA
tcgcgggcgctctgcagggatggagattgagagaggccagggacccggctcccttgggaaaacgcgcgggcgccctagctccccgctctgcggcatctcacctgcccccgaggaccatcgtcaagaagaggtttcgtcgtgtcactgacacctcaccccgcctcctcccgcgaggtgcctccgagcccccgaggacgcggaacgccggggctccccgccgggcaagcatcagcatccagaccccgcacgcagccctgcacccccacgccctccagggaacgccggcccgcccgtccccgggacctcccgtcccctaagccaaggccccccaagcccagtgcccgcgcgccacccctccctccgaccctgcggcgggacccccacccccgcacctctccgcggggctggctaagcctccagacctcctgcgctgcagccggctcggaaagccacccccaggtcatccccccgcgcgcgcgcggcggcggctacggtggcggcggctgcgatccgaacgggcccctccatgcaccgcgcagggcagaggagggagcggcgcctcgcacgccggggctggggcgctgggcagggcgggcgggcgtggggtcccgggtctcctcgcacctagccgcgcgagccgggctcccgggctcaggggaggggagctgaggggcggagtcaccggggcgcgcccccgcggctgcgctcctccccgccggggagcgcgggcacgtaactcggagggtgctgggccggcccggagcacgcgagcagcgggaggagggaccggggaatgactgacggaggcgggccgtagaggccgctgtgccccgccggcccgcacccggccggagtgtgcgcgcgcagcctgccagatcagcggcgggggcacgggccgtaccaagtgacggaggggggcacg

SEQ ID NO: 10796 - DNA, 719 bp, Homo sapiens
  source 1..719: mol_type = unassigned DNA
ccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcg

SEQ ID NO: 10797 - DNA, 958 bp, Homo sapiens
  source 1..958: mol_type = unassigned DNA
ccgcgctgtcagcatctcgcacagtccgcccgaaacaccagggaaggggttcgtaggtgtgggggtggggtggcgaggccaggcagcctggcgcgagggagagagccgaggcctgggccaggaaggcccttgggtgccgtgtgggcgcagagcccaggagagcgcactgccaggcccggacctccccgcccctaccccgggaagaggcccgttcgccgcagggggaaggcgggatcatagcacctcggaggagcggccggtccgggcatgcgggcggcggggcggggagggaggcttccggaaccccgagagagcacccgtgcctcgcgggccccgtgccccgtccccgggctccccttcctctaacgcaggggacccagcccggggcagtgccgggcactggcgctggcgccccgctcagccctgcgatccttctccgccccgcccctccccgctccgccccgcccctccccgctccgcccccgggccgccccgccccgcaggctcgccattcccgggcaggccccgccccctgtttccgctggcggcggcggcggcggcggtgccggagcgcgagcagagcggagacccccaggtcctgcgggcgcggtgagtgcggcccgggcggcgggcggcgaggcgggtctcgagagcgtgcggagtcgcgcggccttgagccggcgccgggcgggctgggcacccccaggccgagacccgagaagggggagcggccgggggcgcccacgggaggcagtgtgggcagggcggcggtgggacgagaggacgaggaacagagtaggcgccgtgcgggaagcgggccgggaaggggagggtgggtgcggggcccgggcaccgagcgaagtggggtcctccaggggatggctccgaggaagaccgtttcagaaagggagtaacccggggccggcaagggtttccgactgtgtgaccccgtgcaccg

SEQ ID NO: 10798 - DNA, 3843 bp, Homo sapiens
  source 1..3843: mol_type = unassigned DNA
tcgtaactttgacgagaagggctcccccgctgaaagcccaactgcagagcgcccggagcgcgctgtgagtccgcaggaacgcggccgggccggggacgggagaaaggcgcggccgggaccctgcactgtgccgcgcggcgcttgcggctggaacttggcctggaacgcggtcttctcggctccagtttcccgcccaggccccgcccacccggccgccccgctggttcgcaccgctgctccggccaccgaggagcccaaagttggcggcgtcccgcggactccggcggagagcgcgagggagtcgcggccgactcctgtaccacgaagacaactggaggccggcgggggaggcgggccacgaggggctggggcgagggagctgggatgcgcgggcccggctcgccgggaaacaggttgccgcggagtcccgtcccctccccctctgcggtccccgccgcgacctgattcccgccctgcccggggagctaacccagccgcctccggggcgccctccttcttcctggattcccacggctggaccagagcccctctggcagccgggttaaaggctccttcagcaaggtcaaggcgcggccggctggcacctggggatttttttccagccgagcactggcttttcaatcgcattgttaaggatcatggcagcggcaggaaatccgaagggccccacaggtctgcgggagggaggatttattttacagcaaggaacagattcagacagatcggggatttcagtgggaggggacgagaggtttcaggacgctggaatgtggcaaaaacaaaacactccccacccatgcacatcaccatctcctgactgcgggctggggggaagggagttcagggccaatgtgtcccagacttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattccggatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagataactgcatttctataaaccctctctccacggttagggggtgggagggagttagagatcgggtgggggcttggcgcggtactgttgagggctctgcacccaactgagcagtaatacactcatccacatggacgcgggtgcataaatcgccttaacattttgccctgaaagcggagccaatttccaaagttaaggaccacgcagctgaatttccagtactttccaacctcgcctaggcgggggcaggcagagaaggggcgggcagcgggcagctaactcgcccgacccccccgccaagaaggactcactaggtgaaccccccgcccttcacccaagtagttggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcg

SEQ ID NO: 10799 - DNA, 384 bp, Homo sapiens
  source 1..384: mol_type = unassigned DNA
ccggaagtcggggggcgggctctcatagctactgcccgtcaccagctcgttattgtgctcatatagggtgacttgaccccgaggcggtggaggagggaacaaccccagagagcacatcttgccggttcgcaggacgtctgcagtcggcaaactcctggccggaacggcacagaccgcactcccgcaactcggttcccgggctagattcgtatgcggacgggtaccgcaagggacaaacggcgaggcggaactcaacggaagtgaagaaaagactaacgggaaagaaggacgagtacgcggtcccgggacagacctccaaagcttcttcctgcgccccctggcggccggagggggagcagcgcggacacgtcccccggccaaccg

SEQ ID NO: 10800 - DNA, 1432 bp, Homo sapiens
  source 1..1432: mol_type = unassigned DNA
acgccctgcgcccccagtcggggcccctccacccggcgccggcgcgcagcatgccgggagttgcagtcctcgcgaggcaagttccgcctcgtccctgcttgggggaggaggttggagagccgccctgccggcctttgaattttgccgcgaaaagcgcgcgtggcggcccccggctccgcccctcgcaggacgcggtgccgcgtcaccctggtaaccgcctctcagccgccgctgattgggctgggccgcggggggcgggcgggggacgagacgcgggggctgctgccggcgctcgcgcctgtcagtcgggccagagcggagcagcgggcaggactgcctggccggctgctccgcggagaggctgcgcgcgccggccgggggaggcggacagccgggcccggcgcctgtggggcgcggcgcgcggcacccgggcctgagaccaggcgaggcgccggcgcgcgccagacggcgcgaggctgcggccccgggagcccccgcgcgccgcccggggccatgggcgcgtgagagcccagcgcgcgcggcccctgctgcggcttgcgagctcgcacacccggtgcacagtcccccgggccgtcctcgtgtccgtcctgcgccactgggatcggctgtttctcagcgccgaggcccccgaggctgcatccgagcttgcgtcgcccgctgccgccgccgccgccgctgccgccgccgctgttcgccggcttcccctccccccacacccggggctcagagcaggaggaggaggggccggtgcattctcgccgctgttctttgcaacctgcaggggccggtgtatgtccggcgaggagccggggccgctgcgggtgcgtgcaacccccgaaggagacaatccctccacctcggggcgaacccgggggctgcaagccgcgggcgggcgggcgagcgagaggaagcaacaaagacaggctgcagctggggctggcgaaaggggccgcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggcagcctctgccactcctgcatggctgcgacccgtcgagcggagcgtcgtggtagctgagacctggtgcccttcgacggcctggctgatccggtgagttgtgcggggcggggttctgcgctggagctgggggcaccccctggcgtccg

SEQ ID NO: 10801 - DNA, 325 bp, Homo sapiens
  source 1..325: mol_type = unassigned DNA
acgtcagcgaaggccgtctcggcgcatctcagacaatgagcgcagtgtgcaggagcgaggggttggcagaggccaggaagctcctggggccaggcgcggctccccacccccacgccagacaaagagcgcggggcctggggagctggcggccttcccgccacttggggcgcctggggggctctggggcgggggaggcgggggctttgtctaactccgccactgccaccaccggccaggccgcggcttggcaacccgtgaacaggaggcagggctgcagggcgtgagggatgatgacaaggaagccggaggagcagcggcggcagcg

SEQ ID NO: 10802 - DNA, 1242 bp, Homo sapiens
  source 1..1242: mol_type = unassigned DNA
ccggccctggccccgcctcgcacgcgctggtgctacagctgtggtgcagacgcccttccgctgcgagggtgcggccgtctcggggcgagtgcttcccggcctgcaggaggcgaactcgggcttccccgggaggcgtccgtgggaacgcgcacctgcgagtccctgccggctgaggagccgaggtctgcgacctctgccgacctgagctcaggcgcagcagcgcagacctggccgccgtatcccctctggctgggatgcgggcccacgcgggaaaggctgaaaggtggggaacaccccggcggaaaggaaccctccctctctgctctgaaggaaagtttcccaacacagccatgttcttggtggtctccggtcccccatccccaagcccccagtcagcctcacactcatccgcttcagtagccgcggagtgggggcctccaaagaacccagctgcagagcaagtccggctgacgcagtgtgcgctgggggcggggctctggacgggggcggagccacggcgagagccgcggtgagggcggggcccgggtgggcggtgccctgagcggggctcctagtgggcggggctctggggtggcggccgttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagccgggagtggaggcggccgccctagggagggaggagcgcaggcgggggctgctcacgggcggagtactgcgcggcgaagggaacccccgaaggggctgaccgggtctcggggccgtgacaggcggcgaggcggtgggaggggagcgtgtgaattcacgccgggtccccgcgggcgacgcgagcgacgcgacctggactcctatccgggatattgtaaatagatctgcttgtgaggctcacgactgggagcctgtcactctgcccaagcccgacccggccccggcgcccgcccgcgtcctgcggaggtcccctgagccagcgcgcggctgcaggggtctcggggccgcatcccggaccagcgccagcggcgggagagcgttgtctgtgagcg

SEQ ID NO: 10803 - DNA, 1460 bp, Homo sapiens
  source 1..1460: mol_type = unassigned DNA
ccggggcagtcgagccacccccccaaagccgacctccgggagagatctttagctggacgcctcccgccttttaggagcgatggctgcaactattccgtccgtccccacggggcgccttcccaacccttcggttggctcttcccttcgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggtcgctgaagcgcgcggcgagcacgaaggggaaaccgaagcgcgcgcggtactgcgcgttgagctcggccagccgcagccgctcgtccgcgcccaggctcctcaggcctgcgccgctctgttcccgctgcgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcg

SEQ ID NO: 10804 - DNA, 1064 bp, Homo sapiens
  source 1..1064: mol_type = unassigned DNA
ccgcgcgattgaggcgctagcggcggagctggacggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccgaacaccgggaccatgcactcagccgggactcccgggttatcctcgcgccggacaggcaactccaccagctttcaaccaggaccgccaccgccgccccggctgctgctgctgctgctgcttctcctgtcactggtaagccgcgtcccggcacagcccgctgccttcggcagggcgttgctgtcccctggtctcgcgggggctgcaggggtccctgctgaggaggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcg

SEQ ID NO: 10805 - DNA, 622 bp, Homo sapiens
  source 1..622: mol_type = unassigned DNA
ccgccagttagacggtgtttctgccgcccctgccgtcacccgctgggtcccgtcccgctccaagcgcactcccggcccgcagggtgggaatacgaggattacagtgccccacgggcgggcgggccaggatcgcaacctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccggggggcggtgctgcggggagcagaggtccgtgctcccgagccgtcgcgcgtggacaccagccccggcccaggtgcgggtgggccccgacgggagcgcgtggcaggccg

SEQ ID NO: 10806 - DNA, 1622 bp, Homo sapiens
  source 1..1622: mol_type = unassigned DNA
gcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgccgtcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccgcctgtgtcgcgggccccctccctggctctggcctctaaagcgcccccggcacagcttcccggcccttgcagcccggtggggccg

SEQ ID NO: 10807 - DNA, 324 bp, Homo sapiens
  source 1..324: mol_type = unassigned DNA
acgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcg

SEQ ID NO: 10808 - DNA, 1881 bp, Homo sapiens
  source 1..1881: mol_type = unassigned DNA
ccggggccttccagtcccgccggggcgcttgctcctcggctgagctcgtccgcagcgcggccctcggctactggcgaggctgtgcggaaccagaaggtcgaccgcgcccgggcattccccgcgcgcctctgaccccagctcggctccccggaagccgcctgggcgacttcgcggcctaatacccggctctgcgaaatcgctcgcgcctccggcccggcctggagggccccgcaccatccgcgcgcgcgcgcgctcgcacaggatccggccaacaggcgccgggacccttggagcccgccttgttagaaacttgctacgcgcgccgccgcacatgcgccctaggcccctccggacgcaggcgccaccgacctcgcttccgccccgcgccccccggctgccccgccgcgactccgggccgcgagcgctgccgcacaggcgccctaggcccctcggggcacaggcgccgtcgatcccgcttccgccccgcgatcccggcacgccccacgtcccccgcacctcagacccgctttccccgactcccactggacagccggggaaaatggcgccttaaagcgttcgcacccaccttgccgaaatgcgcggcccagtgcacgggcgtccagccatagaaggagtcctcagaggccaggtgggcgtggggtgtctgctgcagcagcgagcagagcgtggccaggtccccgtcgcggcaggcgcggtgcagcgggaaacggagcgagagcagctcctcgctggagaagcccgcctctacgcccgcgcccgctcccgccgccgacatggtccgtcaccggagagcgcggggctcgctggcctagaggacgcgtcggggaggactcgagaagccgccgccgcagcacaaaggaacgagactagcgccgcggtcgcgtcccacaggctgccgagcggagcgcgcacagagggggcggggcggggcctggagcggccgggctgggggcggggcctggcccagaggacgccttgtgcagccgggcaggggtcggggcctggagccgcggacctctggagccgccgggcagggggcggggcttgagccggaggccgcctggagcagccgggcggagggcggggcttggagctgcggacgcctggagcggccggtaggtggcggggtctagcctagaggatgcctggagcagccgggtagggagcggagcctggaccagaggacgccagcagcagccgattaggaggcggggcatggggctgtcgacgtctggagcagccgggcattgggcttgggctagaggacgcctggggcggtgggcgcctggagtagccaggcagagggcggggcctggcttgggtccacgcctggggcggccgggggcggggcctggctggaattgacgcgtggagctccggtggagggggcggggcctggctgggccgctgcctacagcggcttccggggcttggaggtcacggggctcggaggtcacggggctcggaggtcacggggctggctgtgtggggggctcaggggcgtagagtggccaagcagcggtctgagcgggtcccggggcctccggcgcggtgggtctcggctgcgccccgggtgcggaccatgatgtttccagcctgggagccggtccgggcggggaatcccggctgccgggggcgcgggttgaggctctgcgggcccgcgcccagagcgggtgggagtcacgggtctcccggaggcccagtagcgcgcggtgaagttgtccagtaaaaatttatggagcgcctacggggagcagggattctcgttaaaatctgggaatcagcaagccctagttccttacagagcaggacagattcctcggttttgtccgagggacgccttcttcggaaccgagtgcg

SEQ ID NO: 10809 - DNA, 944 bp, Homo sapiens
  source 1..944: mol_type = unassigned DNA
ccgcgtggggcccagggaggcgcgggctgcgggggattgcgcaaggccggggtttctggaggccgaggccgcggtgttttccgcgaggttattatgagctgagtgttcctggcaggcgcccagggactttccgcccccctccccccgcggccccggcgggcgccggccagaccgccccgccctcccgccagctcggaacgccctgtacttcccctcccggctgctcggcgcccgccagcggccagaaactcccgccccgccttatgcaaccggggacttcgcgtccccgctgccgccccgcccccggcctagaggacgggtctggggggagggggcgtgtggcgacgctgccatccaccagggcccagccgccgcccctccgagttgggccggtgccccgcgcggccctgcagccctgcagcgttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgcttccagggctccgagccgcgcggcacctcctgcggctcgaggcggatctcctgcagctccttgaccatctgctcgtactcctcgtctttcatggagtccaggccgctgtcgtggcggtcgtccagtagccgctccttcttcagcccgtcgcgggggccctccatggcccactcctgggggcgctcggccgcctggaacatggcgcggacgagctgcgggcgctgctgcgggtgcgctgggccgcgggctgcgcgctgcttcctcgctggggcgctggcgggcgggacggcggcacggactgctgtgggctctgcagcgccgccgcggcgccctataaacg

SEQ ID NO: 10810 - DNA, 1514 bp, Homo sapiens
  source 1..1514: mol_type = unassigned DNA
tcggcggcgccccctccatccagcgtgaaacccacgaggcgcggcgtctcgagtggcgggcgggcagggggctgcaggattcacgaagccacctccgccggggaccgccttctctcggagtggcctcccctccggcgttccgctttagtaagacgacactcaggccaaacagccgcccccggccagcccgactcggctctggagggagcgccccgagggagtccagccggaggcggagaaggccactcggccagaaggtggggagccgccggcgtcccctcgcacctccgtctccacagcagggggaaaggccctgatcgccgtggtccacaccaccgcgtccacctgaggctcgcctcgcttcctgggtccctagaggggtggcgtactccgctttctcctgcccccaagtggccgcacccctccgcgggacgcttggttgggtccagggcggggcgggcgggcgctccccgtactgccgcgagctcagcgcgcagctcccgcggctcggctgccgccgcggccagttggggcgggtcgggggcggggtctcagggggcggggattcgggggggcgggtcgggtcgggaggcgtgggtggggggcggggcggacgcggagcgcccctctggctggcggggccaaggggctgagaggagtggggcaggctcggcgccggtaggaagagtcagaggggtgaccagagagcccaacgcctggtgctcaagactttctccgaggtatgaacaagaaccaggcgtctgggccctttccgctcgccccatcgctcagccgccgcgccccggacgcccgctgtgccccctgccggcggggcggcggcgggactgggtttcgggagggtttctggaagtcgcgagtcccagcgaaggcagtgcaccgctctccgcctctttcttcgccttcttctcgctcccttagctctgggtgtcgggcaccggtggtaaggtcgcttctccgtgagtcggaggtcgctcactctgggacgggcggacgaggccctagggcagccgagcccggcagcgggggaggcgtggagctcggggcggcttcagcggcgggggcgggaggctggtcctggctgcagactgcgcgcctgggctccgtgcgcggtccctggttctctgcatcgcggaggtccccggatcacagggctccctggcgggccccggcacccaggtctgtgtcgctgtggctgggcgccgggactagcacccgagtcccgcgctcccgggggctgcgccgtgccgcctgttgtgcgcgcgcagaggccggacagcccggctgcgggaagggacccgagcgcagggtctgccccgcgtcccggaaagtgcctagtctgcggagccggaggttgagctggggcagatcggcgccagacgggggcctgggtgagatacgagttgggggtgcggcctgcagaatttgggtttctggaggagcttacggcgcgctggcggagccccaggcgaacaggagcaccggattcggctccg

SEQ ID NO: 10811 - DNA, 2144 bp, Homo sapiens
  source 1..2144: mol_type = unassigned DNA
gcgtcgtttccccttcgcgctcttcgaatgtcaagtgcaccagcttccaatccctcctctgggcgggcccggtctggctaatctcagctgcagattccagtacaaactcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaaggcccgcgccgcttcccactcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctccagccttctgggggcagaggacatcgggtgggggcgtgggtaggggaaggctctctaggcgctgcgcctggcttcgaacccccttctgagccgggtcaacttgaacccgcttcttcggcgcggacacccagcttccccggagttctctgggttgaggagaggtctcgcactgtacgcgtctctcactcccaaccttagggtccgccaccacgggtaggtgggcagtgtcagcgcccgaacttggcgatacccttgcatgaagtcagcctcgcgacatctaagcgggcagggaaacaaaggcagtgtggcacagcgggggcggcggcggggctgcgggggcccttggcgctctggggacccgggcgggggcgtgcggagccgcagccgccctgcagggggcgatcctgtcgccgtctccgtccgagccccaggtgacagagctgtgcgtggccaggcaggggcacctgttgaggcgggaggctttggcacccgccgagagtgcgctcgagcgggcgcattcttccagacgggggcggttggtggacgagagcctcggacgaccctcgggaactaccagggcggggcagcctggccggatgaggaccaggaagaggagagccgagtggggcgggggtaaaggagtgaggaagcgtggcgattccgacaaggaaagatctgggcctgggggtggaggggtgaggagatccgcgggggaggtgcaaggtccggagggctgaggcttgtgtggagccgaatccgagaaacgcatccagacgcg

SEQ ID NO: 10812 - DNA, 379 bp, Homo sapiens
  source 1..379: mol_type = unassigned DNA
ccgcccggcggggcgccctcacgctgtgttctctgcggtgcaccgaggcgcacccggctgtcctgttgcgggtctcctggtcacctgtgggccatagggagagacgcgcccacacactctcgcccgcgcccaggacagctgcgggagccccgggccgctctaacccaatgcgtctcccgcaggctgagatgcggctgctcctgctcgtgccgctgctgctggctccagcgcccgggtcctcggtgagtgcggtcctgccccggcccccggaggaacctgcaggggagtcgggggcggggacgcgcgggcccgcaggcaacgtccccaggaaaggggcgatgtcagggaagctgggctgggaggaggcgagcccgcaccg

SEQ ID NO: 10813 - DNA, 637 bp, Homo sapiens
  source 1..637: mol_type = unassigned DNA
ccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcaggtaagcccagcccggtgctttccaggaagtccgtctgcgggcgcgggtagggagtcgcaccggccatggtggctgaggagggagaggttgctgcccgccggccgcccgactccaggctccttcccgacgggtccgtctcggggagcaggggtgcgcgggggctgcttctgcgcgaacggcccgggcgggggacgtggggcgcgctgggcgtcgcccgccggtctaggcgcgcgaacctggcgttcccagtgaatcacccgcggcccgggcgcccgggttcgggaccggccccctcccctcccgctgagccgcggccgagctggctccctgcaccctacccagcgtcgccgggacgcgatcacaccgagatggcaccgagcctccttcaaaggcttcggcttgttgaaagtggggcggcg

SEQ ID NO: 10814 - DNA, 959 bp, Homo sapiens
  source 1..959: mol_type = unassigned DNA
ccgcgggatcggggggatggtcgaccctcagatacgggagggattgagcgatgcccaaggagagcaggagaacactgcgcttggagacccctgagagccaggggcgggccgccccctaaagggaccccggagtcccgactctcagctccagctcttcctgtgacaccaccctccggacagagacccaagctccaggcccggccccgcccagaggttccagggagaagaccaggccaccgcccactgcccggcgtcggggaggaaagaggaggagcctctgtgtgcccacatctctggccgcccagggcagctcggctcggtctcgcaaccccagcccactggttcgggagacctcaaaggctccaccgccagcgcccccagcgctcactgtgtgcgccccaccccagccctgcctgcgcgccgctcccgccaccctcgcctcagtctctgggccggaagccccctctcctcccccgccgcagccccctcctagtccctctccctccgccgatgcgggaaaccttctccgccccgtcccgccctcttcctccagttgcatctccgcccggctcctccgtccagtctccaacccaggccccgcccctccccacccatttcccgccctgggccgggcccccggccccaccgccccctccccggccccgccccggcccccggaagcctcaccccgcccccggccccgcccccccgaagtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggtgagggcggggcccggcggggcgttgggctggggtcctcgagcccctcacggggattgcggtcctgggctcaggccctcgttcctgcccgccccactcccg

SEQ ID NO: 10815 - DNA, 826 bp, Homo sapiens
  source 1..826: mol_type = unassigned DNA
ccggccgccagccctgggagcctcggttgggcgacgaagctgcgggctggggcaccggctgcctccacgggccggttctgactcaggggctcggcccggagctgcttccccggcggcggggctgactcaaccccctctgcccgaggagttgtcgcgcgcagtcagcgccccgaactcgcgcgcggcccggcgccccctcggggcccacctcccgggccagccgccgcgcctacctgtgcccgcggctcggctcctcctcgctcgcgctgccccagccggggctgaggtaccgggccgggtccccggcgccccgagtctccgccccctcctcctcgtcctccaactcgtccacgtcctcggcctcctggatggcgacgcggatctgcaccgccgtcttgggcccgggccgagcctccccgccggactgggccatggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgcggcgccccgccccgcgccgccgccgccgccgccgccgccgccaccaccccgaccgctagtggagcgcccgcgcaggcggggcctcggaggtggagggcggctttccggagctcctccgacggaggcccgtcccggaaggatccccgcgacccccgatcactccctccgtcttttcgccgctgtggggccccagcccgagaggaggtgtcagggctccctcctcctgcgccttctttcacggcgccgcagggatgggcg

SEQ ID NO: 10816 - DNA, 2156 bp, Homo sapiens
  source 1..2156: mol_type = unassigned DNA
ccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccccgcccccgcggggaacaatgggcgccggccggagaggctctgcggccgcggcgctcagggaaccgctccggagtgcagagcgcacggcccgcgcgggtcccgggcgtgcgtcccgcgggagggctggctgtccgtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaagccgccgcagctcgcgggttgccataggagcggctccagcagccgggcctgcctacctgggcttcttaaaggggcagcggcgcacgggccgggggctggaaaggggcggggggcgggcctggcaaggggcccaggttagaccctcgctagaccttcggggccggggtgagaggtatccacactgctgcgcccttaaatctctttcctgggctaagctgggagtgcgccccaagtctgaagctccggcttcagttgcgaattccccatcctaagattgaagggtggggggtggcttcccaatttctccatcaccaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacccagcccttcgaggtaagacttcgaggaaatgcgccggcaacagtgacggatgcgagatccgaacgccgacctccgcacgcgcctctccctcggtagttccgagaaagggacaagccggctgcagcggggagcggttgggccggttcctcggacg

SEQ ID NO: 10817 - DNA, 1441 bp, Homo sapiens
  source 1..1441: mol_type = unassigned DNA
ccggagggaggaaccaccgtaagcggagactccgggcggcggccggcggaagggctgggcgggaggcgtcgggatgccggcaggaccctgcgcccgagggggtagggggctcgtgtcggggttccaggcgcagattgatggggcctaagcagggaatgtgagggcggggagggcgtacaacggaagggactaatctcgcggtttcgagttgggagcaaacctcgccccccaccccccccatccgtttccctttctcagtgaagacggtttgggggcgggtggggaggcgcgtcctcggagcgccctcgcgctcccttttcgctccccgcgcgcgatccatcgcctctcttcccccgaggccagcgatggctcgggtgcgggcgaggagctgggagggcggctctcgacgcaggtgtcagatccgctcggcagtgctcggcgcgctggcccggcccccagctcctccggccgccgccccccgcccgccgcgccgcggcgccaggagggcggggccggggcgcgcgccgctcctcagcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgagcggtacgaccgctgttgccctcgggtgtagagcagtgaggcgaaggcgcgccctcccgagtgggcgagttcagcggaatggatcccccgattagcgggggctgggccggggaggggaccggcccgagcgcgcccggggtccggggctagttgaggccggtggtcgccgctccgcggagtcggtggggagcgaggcggggcccggccttcgcgcgtgtgccgggaggcgccggcccgtggcgtgtgcgtgcgaccgggcgagccgtgtcgagggggcggcgacttcgggcgtgtaaggagtatggtttccccgccggcgagggggtgtggtaaccccgggaacgccggctggagtcggacccgcgggctgctgacctgtcctcgggattgcggcgacactccccctccccccccttcccacaaattctatggagcgaccgcgggaggaggatcacgtggtgcggtcccgcagctactgtattcgattccacgttttcctccttacg

SEQ ID NO: 10818 - DNA, 734 bp, Homo sapiens
  source 1..734: mol_type = unassigned DNA
ccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccg

SEQ ID NO: 10819 - DNA, 935 bp, Homo sapiens
  source 1..935: mol_type = unassigned DNA
gcgtgcgacccgcgcccactgtggtcccgccctactgatgaccgtgaacctgtagggtgttgggccagcccctcaccccaaggctgggcaggcccccggagtccccctcggcccagacagaagctccctcaggagcgggggaggggaagggggcgcgcggtccggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgaggtgagcgggccgggcaggggcggggggctcggctggtctcagccccgggcggggagtagcccctcccccgcggcaactttgggggcgcgcatggggacctcgcggcgccgaccccccggctggggtctggcaggggtgggggacttcatccaggctccagccctgtggggaagggaccaggtgcggacgggtcggcttgggaagcggcggcgctgggaccctctccccctggacaccgccg

SEQ ID NO: 10820 - DNA, 1054 bp, Homo sapiens
  source 1..1054: mol_type = unassigned DNA
gcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacactcccggcttgactgactcagcccgaatatcccccaccccg

SEQ ID NO: 10821 - DNA, 1474 bp, Homo sapiens
  source 1..1474: mol_type = unassigned DNA
ccggacgctgtggcagaggaggcccgcgcgccgcacatctgctgggacccttagctcgcccaggattggtagggagatcctggaagaccagcgcccggaggggtgaggccccgtcttgggggcaaggccgcgaaaccacggcctgcagcttcacgccaggggtacaaagaaaagcgtcgccgggaacccaacacctgcagacgacgcgcagccgcagaggaggcggggcgtccgaggccccgccccgtatgctaatgaagcacacaccacaccgccccgccccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcggtgagcgcggcggcgggagggactcgggggcgggggcgcgcgcgttgctcatgcccgcagctcgccggggtccggtgtgtgacgtcactctgacgtaatcccgagctgtcgggggcgcccgggcctcgtgtgacagcgggcgggggtcggcgccccgagggctgcggggagccgccgggggtccggggcgcagggcgtgcgggcctggccggggtgtgagtctcgggggtccgggccggcggccctgccagccgggtcgtgcggttgcgggggtggggcggcggcgccgctgccatattagccccgggagcggcgagagggaggctggggtgggggcgcgaggggggcggcgcgaggggggccgattctgcgggcaggtgacatcacacctcgaaggccccagtgcgcgggcggcggcgcgggtccggcccaggaacgcccagccggtcgctggagctttccggctggtggggagcccatgtcccccacgggaggtcctcagccctcgcccttatggcggccggccccgagggtcaggtgggtctcacccacaggcaggtacttccggttggagctggttacagttgcccaatacccgtgtcgctgtgtgggctgtttgggaaagctgggctgagggcttggttcggagagcccgcggagacccgggtgggagtgtgtggaagtggagggagcggggagacagcagcatcggcgctggcg

SEQ ID NO: 10822 - DNA, 357 bp, Homo sapiens
  source 1..357: mol_type = unassigned DNA
ccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccggggatctcggggtctcccg

SEQ ID NO: 10823 - DNA, 814 bp, Homo sapiens
  source 1..814: mol_type = unassigned DNA
ccgccgggagccccggggctcggcttcagccccgggctgaacaagcagggaggggagaggcacttaggcctcgcctccccgcggccttcctcccctagccggggaggaggagacccaggaagccgcgcccggctccggtgggtggagggcctaggccgcgcctcccagccccgcggccctaggcctcggcccgcccgaggcggagcccgggaggtcggggcggggtcccgggccggtcacccacctgggttgccagtcattccagctccgcgaatagttggtgccgccgctgctcagccgagaccccggggctctgcggctcattaccttccccgacacgacatggccaagcgccgccgcccgaaccggccgccgccgacaccccgctccggcccggggctgaggaggaagccgagaaggaggaggaggaggcggcggcggagggcgggggaagaggacggccgttccgggttccgcctgagcccgcagggcaggacgagggagcggcgcggtgagagaggcggatgaaggcgaggcgacgtctcttccagggccgtgcgcggcccacgacgctggggccccggaggacgaggaggacgaggagcaggcggtggcggcagctcctcacgctcacacggccactgcttccccgcctcccggctccgcccgccgcgccgccgctgtcgtacggcaagctgggagcgagaggcggggtcggccccgccgggcctggggagagaggcgggtcctgtcggcggggcggggccgatagcaggcagccccgccccccacggccccaggctcttggacggcg

SEQ ID NO: 10824 - DNA, 847 bp, Homo sapiens
  source 1..847: mol_type = unassigned DNA
acgcaaagcgcctttttctccactttcggagatggtacgtgcgcgcttccacgcagtggcggctgctgcggcgagcacgtcccctgcgggacccacgcggggagtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacg

SEQ ID NO: 10825 - DNA, 589 bp, Homo sapiens
  source 1..589: mol_type = unassigned DNA
acgggggcaggcgtggcgtctctgggactgccggaaaacgacgtgagggaaaaactcagaggctacgaaaaggcgaacagacggagggcctgcctcaggggagctaagcagctcgcctgaagccccccatctggaaatgacgtgtttaactcggcgcccctgcagctccggccgcccttttttgtttaactccgcgcccctccagctccggccgcccttttcgtcgctctcccctcgcggtcgctcacccctgagatccctggttccactgagacgctcagcttcattcggcaactcgcggacaccaagcgccacaaattcaaatacgagatctagagacgctgggtctcaaacgtctcccagagtgaaagacagaggaaccaatcgaggctcggctgacctcagacgtctaaggcgataggcgttgctaagaaaagggggtgggacgatacccagttgccaagacgacggcttccgggtgggcggcttgaggtggcttccggccgccaggcgagactccgcgggaaaactccctgctagagagactaggagatttggggctgcggccgtttcctccggagcacccacg

SEQ ID NO: 10826 - DNA, 848 bp, Homo sapiens
  source 1..848: mol_type = unassigned DNA
cgcggcgcactcccccccccgcaccacacacacacatacacacgatgacacacattcctgtgttcccctcgatgtaagtggcctcgcctctcgctgggccccaggtgcccctgcaggaaatgcggaggcgcggggagtccagggaacgggcttggggtctcaagttcgtgatccccaccctcaccccgggctccagccctgcggcgccggcccgcagcggactcaccggacgatgccgaacatgacaagcacgttgcccagcagccccacggcgcacacggccgagtagagcgcggtgatggcgattgccagggcgagggacgaggcgctccgcgcgcctggcggccccgacgcattggcgccagcgctggggcaggcgctagggtaggcgtccgaggcgttggcgaagagcgggggctgcagctcggcgccggcggagggggccggttccatggctgccggccggctccgccgcgtccctctccaccgtgcgccctgggcgcggggatccgacgcgaggggagcggcaaggcagaggccgcggccccgacgccgccggctgccgcgccccggccgccccgctgtctctgcgcctcgtccgcctgcctcgccgcccgcaccggcccagcccccggcgtccgcccgctctcctcgcccggagcgctgtgagccaggagcagccgcaggctcctcggacgcgcccgccgcgcgcaccacgtggcccggaggcggccgccagtctgcgcccgcgaccgggggcggacgctgcaccaccggctcggagctgggcaggggaggcctcccgccccctccctagggatgctccgccggctcgagtgcgaccccgt

SEQ ID NO: 10827 - DNA, 1230 bp, Homo sapiens
  source 1..1230: mol_type = unassigned DNA
cgcggcccgcatccttcctgccccgcgggcgccctgcgacccctcccactgcgtccggttccgacagaagtccagggagcagtggccctcgcgccccgtacgtcagacgtggggccaggcggcaggcccccagcccaggaatcggggagtcccctcggaagggtgtgctatccggagtcagcggctccccacgcacttcctcagagtgagaacgcacgcggcgcagccaccggcccgcttctcccaccgggggctctcggaccttcaacttgcctggggctgtctctgtccctcgggcgaggggctcctggggacccaggacacctggccacggggaggcggggcatggggggcagaaagccagatggagcgggtaggagaaggggggtgctgggaggagtcaaggagggagagagggggcgtgcatggggcgcggagttaagagccaccgagcctgggcgcggtgtgcaggcgagggccacggccttcgcagcagcggggaacgcggggagtcgaggcacccagcgggccggggaagaaggtgggggactccgcggacgccgaggagagggcactgcggagtcagcaggccctgtagggagtcggagaggggctgagcagatcctgaaggcgggcgggggacgcacctttcggcggggcagggtgcccccggacacggcgagcgcgcggtacagctcggcagggtgatagtcctccagcgccgcgtacagctcgtccgctgggggcccaggggtggcggctgcggcagggggtcccggggtcgggaccggagcggcgggcgcgacttccgagtcgggagtccgggcggcggggtccggggtggccgccgcctcctccttctgctgcagcttcctgagtcggcggagggtcatggctccggcgccggacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgt

SEQ ID NO: 10828 - DNA, 1094 bp, Homo sapiens
  source 1..1094: mol_type = unassigned DNA
cgcgggagtcccccgagccccattggccttcccttccggccgccgccacgcggggcgccgcgtccccacgggtctagacgtccagccaacttcccggctctgcaaaagcctctgggggtgcgcggggctgggcgggggtgcggcgtggtctcccccagggtgggctccaaagctcccacccccgtccggggcgctgacaccgccgactcgcaagcctatgccgcgctcggagcgccgcggggccagcacgcccgggcgggcggcccggaggaggcggcggcacggctggggcacccccggctccgatccgcgatgaatggggcggcccgggccccgctccccgcagccccgcccggaggtcccgctccccgagcccctcgctccgcggccctcgccagtacgttgcccgggcgcttcccaaactgcccacggagccggaccccgcgctgccaacgctccgctccgggcaaggctgcggcccccgccgggccccggcgctcgctgccccgcacgtccgggcccgggaggaggaggtcgggggagccgggccgggcgccgcgagcgctgggagggtccggccccgccggggagcggcccccgagggcgcaggagcgggagccgggccggagacccccgcgcagcccggtgacacccccgccccgcgttccagcccggggtccccaggcaccgcgcgcgcccaggcggcgcatccgcactcacctccgctccgaggcccgctccgcccgccacgccggccgccgccaacgagctcccggcccgcgccgccccagcgctctgcagcggaggcgccgtcctcatcccgaccgcaggcccgcccgggccgcccgcccgccgggcaccgagccgctctgccgcgcgctgcgcctcggggcggggtgggaggagagggagcagccgccaccctgcccaggtcgccgcgggccagccctgcagccagctccagccctgggccgggtgctgggaaggccggacgccggccggcggccgcggggtctgccccccggaggctggggcggcttaggttacagactccgccgcccccgcaccctccccccagctatttttagcgccgc

SEQ ID NO: 10829 - DNA, 1979 bp, Homo sapiens
  source 1..1979: mol_type = unassigned DNA
cgtctacctttttcgcgtgttggagaactaactagcaaggcagggaatgcggttcgtgggcgcttggcctcctcaagcggctcaggctctcagagcgcgaggcccaggggctctggagccgcggccgcgacgcgcccgagggccgttctcttcgacggcagagcaagagtcaccgcgcgggagccccgagcgaccgccccgctgccccggtaccctcccctcgcagccgcccagagctcttcatgccccgtgacgcccgttagggcagcgcggccggaggccgggccggacgtggcccgagatgtccgggggcaggcagaagaccacgggcacgcgacaggcaaccgccgcctcggctctagaggtggacgttttgtctccctgcgcttcaataccagattttgtttccagacgacatccctgttgcttccggcacttggaaagaccaatcgtcaggcccgagaatgcaagacccaccctcctttgcgacggaggcagccaatccagttgctcgctacttccagtgtcgcatgcgcccttacgcaggaccctgcccaatcgttaccgggacgtcctcctagtcccgcctccggaccgccagagaggctgtcaatcccgcctctctccttcactccattagcgcactaactcacggcgctgtgacgtgcacagcccctgcggccggccggggcgggccaatggcggtggcggatacggcgggccaatgggcgggagcgtctcatgcggccggctcccgccgcagccgccgctgggtcctggagccagaggccgccctgagacggtgcgcgatggaccgagggccccagccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacggtgagaggcgccgctggtctgggggcggtggtcggggcgggcacggggcattcgcgcggccttgcggcctgcaggccttccccggcgacggagctgcgccgcgggcctccgggcgggcctggggggtcggggccgggtgggcgggggtctttgggggcccggggcgatcgtgagggaccaataatgggtcccggagcgggcctacgggtccgggttcggggcagccgggggtctttgggggcccggggtggccgtgaggggcccatagggggctccggggggggcctgggaggtcggcggagcttgggtcggccgtaaggggcggacgggggctccgggcgggcctgggtggccgggggcccgcggcggctctgaggggccgattgggggctccggggcgggcctgggggccgtgggggcccggggcggccgtgagaggcggacagggggctccggggcgggcctcgggggctcggagcggccgtgaggggcggacggggggcttcggggcgggcctgcaggtcttggggacctgaggctgccgggaggggctgccagggggcgctggccgggcgccgggttctgcggagctggggcgccgacctctgacccgcgagaggggcgccttcgccgtgctggtcgtagttgttattctcagcgtccctattattatcgctgttttgaaatgagagcaggcggctctcgggctccgagccggagggggagggcgaactggggacctgggggcgtcggggttgcaggaggcgcgcgtaggccgaggaggggcaggaatgcgggcagccgtgtggggggtgttagggggagggtaggcgggcgggtgtggggggtggctgggaggaaagcggtggcggtggcgg

SEQ ID NO: 10830 - DNA, 1930 bp, Homo sapiens
  source 1..1930: mol_type = unassigned DNA
cgcggggagaccggggcgcgcggcacgcggcgctctcacctgtggatgttcatctcccgtggagggcggtgggccttgtcgtaggagaccttggcgaagacgccggccacgatgacgaaggcgatcaccccgcaggtgatgtagacggtgaagttggtcttgtccttctccgggtcgtacttgttctcgggccccggcgacaccaccttggtgctgggcgtctgtacccacaccgggctctggtagttggtgcactggcgctggtccagcttctcgtggcgcttcttgcagcagaagcggtagtagcaggtaccgcagcagtacaggtagccgctctcgctgttgttacactcgaactccttgtcgtactggccgctcacgtcgtagtagccccagcacgtctcgtaggtgacggccgcgctggccgccgccgccacagccgccgcgggctgcccccgccggcttcccgcctccgggattccgggcgcccgggcggtgccgttcagctcgcggccgccccgtgccagggcgcccccggccctccggcccccgacggcagcgccgcctgcactcagggtccggttggcggcgcggccgcgggctccgtggacgctgggcagcaggtccagggactccagcgagagcagcagcagcagcaggaggcgccgcagcgccatggcggggccgggcgggagggcgcggggaggcttccgcggcaggccgctcccccggcgggccgggctcggaggacccgccgcgcgggccgggctggaggcgctgagcggtcagcggctccggggcgatggcgccatcgaggcgcgggcggcagtggcggcggcggcgcgcggtgcgcacggaccggcccggcgcgggctgctcgggctctcaggctgcgcgccggctccgcgctccccctgcgggctcggcgcgcctcctgggcagccccatcccccgccggcggtgactgcggccccgcgcgcggctcggctcaggcaggacccgaagcgcggctccgggcggcggcggcggcggcggcggcgtggtcccgtccgggcgggtcctgcgggacaagacggggagccggtcacggggtggggcgactggcgctccgggagcaggaggagaaccgcgggcaggcgggcggggagggtgcgcgcagccctcgaggagagagactcggagccgggaggggcgtagagcccgctcccaagacggggtcccgcggccctgcgcgcctggaaccgagagcgcacgggccgcccctccaggcgcagctcggccgcccgggtcccccagccgcccggccccgcagcgcgctcccgccgcaggctggctccctgggacggagccggttgaggctggggtccggcggcgagccgggagagcgcgcggcggctggacctcactcactcaccatgcccggctgcgactgcagaggcggcggcggcggcggcggcggcggcggcggggcgaggcgggaacgcagctgccggagcgagcgagcggagagccgccggctcgccgcctgcactagtgccggaacgtgtgcgagagtgagcgagggagacacacgcactcacacacccgcacacacgggagcgccgcgaggggaggggggacaggggaggggagggcagccgctctccgccacccacgtttgcacgcccgggcgctcagggtgcggggcgggggggactccttttcgcttcttccggatcgcagcagttgaagctccgcgtcacgaaagctccggacagcagttattcgacacggcgaacccggcgggcgaagagggggccgggagcagggcggaacgtccgctctgcagccggcccgcggcagggactgacctcccctgccattgccttctctagccttcgcgaccagtccccaccctaccggagcccggggcagcgcgctgcctgagcgg

SEQ ID NO: 10831 - DNA, 3177 bp, Homo sapiens
  source 1..3177: mol_type = unassigned DNA
cgcaggtggggtaagcccgggttaccgacgagacctgctcgcgtctccgctcccactctggtgccccctcccctccctggcagccccccccccatccgcctaccctccgggctcacttcgactcacctggcggtgggtcttcttcccccccgacccccggcggtgcggcccgtcccccttctgaccccgcgcctggccgtcgtgccccgaaggatatgggttacagaccgtgcggagacaccagctccgcgggcggctgtcctggctcaagtagaagaaaaccaccggggccagcgccgggtacggcagcccctccgcctcggagtccgcgctgcccgggtccttttctgctgaccccggccccggccggcccccggcccccgacaggtcgttgagccgcatgaagctccggggctgtcccgactcctcggcgcccgctccatcctcctcctcgtccatcctctggccagccggggccccgggcgatccggagaggggcaagcggcgcccctcagaggaggtgtcctcacgcaacccgggggccccggcgggggcacatctggtgggctctagggcgcaagctgagcccccgggagggccagttcagcccagctccccctgcccgcaggggcatgctgcccgcggggcgccggggcgcagggaaaccccgcccggcgcgagtcccgcttcccctgcgcccctggggcttcccgggccagccggccggctccccctcactttgttccggcttcttcgcttcgcgcccaggctccggttgccggattcggcgctaccttcggcgaagccgccccgagagggcgaacgaaaaggggggcagcggcggagggcgggggtccggggaggggcgccccctcttcccgcggcgcagctggagccggatctaaggggtcagcatcgtcccggctccgcgccaggcggcgggggaggggaggagggatctctttaggggtgggcttggagggggtgggggcggctccttcccccgccccgccgcgggctcactgtccgggaggggcggggagacagtggggggcagtcccgggcgggagtggaggcggagatgccgccgccgcagccgccgcggtggctgccgctgccgtagctgtcgccggcgccacagcctcctcctccggccgagacgcggagcgagcgagcgaaagcggcggcgaggagccccgcgcacaccacagctggatccctcacttcaacttcaagcctcggccccgcccccagacagccccgcagccaatcgccggacgccgccggccccgagccgcgcgcccattggccgtccgccgtggcagtgcgggcgggagcgcagggagagaaccacagctggaatccgattcccaccccaaaacccaggaccgcccctctcccctccccttgcccctgggtccgctcccgaaggctggagccaatcagactgctgcccagaccgaacccactttcctattggccattggggtctttgggactcccttggagggagcccgaagaatcagagtattcggcgcggggtcctggcgtagggccgcaggccccaggcatcctttgtccacgacccctgatttgggcagcagccggaggacggagctcagctctgggcgggcctggggaagaaaggagacaggcggcacgggggtgagggttgtcaccagggggtcccagagcgaaatcccaggtctccacctggttaatctcccaccctggagttgagcttggctgcgggactgggggagggaaggagcggagctggatgtcctgggggtggggcttcaggctggaggggcccagtcttggagaaacgggcggagctcgagaaaggctagggtaggcatggtctgggcgtggcctccacaaatctcttgggcttattggtcatactcccgagtcaattctgagacttcgaccctgacctcgtaaccctaacccgctggacctgacctcacattgacgctcctgggcttcatccctttgcccctagggaccttttgaagggcgtggactccacgcaggggcttcgtgcttgaacacgtggccccaggcaggtcgcgctggaccgcagagcccggatccccaggaggggctgcggagcagagcgaggacccctaagaaggaacctgtgggggtctcgagtgtgtgggagggggcggaagcacagagctgggctttatcgactcgaccttcaaagtccccaccaccgccaccccccaacttcgtgcctcagtttctcttaagtccctatgtggcttagggaaagagtgtccgcggaactggaacttcgcgggtctgccgccttcactcactcaccttaaccctaccggcagcgggccctcgtgggtttgtgctttccacgcgtgcacacgcacgcgcagaccccggcccttgccccgcctacctccccgagttctggggctcagtcggctctagctctctcctgccgccggcgccactccagaaagctgtgggtacccgggagcggagcgccgcgggtgtgctgggcgccggtggaggggggaacagcgaggattagacgccgggaagcacttccccaacatctgcgagaggtagacacggcggaacctagtgggtcagtcagttccctctccggagattttggggcgcttgcgccactgcggagaggcggcgggatgggtcggatgacctccatcaccacccctcactttgctgaggccatcacccctgggcgttgttcactctcctaaggctgcaccacccacgcagcccccgcgcacctcccgccaccgcagagggttggggtcgtctcagttcccgccccggccgatggggggaggggatgggggaagtggcagagtggctgctgcgccgtcgtctccctggttgccctttcgccgaatccatgcacagagttgtgtaaatgaggccgggcgggctcatttgcatttcatgctaatgagcagatcccctaagtgcctttttttcctggcgggagtctctgctctcattctgagtatgcggcgcctgagtcttgaaccccgtgccgtcttctgggaaaggggggctatttatggttgctccgcgcgtctgacaccttcttccctcccgagaggccgcagtctgccgggtcggcctgcccttcccgccaggatagaggccccggggctggcgcga

SEQ ID NO: 10832 - DNA, 2195 bp, Homo sapiens
  source 1..2195: mol_type = unassigned DNA
cggcagagaggacgccacccacgagagagagtgaccgcggactcccaccgagaggcaggcggtggaggggctcctcttggagaccccgattatggagtggtttcccctccctccagcccgagccgcagcgccgggctcccccacccccccagtccccagccggctcgggtttgaaaactttcagcgaccgagcggagttggcgcggcgtccccagcccgcaggatgtccagtccccccgcctctgccctcgcccactccccgccgtcccgacccgactcttccgggcggcggagcgggaaggcagcagcccttacctgggactcgccgccggccccgctccagcgcagcgtttggggccaactccagccccaggcggggggcgggcgggggtgggagggacgcggcgcggggcgctgggccaggcccggtcctggctgggatggcggggcccgggccgggacgcagggcctgcctctccctgggaccgaggctgagccaggcgcgctgggttgctcgctctcgcgcgggcctgtccccaggcagggctccttgctttcggcgagggtgggctggagcctgcatcaccgttacatcacctccattcagggcgctaatcgggcgcccgccgcgctccaggtacgtgcgctccgtttacacaggaacaaagcctgcccggccctccccgccccgactcacctccaggctgagccgactcgtactttccggctggtgagggagatgggagtttctggccctgccggcgtgtgggttgttgctgttgactgccacgcccccgcatgcgggcgcgcgcacactcacgcgcactcactttctgggctcggccttcgccggggcaattggtgtgagggtgcagccctgcgcaccccccaccgcgtcttccagagagcgcgcctacggacacgcgcggggctaccttggcgcgtctccgtgggggacacctagcctttgtcaccttcgtcctggccctcccgtgagacacacttcaggcacagttcgctgggagcgggccggagcgaggcgcacactcaagacagagtccgtctttgtcacgccttctgcgccccctcccctccccagcttgcacacgtggacacaccgcacaccgaggttcgccttttgcacgcacggtccttctctgggacctccaccagtcaccaagcgtacgtgggatcgtcaccaagcgctcctctcacgcgtgggccgagtccagaccactctggaccgtgggcaaaggtccccctcggcccgactaccccgcgcccgggtttcctgtgaccgttccaggttctgcccaactcggagcgcgctctcccctcccggcgtccccgttccctgctccgacttgtcctaattagccttcacggttttgttccccgaggtacagtgtttagcgcgaccccctgggcctctgcgctccgggacacgttggctctgactccgagtccgtcctttccaggaggtcaggttcccaccagccccaccccccactccctgttccggggtggatctgtgggttgccaccctttcccctccggccccaggaatctgctgaagctggaccgcagaaattgggaagcgaatccaggctggtacttatccagcccgataaacaagagattttccggccgccttcccccggggctgctggcctcgcggggggtggggtgcgcagtcctgggggcccgcagcgaggcctagttagcccgcgccagaggcccgtaggggctgaggcgcacagaggagggagaggttgttgggcctggccagggccctggagacgcggagggagggcagggcgccgagtctcggggtgccggttctcatgacgccgaattgcctgggggatcgccagcggtgcgccggtcggagccagctggtggcggggcgggcggcccggagtgtttgctcaaccctgagcgcccgcgagggggaggggaggcagctggtcacgggctagggggtagcaaggtggaggagcgggggctgggaaaggggagggtatctcccgggctgcttgtttgcgtgcctgccgcggtctacgacaaccgggagtctaaactctatgaatcacccggagttgctggagcgataaacctcaggctggttcctcccctcgcacaccggcttctcggactcctggagggaatgtttgcttagcggccggagctggcgg

SEQ ID NO: 10833 - DNA, 2063 bp, Homo sapiens
  source 1..2063: mol_type = unassigned DNA
cgcttaaagcagaggcggcaaccaggcgctcgggttacgttatctgataacaggacagatgttgtacggctcgttttcctcatacgcattactccgcagtccgcagcaccgttagaaaatccacctgatttcagagccgcagagcgcccaggggtccttctccgcccacccgcagcacgccccgggtttttctcttcccccaaacaacggcaccgggctcctgcaccaaaacacggcgggttcgcgcctgccatcaccagtgcaaaatctgcggggggctgcccggaaaggaccgaatttcaccgctgcatgagttttaaaagggagggggcacatccatcttcagccctccattccactcccgtttgattgtgatgcacaccgggcgtctgcacagccccgtctcacactagcacacacgcgccccggccccggccgcttcccgccgctcccctcaaacccggccggcccggggcctggcgccgcacgcgggtcgctaggggccagcgcccgccccggctcggctcggccgaacaaagggcccgcgaacctcccggcaaagttgcggctgcggcgaggagcgggcggactgccgcgctcacctgggctccgtccccggcggcggcggcggctccgcggggctccggtggcgcgggcctggcggcggcggcggcacgaacaaccgcccgagggcctcgggagtgcgcgggcggcgggggcccgctcagcgccggcgccacggactcaggtcccggcgcgggcggcggcggcggctgcggcggcggcgcgggcgagtgggcggcggcgcgtcccggcaggtccaggtccggccccggcaacgccgcgacgcgtcctcctcctcacgcccggcgggatgcggctccggcggggtccgggtcctaggcggcggcggcggcggcggtggcagctgcggacggctgggcgcggggccgctccgctccctccgcctccggctcgggcgggcccgcggctactgcgacggtgacggcggcgggagcgcggcgggcgctgggactgccctgtcagggggcggcccgggcggcgctcaagactgcgcggcggcggggccggcggcggcggctacggctcccggggccgtcgcgctgaggtgcggagctgccaccgcggccatcttgttgctctaactgacaagaacccccctccccccgcttcagccagacggggcgctcgcgcccccttccccgccccgcgttggcctccaacaggaagtcgtcccggcccctagcacgtgactcccaccgtatctgcataccggagggcgaactggccaatcggcactctgcacctgagctcctcccccgcgcgcccctcccggcccattggctcctcggccaggccacgcctcctcctttccccttaatacccgcccgcgctgtggttccctgcaccgcgcggggagcgcgccggggtgcgagcggtgcgcgctccgagtggccgggacgcgcgccagtcctgggagcttgcactgctcgggggggttacgtggagacttgcgtggtgtcctttaccgccgccgcctgccctccggtccctgggcgctgtggctccgcgttagggtgctggcgggaggggtgccgatccggttctgcgcgtccggtgggttctccgggccagcgccccgcggcgcccgggctttatgctgtaattgcgcccggcggcgcccggcgcccgcaccggcgcgcgtctcgcccgtgccgtgcacacgccctgcaccgccccactttgcacacgcacacgcacacgagtccttggggccctggagcatcgtgctcgcctcgcgcctcccggcccgcccttgcgctcagtcgctccccagggagcgcccagctgcgagcaaaacaagcctcgctgcgaaacagtcccccggggagacagccctttccccggagcacagacaccacaccttcaccgcgcaagccttcggtccgggccgaacccgggcgctccggcgcctacgcaccccacgattcctccccggtgctccgtacgccgccgtgatcctccattccacggctcctcga

SEQ ID NO: 10834 - DNA, 816 bp, Homo sapiens
  source 1..816: mol_type = unassigned DNA
cgcagcaaagagctccgggcgccctgggggagagcggtcccaagcctcggaaagtgggcagagccccctctcccagggctgagacggcaggcgcggggctcccctcggacccgccccgccaaggggacagtgtaggccgtgccgcgatccagacccgacgcctccgcgggctccgcggcgcccgggctgcctccgccggctgggagcgctcgagtggccctcgggaactcaccgtgaagcaggagggccgggaacaggtatctgagcaggaggcggcgcggccaggacatttccagtcctgctctggggcctcccgcacgccgcgctccgatttggtgcccgggcaactgggcgcgcgctctgccctccgcctccggccgggtgcggccgggccaggccggggcttcaggcggctgccgcgcgccccatgcccggcgggctaggcgcggggctgcggggcgcgcgctctctgggcgccgtcgggcggctgtgggcgccccggcccggtccgcgtcccggcctctctgccgcccgccccgacttctccgcgcccggccccgcgtcccgccccggccgccgcgtgcgccgctctgagctgcagtggccgccaccgccaccgcagctgcagcgtctcttcatatttccagcgcgccgccggccgggcagcctggccgcggcacggaggaggggccctggagggggcggtcgggggaggcgacgccgagccaccgcccccgggcagccgccgccgggggggagcgcggagacttgaaagggcgcgtcgggcaacgcctcccctcctcccactccgggcgc

SEQ ID NO: 10835 - DNA, 368 bp, Homo sapiens
  source 1..368: mol_type = unassigned DNA
cgtgccgtctgcgtccgtgggctacacacaccccctcttttctcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatgggccacagcgaggtggtgcgggtgatgctgctgcgcggagccgaccgcgacgctgcgcggaacgtgagtgcccgagtcgcgcggccaaagagcgaagcctcccggcgcgcctgtgtggagaaaacgg

SEQ ID NO: 10836 - DNA, 1411 bp, Homo sapiens
  source 1..1411: mol_type = unassigned DNA
cgtcccccgcgctcctcccgcgcgcggcccctggagtccctgaggcgcgcggccagcccagctcgggcccgcagcaccgggagcagcccgccggccaagcgagcgcgggccggggccggggccggggcctgggggcgccgcccccgggagtctttctgcggcccctgaggagcgagggcgacggcgaggctgaccggggccgaaaccatgaaccgaagttttcacaagtctcagaccttgcgattctacgattgcagcgcagtggaagtcaagagcaaggtaagccccccgcccgccccggcggccctgcgcccagtctcctggctaatgaatggggcgccccgcggagggggactggggcggcgtggaggcgacaggcgccggcgacaactttccagttcgggcgccgcgcgccgctccgcgggacgcgcactggggaccccggccgtccttcccgccccccgcgcggacacaaagcccggcagccgcggcgctcagagggccgagggccatcggacagtccgggcagactctggacccgctccgcgggagctgctcttttgttccacgagtgagaggcgatcggggcgcgccacacattggaggggagggcggcctttccggggcgagttgagggccaggggctgctcggattcggggccgtgggggggctctgggggcccgggccgtgggatggccctggccaaggcgccttcaaggctgcaaaggaggcttgttacctgccaggaggagacttgccgccggctccgagcccggcgtcccccacccgctcggtaccaaacatctaggcaccaggcgcgctcccccgcgcagacccagagcacgcacccggctctcccccggcccagacccagaccacgcctccccgggcgcgtccccgggccagacaccccaccccacccccacgggcgcgcccccaccccagactcccccacctccggacgcgcccccgccccagacccagcccactcccccgggcgcgcccccggctcagacccagacccctcccgagcgcgcccccggatcagacccgtacccagaccacccccacgggcgtgcccggcccctcccgctgcctgcgcccgggcggagcgtgcccgaacttgcgggtcgcgatgcgcgtctgggtaattggctggtaggatctggcgcttctgccctttgcgggggtggttccttcgccgcagatgctattgtttgtgagggtctccttggtggaccccgcgggctgaggaggtgctgcagttgttcggggtcctgcgggagggggcccctcgagtctttcgctggctactctctgggagttgagcggccctttcgccctttctttcttcgcaccccggttctcagagttgtgggaaaggctcctaacggcggagtgggagcccgc

SEQ ID NO: 10837 - DNA, 1487 bp, Homo sapiens
  source 1..1487: mol_type = unassigned DNA
cgggccctgcgactcgcggcggaggcgcacagcaggcgctcaaacgatcgtgggttcagggccccgcgccagcgttcccggggccttctggagagaggcagggtcccgccgccccggttcccgcaggaatcagctggagaaaggcgggcggcttggggctgaacttcctccaccccccatcccccccgccgcctggagcagacacgtcgccgccgcgcccctgggaacggtcagggaagcaagcagaagccgggaagccgcgaaagaggcgagaaagtgcgaccccctccccagatccccggtcccccgtcgaaatccctgtcggccggtcaaaccctagacaatggaagctccacgttttcatcctcattctcccccacaagtccggtcgcgggttcccctcggcccgggaccccggcgccagccccggagtcggagcctgcacgatacgccccctcccgccgctccacttctccacccggagatcgctcaccccctccgccccatccccccatttcccgcttggccggccccgcccgacccggaggcggcgccccctcccctgtcccaggcccaggaaggaggacggcggaggaagtagggggtcctggctgcgggcgcagggatgtgggtcggcgatcggcgtccgagggcgtaaaaaggcggcccgaggactgcgcgcgggcgggcagcgcgggaagccgggaagaaaggagggcgcgcgggggaggaggctgcgggtgcggggcccgaggccggggcgctcactttctcgcgccgctcgcgctcgccgtccagctcccgctgcaggccctgcgcgcggtcttccgcctcgtccgcctgctgctgcagggcctggatcttgcgtttcaccgcctccagggagttgaggccggccatggcgcggaggcgcagaggcgcacgggcagcggcggacgctcggctgggctcggctccggcgagagctgcacagccgcgccccggccccccaagcctttgcctgcgcgggggccgcccccgcctctccccgccccccgggccggctgccgtcggggcgatgaggtcacccggccggaccgccgacgtcagcaccgctgggggagggcctgacgtcggcaccgctggccacagctgctggaaagtgccccttttcgggacttatttggagaaagcgctgggaggcgccgccttctcctcctcctcttcctcctccccctgcggctctccccgccttcccggccccggggctccggcctggccccgccgcgggctcccgcatccctgcacacgtacgtcggaggccttcttctccgtgagctccagcttctcctgcgcgtccttcaggtcctcggaatatttatccagctcgtcctctgtcccttttagtttcttctggaggtgcgtcagctcctcctccacctggggacgacagagcgaggaacgggtcagcctggggggggggtcacgtccccgaggtgcaggggcgg

SEQ ID NO: 10838 - DNA, 602 bp, Homo sapiens
  source 1..602: mol_type = unassigned DNA
cgcgcaccgctgctgtacctcccttaacgtatccgtaacctccctcaacgtatccgtacctccctcaacgtatccatacctccctcaaggtatccgtaccttcctcaagctatccgcaccaccctctcttccatttcatgcgaagattgtagtcccgcagccctgcgaccagcggccggaagcagctaagatgctactgctcccagcatgccccgcgaggcgcgcacagcacaggccctctctcaaggtcaccacctccactcccgttgtatgctgggattgtagtccggccgccctgtgactaacggctggaaccgcctaagacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcgg

SEQ ID NO: 10839 - DNA, 628 bp, Homo sapiens
  source 1..628: mol_type = unassigned DNA
cgcctcaccgagaacagaaagtgcgctccaggtaccacccggattccgtcaaactacattacccagaaggcagtgctacaagggacggaagccgaccccaagccatagacggaaggcgcagaggggcgttcccgtagcggcgtgggcgggacttccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggtgagtggagggttccgcagcccgcgcgagctcgggtcaccgcccgcatgcacccatccgctgtaatacggcggatgccgg

SEQ ID NO: 10840 - DNA, 215 bp, Homo sapiens
  source 1..215: mol_type = unassigned DNA
cggctgcgtattgatcgcacctgtcatgtcccatctcccctaatcgaagctgaaggccggctccgatgcctgctatttttcataattccaccgcagccgacagctccacaaacaccaccgctcgctcagcctccgcctccccgggccggctgccacctcgcgccctcggcctggccctggccccgccggctgcactgcacggcccgtccctccgt

SEQ ID NO: 10841 - DNA, 2638 bp, Homo sapiens; identical to SEQ ID NO: 5586
  source 1..2638: mol_type = unassigned DNA

SEQ ID NO: 10842 - DNA, 2172 bp, Homo sapiens
  source 1..2172: mol_type = unassigned DNA
cgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgt

SEQ ID NO: 10843 - DNA, 2548 bp, Homo sapiens
  source 1..2548: mol_type = unassigned DNA
cggagctgcagtagaagcgcttccgacctcgtccaggccctcagcctatcccctcctgaaggtcggcagggggcgtcattaccgttggcttctccgcgcggctccggcctccgcttcgggaaccgagtgcctgcagcccgcgatcctggggaggcacagggttagggtaccgcctcggcggagaaagtggctgtgccgcgcgggtggggccgggccagggctgggctgggctggagggcgcggggtacctgagtgaagccgcagctcccgggcggggtgcagaggagactccctgagcgctggagcggggagagccagggcgggggccaggcgccgcagtcccggacgaggcccgagcagctcctgcgcgttccgcagcaggcccagcagcgtgtgcgccagcgagcgcagctctgcggaccggacaggagtcggagcggcggtcagaggctggccaggccccctcccctctgccccccgtccgggtccgggtgaacagaactgaccgcatcgccgccggcgctgcaggcactgctggtgcgccaggcgcgcacaggcgccctgggaccccgggcacaggcgggcatagaaggcgcagagccgggcggcgtctgcctgcagctcctggggggggtcccaggccagaagctccctgcagctgggctcgcggctggaggaggctgctgcgggcgggacaggggtcagctcaccctctgtttggggccctagccccctcactccttccccggaaggagacaggctttcccgaggcagaagggagctgggaatgggcatgggccgggtggaaacgggcttgtcccacggttgtccgttggggcactggggacggggcattggaaagagggcgctcaccgctcatctgctcctggagccagtccttgaacactgccacgcgggtgtagaccccgggcttccctggctccccgcagccgtccccccaggaggtgactccgaacaggacctctctagggcgggggccaggctcagaacaggtcagggggcctcccgagtcaccctgcggggccaagagagaggacgctgcattcacctgccccctatgacgcctgccttacgcctggcaggtgtgagcttgccacttgtgtccattttagggatgaggacagagaggctcagagaagtcgagtgacagacagacgtggaaggaaaagaggccgtagtggccctgggaaggctcagccggccttttctcatcagactgggttcatacctggcacgagtcaacgccccccgccaggtacccggcgcagagcatggtgctggggcgcagcccgggccccagggctcttcggcaggtgtcggtgctgagcaggggaacacgggcctctctcactgcttcagcctcaggcccgtctgcagggaaggggtggaaggctcaggtttggagggcaagagccccgccttgagggtccccttcccaccaccccccttgattcctccccctttgaaagagcaggcagcatttttccaaggcaacccggcctccctacactctattacctcggacccccagttcttcccaccacgcgccggctcacccacgcccagtaccttcgaagagggcgccccagcccgcgatggcgcaggcggttccggcagggggctcctggggctcctggggcaggcacacggggcgcgccgatccccccgggctcaccggcgtccacagctgcaccagggccaggtcgttgtggaaggtccgcgggtcaaactgaggagggggaggcggcgcagggtcaaggaagcacgggtgggggtgcggtgcccagccttgggggcctggggactgccttctcaccttggggtggggcaggatgcggttcactggcacctcctccgcttgctccccccgggacccctctgccagcgtcacagtccacagaagctcattcggggcgctgcgggtcgagcggcagctgagacgcaggaaggacaggggcacaccccgcaggcccctcggagaccctgcccctccgcccgcatgccgggctttctccacctgggggcacggagggcgggccggggaggggtcccgtcccagagggggcgaactcgcccggccgtgccaccccctccgggctggcatcctggcggggcgggcgcggcgccttgagatggggaagcccggggccggccgccgccagggggcagcagagaccacctttcccgcgcgtcgcccgccggacaacccggcaggtgcggggcccagcgccggggaccccagctgggcaaggcctgggggtcctacttaccctacaaagcagtgcgctgccgtgagcacccaggaggccgctaccaggacgccgccgcacagaggctgcccgccgagctgcagcctcaccagccagggccaggccccgggcggcgccgcgctgccccccacgatgcggccgtgggcccgcgtcacattggcagtgctcggacgcctctcgccgcacggccctagaaaggggcaaggggtgtcacgagggacatgttctggccatcctcgccttcgaggcccacccgg

SEQ ID NO: 10844 - DNA, 919 bp, Homo sapiens
  source 1..919: mol_type = unassigned DNA
cggtggggtgtgaacgggcggaagccccgtccagtgcctgtttaaccacctccagcttgtggaggccgagcgaatgcgggtgtggggtccgggccggggtacactcacgcgttgcgctggcaccgggactggatgcagatgagcaggcgcaggtggtcccgggggcgcggcggccccctcctcggcggctccccgagcgctgcgggggagggtgggacgtggtcaagcgggcgggcggcggggtgggcgacagagcgggcgatcctcccacgccccgggcctcacccacgtgcagcgtggcggcgagagcgtagaagccagccacgggcgccctgtactggccgctggtcaagttcaggcccgggccgcggcggaaggcaccctcggcgtcgggctgcgaggggcacggatggtcaccccggctcccgcccggccggactcacccgccctcccgcgcgccggcactcaccaggtagtagacgccaagctcgtgcagcgcgcgccgctccaccaacgcgtcccggcgcaggcggcagaggaaagcggcctccacgcgcggcgcccgcggccccggggccaggggcgcggccagcagtgccagcacgtcccccaccacgtcgtcgtcgtcctccccggcggtggccgagaccggggcgaggctcgcagcgaccggcccggcggggccacacgtacagggttcgggctccgcgcgctcccgctgccgcaccgcacctggcacagagcgagcggtggccgcgcgccagggacccctcacccgcccgccgcgtgggtccagccctgaacgacaggtgctagcgagaccaggggcctgccgggcgcaggggtggggcgagggcgacgtcccctcggcctgaagggcctcggagtctttgcgtcctgaccctgcagcggctcccgt

SEQ ID NO: 10845 - DNA, 2488 bp, Homo sapiens
  source 1..2488: mol_type = unassigned DNA
cgggccgagtccgaggttgctcggaggtccagggctcccaccccgcgatgccagtcctgcctcctcctgcgccccgggcaagggtctgtccgcctgggggaccgcatctggaatccgcgtggctcccctccccggcggtgccgtctccacggacagtgcgtgcccgggtctgggctggagcgacgtccccgagattatcctattactttacaactgtggctcgcgcgccgtcaggacccggcccggtgtgggctggcggagcacaatgaccggcggcggggcgggggcgggcacgcgggcggcgggcgctgggggtcgcgtagatgtttgggtcgaacaggtgagcgcctcccggacactcgggtgcccgcggggggcggggaggagggcggagggggtgtaaactaagtggtgggaaagagacaaaggaagagtgaagagcgagacggtgcggatggggaagggggaggggcgcggaggggcagccggtgggcagcgcgccgaggagctcgagcttgaacttgatcaagcactgggggccctgccgtgggggtggggcgggggtacggccgagagccggccacgtgcctggctttcccagcccggggtctcgctccggccgcccgggggagccgaaccccgaggcccggcagccccgccccacaagtacccgcgtccctggggacccgaaagacgcatgggggtcgaaggctgcccgaaggggccccgggcgccgagagttcctgagggtgcctgagtcactttatttgggccaagtctccctctcctggcctgaccgcagacagcccgccgggtgccctctccccccagcccccaccggacccagagaccgcagcctccgggagcgatgggtaggcacagatcccagcgccttctttccgggctcagccccgtgcaaggatcttcctcgaagcgcttcccccttaagagcgcgctccccaccgaagcgcacggcggcgcgtccagcgcgcccttatccccccctacctggcccagctccccctccttcctcctcttctccccccgcgcctctctccctcctttctcctctcccctctccctgggtgcctccttttcctctctccccttccccccgtgcccactcctccctctcacccgcccctccgccacctcctcctgctgctcctcctactccccctgcctgcgccctccctgcgctcccctcccccccgcccccgccccgtgcccggtcccgccccctctcccgcctccccgtgcccggtgccccctcccccttcctccgggccgcggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggtacggagtccggcccggatcccggcgatcgggccgtttccggggcccgggccgccgccccccttctccggctgctgccgccggccgttgagctgcggttaggggggcgaggggctgggggcggttctggggaggggggcgcagggggagcttcctttgccggggctgagggagggggcgcgggggagcggctgcgccctgggccgagtgggctggggcggggggcgggtgagtgtgcccgagagtggagggggggcgatgaaggctgcactgtgggggccgcggggcgcccaagaggtgtgtctggccctgagcgcccagggtcgcggggcgcaccccactcccggggtgcgcgccgcgggtcctggggggcggtgattgtgcgcgcagcgccgcggtattgtgccacggccgctcggtgtgcagcgggctcggcaccgcgtcccggcgagggaggcgttctctggcggcggggcgggggccgggctcgggttgccgcggccgccacgagaagggaagtggactgtgtttggggatgtgaggacgggaagcgttgagtgtcagggaggggttccccggcgcggcgcggggagttgagacgcggtttgcagagttgagcccacttcagcaggcccgggtccctcccgggaggggacggggtgtccctctcaggtgcaccgtctgaccggaagccgcgggcgttggcggcccctggcgaaggggccttccttaatgaggggacacggcggggcgggggcagccggccgcctcgagggcgcgcgcaggggttaagttggatttacacctccgccctctctctcctccctccaccttgtcttcaaggctggacactttggatagggaggaggggggagtgcaatccgcatttttattccagccgctcgggagcagaagtgaccctgctcccacccggagctgcgtttgcccgagtccggccgcccctaccgggctgcgc

SEQ ID NO: 10846 - DNA, 513 bp, Homo sapiens
  source 1..513: mol_type = unassigned DNA
cggccgggcttgtcacggggctctgtgcagccttttccactctcccggctgccagcgtcccgccccgtcccctcccagcccccaagggaggaggggagagctgcagagaggaggaggggtcggggaggccggctttataaaggcggctggaacaaccctgcccgccagaccccgtcgcccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctatgagaccgcaagccaccctccaagaatgcgcgtgcagtcgttgccgtggcaacgt

SEQ ID NO: 10847 - DNA, 1766 bp, Homo sapiens
  source 1..1766: mol_type = unassigned DNA
cgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggaggtaaaagcgctagcgcgcggagggctcgaggagggcaccgcggctgggccccccgcgccccgggccccagccgtccgcggctcccggcccgacgctccccgccccggagcgcgcccgcctcccctgcgtggaggccggcgggcaggcgagcggggggcggtagcgccgtgccaaggggctggctggggcagcgtggccggccgggctggggcgatttaagagcggtccgggcggggtgcggagccggactttggctggggcggcgcgcggggagggggccgggggcggtggcggcggcgttggggggcggggaggaggcaggaggaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcaggtgggtggctgggggacgcggggctcgggcgggggctcgcggcggccggagccttccccggcgtgagcccggccgcgagcgccgcccaggtgagccggggctggtccggaccgcccggctccagccccagcgctgcttgcggaggtgggtccgggcgggcgggagggaggctccggcgccggccgtccgcagagggatgacctgtttgaccccgctggctggcgggcgggcgaggacttcccgccgcgcccctgacccgcggacacggcacaccgagcacaggcggccccgggtaggggagcgcgcctgggccggccatccgc

SEQ ID NO: 10848 - DNA, 6511 bp, Homo sapiens
  source 1..6511: mol_type = unassigned DNA
cgtagggtgaacaggtccggtcaggagccgcagcgccgctcacctgcacctcgtccatctggtgaggcatgtcgtggagccccaggttctcggccaggcccgcggcatccagggcgtgtgcgtggggcagcagcaggtcggagcggcggtaggcatccctgcgggcgctcaccgcgcccgcctccagcccggagaggtggggcagtaggccggccgggcgcccgtggtgcgagggcagccccgctccctcctggctctggcggccgggccaggcctgctgctggctgcctgtgggcgccggctggtgcagggggttgatggcggcggcgtacgcttcccccagatgcgagtaggggtcggccgactgggagtaggccagctgctggtagggagggggaaagtagggtggcggctgatattcggcgactccagtgtgggagaggggtggcgcggggctgtagaggtgctgcccggcggaggagaggtgggggacccgcggattcccattgctgctcccgtcgtggcgatcctggagggaaaaaaaaaaacaggagaccccgttagtgcgaaaccccgctactgcgaactggccggcatcgccgggctacgcagagggccccgggggaccaaccgcaccccgcccggcggggcttgcccagggtcggaaggtacccgggggcaatgcgccccgaggatttcgttgtaagcaaagagtgcggggagggaggagagtctggtgaaagacctgggggaacgagttctcaaagcccggcggcgaaggtctaggcgctgctcccaagcccgaggcgcttggaggcgccaagtccgaaccctgggtcttgggccagaaaagtccgtggccggagcccggggcgaaggagccagagcccggggcgaaggagccggacgcccggtgcagagctatctcgtggagcccgcccatgacgcagggactgctggaggtggcagcgcggcaggcgcggatagagtgcgcggcgcgggaaatgcgcacctcccccgcccccgggaccctcccttccacgccctcgggacaaagacctccgagcgggcggcgctcggaaagcagggcccgccaccctgcgccgccctgggaagtgaagagggagcgcgcgcacagggcggccctccctgctggccgggcccagccgaggggagtaataagtgggggcgccctgcactgccaagggcagtgttctcgcacgtcggggcgcagagggggcatgaagaaccctggaaattgggcagccttgcccgcgcacgttccctcgcccctgggcggcccgactcagtttctaaaggatgcgtccccatctgcccaggggtctcggggcgccgggaacctggaggaacatggcgctgtcgcctcctggcggaagcgcccgggcctgcgggcaggggcagccctccagggcccggaggcgcagtgaactcccgcgagtccgtagcccgagctccgcgctcccggcgcccctgagctcgcctagcgctgcctgcgtcttcttcctcttcccgctcgccgcctccttcttccctcccactctccgaaactctagctcaacctgtccgacaggctggagcactcgcgagctcttacggccccatctggcctcgggcacccccaccaccactccccagcccccacttcttttgaaagccaaacttcggttgttttcgtgcttccccgaggaggtagcggggcaggtgacaagccggccttggaggagtgtccgccaaggtgtcgctagcaggtagcctcatctgacccctttggacagagacttcgtgcgtaaaagccacgtctgagggttgcagacggggcacttttccgagaaaacgggaagcagggctgtttgccgcttaggaaagcgcccggtaagctgtgtgggtgggatttgccattctctttccaggcctcgttcccgaggggaggctatttaggaaaaggccctatacaggaaaggggccccgcagaaatggactaaggggtgtccggagaagtggatcccgtcccaccgagaggccagggctcctatgccctcgtccccgacctcggtccagtggcccctgcctcccggactgtcctcggcggggcggggctgcaccccggagccccagctcacctcgcagtcctcttcgtacttgacattatcggttattttccacaacatggcgtccggcgtcccccaaaacagtcgccagttaaatccaggatccccccagcccccaagcggtaaatccaaaatcggggtcacggtgaccaggcgtctgccgccgcccccgccgcgcgcgggccttgctgtccgggtcactggacacgcatcggcggctctgcgagcgtagatgctgccgccgcgagtgtcaagaccgctccgcggacggggaaagccgcgcccgaacagtgtgtcctggcgatagccgggggacccgagcgccttaatgagaaggaaattatcataactcctccccgggggccggcgcggaggcccaggcgccgggcggggcggcccccagccagtcccagcctagctccgccccgcacccgggcctggcgcagcgccgagccccacgctgtgagggacgaagcgcggagtcagtgggcggtgcctcgttgacagccgaagacctgcgaggcctgggtcccccgacgcgccttccttctgtcacctccaccgtaaacacacctgagattggcagagctgggggaagggatccaaatactgaaacccacccctctttcgcctaaacggccttcactcgttcctccaaaagacggatgtcacctggagttaagaaactgcgcatttggggagcgactcaacaaccggggtctcctcatctcctaaaaacacatcccatcccacctacaccccactgaggcttaaggtctgagctgggatcatgcagctggagccccagtgcgccagagacgcccagttccctccgtgggcacagcgcggtcccggcccccgggcgggaggagagaggaagggactcctggggagtctgccccaagggccgcagaggcagcagacggtcctacccgcccaggagttgcggacagcggcgtctcgccgctgtcgcccgaagtggcatctcccgcggctggctgaggccagggggaacccgcgcgcactggaccagcccagcggcccggccctgccctgccctgcggaacgccggctctgcagctgcctctggcgggccggtcactcagaagcctctactcgccctgggaaagaagcgccgggcaggaataaaacccgagcgccacgggtaaggtgagggtgaggaggtgcaggaagttgggagagagcctgcagagagctctcgactggagaggtagacacccaggtcccacatgtttagacagaaaacgaaacttccttccacacaaacgctgcttccctctccccttcggtacttgccacccaaacttgaaagcaaagtgcaatactaatttttaaaatttaaactaacgaaattctttggcccagttattatgcagcaattgactttcattgtaaggggaacatcgctaattctcgagggcgtatttgttgggacgccccaactggctccctgggctggatttaaacattctgtggggattagaggacaagactatttctatttgatactgaatacgattttgcaataatcaatgcctatcagtacggtgtccgcacctgcagtagacatgactctcccatccacggaatggcggcatccactgcctcgctgttccttctcgggttcgtttgaactttagcatttatttagacccaggtgggcctaaaagaaaataataataataggcgtcctccaagggaaactttcccccggccttagacagcagccaaatcccaggtgattttccgaccggacgcgggaacaaaatctggaagttgaaaccactgagacttttcggccaagcatatctgcagggctttgcactaaggagaacagtgcataaaaagacacacaggaccctgacacttcggtcccaaaacaggcttctgggggtaaaataagttaccgcagaagcagcgctcctggtattagcggcgggggagggggacacctgccagaagcagaaattagacccaggcccgcaggcactccagagcacaggtccaggaagatgggtcctagactcgccagaggtgcggcgcctctttcgggcgcctgggactccctgacgggtgccgctgggctgtccgacattctgggccttctagccctcggttttattctctgacccggcctgaggtgcagcttgaacaagctgtcttgtctgtgctggcaagtttacctcctgcacgctggggcccggaatgggcaagaaggtgctcatcccccatcccaggccctggctctcctttcccacagcaacactagccaaagctgcccggaggaaccgatatgcctccccgcctgggagcgtctacgcaggaggcgaagggagccgatgggcactgagggctcgcgcagcaccgtgccgtgggcccaaaggacccagaggatccggaaccgcttggcaaaggccattcattcccaaggagcttccctggaccccggcgctgccctctttccaatgggtaagcgttcgaactggagcgcaacctccgcgccctctgtacggaaggcagctagaacaaatcctctgtcttctcggcacgggagacccttccccaatacgcacattctcggcttctgggccggcacccaggcacgcgcgcgcccttgtgaggaagcctcaacccttccttgacttcaacttttctgctcagcagagccgggaaccgaaggctccagcatccaagacagcctccctccaacgtccccgccccttgcccacgtgaagacgcggactgcgtggccgcgctcaagacagccggcaccggcagaaggggacccctctggaaccccggaggcctcgcagccgcctggagaagaggatggaaggttgtcgggggttcccctctaccgccccctagggagcctaaactcacttactccctggaagccctggacccacgcccctatgaaaccgcaaaccaggcctctgcaacagcgggagcgccccaacagcgcgccacttccaaagaggcgcgaggtggtgcctttggaaacagggctcccggccccaggcctgagtcatccgccacccctgcccccaccccagacggaagaaggcggccaggcgggtagagcaagattcgggcagatctgcgactcctcttcccgccccagggaggggactcccgagcagaagatggaggcccccgagcgctttcgcagactccgcgccacgcgccggacgtttgtcccgcctctcgggacaacgtgagcgccggtagggacctcagtaagtggcagacccgccaggatcaagcaaggtggaaaggccggggcctgcggcaaacccaggaggagggggcattcacgcccgccaccctcccttcgcggcactggcacccactggaccgacactggcgtcaaagggcaccctgaagtatctatgtccagtaagggcatgccctggggcaccacagacatcaagtcacagccactccaaaataattacaaaaatgattatcgtaaataacagattgctttaatagggcgcgaagcggccgccgcatacagacgcctctggtctcagtcccaccagattcagttcactgctcgcttctttgcgctccgcgtcaggccgcatgctcttcgtttagaaccttttgagccttaactcttcctctcaaacaactccttttttcaaacaggcaaagtgaggcgaggagctgaggggctcacaggttcccaagcttccgaggagggcccgggtccacgtcagtcccggcccgccaaacgagacttcgtgggcacagtctctaacctgacaaccacctgtcccatttcacagcaggcaaaagtgaatttttagtcgcccaactacctgaaagccacaaaggtgcctagggttgaaggccactttcctagcggttctactagggagcccgttagagacatgcctgactctccccctgccctgccccgggggggacccccgcccgccggaggcctcacacgcttggccgtgggatggtagactcctgtcacctctccactaacatcccggagcccatccgtacgcaccctaaccgctcggagcgcaggcccgaggactaaggcggtagcctcgtgtcccctgaggccttctccgctccgtgttctgggtcgccatacacttcccggctaagcccggcgcctttaactcagaacttggtcgcctccaggcgtggagcaggccactgttgccagacgctgcgcggacccgtcttcctgcgccagtactgggcgacaggcagcccgggcagcacccaggagccaccctgcacggccccaggcgcccgtcccacccagcgccacccctcgcccttcgcagcgagtcctcccgcagcctctcctctctgctagcccccggggtcgc

SEQ ID NO: 10849 - DNA, 6511 bp, Homo sapiens; identical to SEQ ID NO: 10848
  source 1..6511: mol_type = unassigned DNA

SEQ ID NO: 10850 - DNA, 338 bp, Homo sapiens
  source 1..338: mol_type = unassigned DNA
cggaaacctccaatccgcgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggtaagggagcgtgcagcgggggcgggaccacgaggcggcggggctgggggcggcctctgtgtctgcgccggggatcgcggtgaccccgctgcggaccggctcgcggtgaccccagcgcgaacgagctggctgccggctggggcgagaaaggcctgcggaccggcctgggcgcatgcgcggaaggcgg

SEQ ID NO: 10851 - DNA, 936 bp, Homo sapiens
  source 1..936: mol_type = unassigned DNA
cgcaggcgcggggtgtcttgagtccctcaatccccagagggaaggagcccaccgtgggggaccggccaaagccccactctttgtccggcccagggcaaatcggcccctcggcagctcagcccgtccagcccctcccgagaggacacaggggacccggagtccgcaggggccagcactaccctccgccccgggtcccgctccctactccccgtcgctccgagacgctccgactctcagtccggaggtgagggtctcccttcatgcacgggcgcctgatgggggtaggggtggggacgcacgagagtcccaggcttcggcccggaccgctcggggttccaacgcccccttcccgggcccaggaacagcgcccccgcaggaagcatctgcctcggagggggccctcgggatgcaccccgccgtgtccgcgtccgatgcccgctcctccagggccccgcgacccctggggatcccccgctccccggcctagggggcacccactccgcacgtggagcccgggcagcgtccccagacgcacccagcgggataccggagaggacgccgacgcagtgcaacgccccggccgaagcgccgaacaacatgcgcgcgtcgcggaggaggtgcggggcgtgctcgctcaggcagcgggtcgccccgacgtggtagaagcccaggaagccgcagcccgcgaaggacaagctccagccgcgctctgcgtcgtacatggcggcggcggcggggcgggggcgcgggttaggatctgggtcgggatcgggaatcggctcgggtcctgatccgcagcagctccgcccggcgcccgcaagcgctctctaccctgcctcagtgtctcggccagggcattcccagcgcgacgtcagccccgcccccctcggaccatgcaaatgagccggcgggaggcccaatgagcgggcaggacgc

SEQ ID NO: 10852 - DNA, 2184 bp, Homo sapiens
  source 1..2184: mol_type = unassigned DNA
cgccacgacggggacctcaccacgttgtccctcatccacgtcacccgcccaacccacgcggagggtcctgagggcttcaccacgcagccctgaaggggcagagctggggtcacacaggtatcggaagcccacgctgtggccccaggagaaggttctggatgtggctcctatgagtgaagggtggactcacagcgctgccggaataaagggaaaccacaggcaggagggaagcgcgtccaggatccgcggccaccggcctctcagactgtcttctggggccaggtcgcgaggagatggaaagcgggggcatcacaggctcgtctgaacccgcgcgttcattcggccacaccgaccccaaacccctgcatgcgggcaggacccctggttctcctgcgcccaccccagccctgctggccgccggggcatttgagggatggttgcggggggtcggagggtggaaggggcgtcgggcagcctcggtggggaggggaagaggcttcccgtgcactatggactcccgcattcgggaagggaggcgctcggggttggggagggaggaaaaggcggctgtgttcggggagggggcagcgagaccccgcccgggctacgggttgcaggatggagcggacgggaggaaggagccctgacgccgcggaccccacgcctgccggccgtcccctccctccctgccttccttccttcctccctctccgcagaggcagcgcggggacccggccggggtggggctagggcggtgcgccccggagcctccaacctggaccccaccccggaggcgccgcgaccgcgctcccgccgcctccaggaaggtgcccggatcgcgccggcgaccggaggactctgcgccccgccgcctcccaccctgtcccgccccgcgcctgtcggcgaccccgcggggccggtccccgtctccacctgcagtccggggcgcggcgcccttgagggaagcggggctctgggatcccccggcctgggcgtgggacaccccacggtccgcacgaaccttggtggcccgggcccctgctcccccagaacagcgcccaggtctcggagaaaccccccgaagccgtgggcccagacgctcccgggggacctcggtgggacgggcagggcgggcgccgcgggcgaggggacgcgcactgtccccgggcgaaccagaaacaccccacaccgggcacctccccaggaatcgcccacccacccccattgttctccaccaggtttcaccttaccaccctccccccaggcatctcccccgttgcatcgcccccacgcgggcatcgctcccacccgggcatctcggctctgtcctgccctggggtggccgcagcccgcggggaggaagcgcggcgaggcgcccacaccgggaaagtgtctccgtgactctgcgaggttacactccgggtgcgtcgctgcgggctcgtgggctcgtgggctgcagccccccgctcctgtcgggtggacgagccccgggcccgcgtggagctgctcggtcaaggccggcccgggaggggcgcggcgcagggcgggcaggggcggggtcctaggtcaacgtccagccccagacccagccccgccgccggatccaccgtgcctctgtttccccattcctgagaaatcggaacgccggcggcacccccttctccgggccggagcctgcgccctccggattgcgcgcctctgtccaggcggcggccgggggtgggagcgcgcagcgggccaacttccctaaagggaactgtcgggagggcgcccagaagggaaagaccaggaagcgctgggtgctgagctggagtctggccccttcctgggggaccggggagggggctgaaggtggggagaagaccgccggggctgctaggggggcactgagggagcgtccagggggagaactctgggtgggcgacgccgcaggggagctgcctggcaggggcgagggcctcggggaagtggagcttctggccgagagctgcatctgtggccggggagggaaagggtcacaagggcagtgcgcgccgggagggaagctcaggccggggggaagggactgcgcggcggggacaggtgcgtcgggtgctggacagtgagcaggagcccgccggtgctcaggtcacgaaggtgctggagccgggggagctggaacgcaagggggttaagggaacgcgc

SEQ ID NO: 10853 - DNA, 413 bp, Homo sapiens
  source 1..413: mol_type = unassigned DNA
cggcctgacggcggggccgagcaggggaagtggaaggatggagggagaaagggagagagttccagccgccccggctgtggcaggaggagccccaagagcgctccccgagcccgccccgcacctccaggctcagcccggcgcaggctccctctcccgccccctccacccccgccagctgctgaaacccccccaccgtccctccgcgggcaacagtgcccgccaggcgccgccgcgcggtgcctcgccccccacgtcgcccgcccggaaagagcccgcagtggcccggggcgccgcgccctgaccgacgtctctggggtctgggagggcggcgctgagagctgggagaggcgctgagcctcccggtctccacgggacgccgggaaaggagagcgagcgcaactcccacgccccgg

SEQ ID NO: 10854 - DNA, 403 bp, Homo sapiens
  source 1..403: mol_type = unassigned DNA
cggctcgcgccgccgtgtcctctacccggctacacagcgactccaaaagtttagctttcaccccgcggagatttcgacagctctgggaggctctttttaaaagggaatttggagaaatctgttgctgagcacgattgagtcccactctataaaatacccatcaccccgccgtcattcctcaagtttacgctttcaaatatgcgaaccccaaggtccagcccgggagtaagccaatcccaggacccggtccaccggcgcgtgtcttgaaaagaatgtcggaggtcagattctctcctaccgcttagaggcctcggctcagcgcacacatttggggttcgcagggcttccgcgcgccggaacccgacctgcgctggattttcttccgggcgcaggagctaagcga

SEQ ID NO: 10855 - DNA, 675 bp, Homo sapiens
  source 1..675: mol_type = unassigned DNA
cgtctcatcgcactccagtggagtgtcgcgaagttgcaactcggccccaaggcggcccgcacttccacccgcacacaaaggcaggtcgcagccccgcacgcggggacagggccagcaaggggcggggaccctcggggccgccgcctccgcagccccgcgtgtgggaccctggggcgggccgccatcttgtggtgcggccgccgcctgccaggagacacctagcaactccgcagcggccatcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccatatgggggtcatggcctggcgtgggggcgtggccgggtggggccgctggatttggtgctggaaagctagggaagtagtcgtgcgtttaagaacgg

SEQ ID NO: 10856 - DNA, 580 bp, Homo sapiens
  source 1..580: mol_type = unassigned DNA
cgaagagttcggccaacaaagcaaacgtcccgtctccggtctcctcttcctttgtaggggaaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcggtaagcgctgcccgctgcgccctgggcgccccgccgagcagctccgggccgctccctagagccctcccgagacgctgcctgcctgcctccatcccggcgagccgcggtccggtgcccccggacgccagaaagggcgtcctcggccaccgc

SEQ ID NO: 10857 - DNA, 858 bp, Homo sapiens
  source 1..858: mol_type = unassigned DNA
cgggaacaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggcctccgcagcgccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacaggtgagcaccccgcggtccgccgctgtcccgcgaggctcggccggcgggggggcagttcattcatccaccagcccttccgcggggctggccaggtgagtagtgggggcctgtccctcctctccaggaccgccggggtcttccccagaattgcggtcgggcggcgctggtccctggggaagtgtaggggcacccgccctcgttgactccttggagttctcggtgaactcagcgtgcccga

SEQ ID NO: 10858 - DNA, 5715 bp, Homo sapiens
  source 1..5715: mol_type = unassigned DNA
cgcccgcaccgcgcacacaggtagtggacgcccgcccacctgcccgtctgctgggcgcagggcgctcctggggtggggagggcgctcctgtggggggaaaaggggcgctcctgcctcggagggggaaaggacgcccctgtggaaggaagggggggctcttgaagcggtgtggtgagaggacgcttccgaggaaggaagggggtgctcctgcagcggtggggggagaggacgcccctgcggaaggaaggcggcgctcctgcgggggctggagagacgcccgcgcggtctcccggctcagggaccgctggctcgcgggtccgccctctccccggcgctatggaaaccgcactttctccgcctgccgtccccgatctctttctcctattacctcccaaacgcgatttcaacttcccgacaagctgacaagtgaatggcgcagaggacgccccgtaaagcgcccgcgagcgggtgggacacaggcgccccctccgcgcccctctgtcctccacggaagggcgcgcgccgctctcgatctggagcgcggtgctcgcgaacccgcggccgcgggccctggaacctccccgcgtttcgcggctgcggggggacggagatgcggccgggagacggggacgggaaacgggggacggggatggggcgcgcccaccccgagcgcgggagcggccgccctcgcccaaaatggggaccccgcgccccgagagcacggcccggctcgccgcccatgcttccactgcaaggccgcagcccccgccgccgatcccgatcccccgccccgcccagccgcggccccgcccggcgccccctccccggcggaagctcaagcccaattaattgagtccgaggcgggagggaagggccctgcgcgccgtggcccgccccgcccctcttccgcgccccttttcccgccctgggtggcatctcctccgccggcatccacaacaagccgctgattaatgaggccggggccgccccaccccgcccggccgggccggggccttcgcgggagggggaggggacggcgggaaacgcggcccggggagaaaggggggcggggcgggggcgcgcggcccgcccccgcgagcgccgcgccgattggccgagcgcgccgtccgtcggggggcgcggcgccaatgcgaggcagcggggcggggcggccgcgctgtgtgtgcctgcgtaacgccgagtcacatgttgttttgctcttcttagttcagtcactcggtgcgcgatgtgttactcactgtgcggcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccgg

SEQ ID NO: 10859 - DNA, 858 bp, Homo sapiens; identical to SEQ ID NO: 10857
  source 1..858: mol_type = unassigned DNA

SEQ ID NO: 10860 - DNA, 247 bp, Homo sapiens
  source 1..247: mol_type = unassigned DNA
cgggcactgcctgtcgtcagcataacgaagaaacctacacccacgaagacttcagaccccacgtgattacatcactcaaccaccagcgctggcctggaggaacccgctgtcacgtgaccgctcgtgcccaatgaccgaggcccacgctttccagaccgccacagtcgctgtcacagggcctgagtttgggcggcgccccgccccggccgcacggtgcgccggcgttaatcctccccgaaggttccgg

SEQ ID NO: 10861 - DNA, 224 bp, Homo sapiens
  source 1..224: mol_type = unassigned DNA
cgccgccaagaaggaggaggagcggcaggaggcgctgcgccaggcggaggaggagcgcaaggccaagtacgccaagatggaggcggagcgcgaggccgtgcgccagggcatccgagacaaggtgcgcgccgggccggccccgcctgcgggaaggcggccctgagtccagcggggacccagatcccgcctgggtggaaggggctgcccggaagaggggcgggcgt

SEQ ID NO: 10862 - DNA, 1174 bp, Homo sapiens
  source 1..1174: mol_type = unassigned DNA
cgatgtggcggggcctgggaaatgcgcccgctggagcacaccgcagcctcgcgggctcccgagcggcgcgcgcgggccgaggacctccagggcccctcgcgggtctcccgagcgccgccgcaccgcccctgcccgcgcccgggaccgcctcgtgggcttctttgttagggccgcctgcgccgagaggcagtctaggtcctgccggggacgcacgggccccactcctgacttcctagccggagtcccctgaggacttgtaagcatataggctggagtcgagaggctaaattaggccccaggggactttttcaataaaaccctaaatttcatttaggttgttcgtaggccaagcgattgcaaggactctgagccgaagcagcggtgccgggccgacccgaggctcgctccttatcgccccctccccgggccggctttgtgcagctggggtcctggaacccggtccctcccgggctgtcggccctggggtctggtgtccgccaccctccccccccggaggtcgccactgcccccctaccccactcccagcccttccgtttccctccacgtccccttcccgcgccctcccccacttgaattcttcctcccctccggctggaagaaaagtcggtaatgagaaaccagttcagtgtcagtcggaggaggggggcagataaccccagagatacacggcaatggagagagaactcattttgtgcaaagagggcctcgagtcaccagggaattcctggattgtctcaggctgtcgtgtgtgatgtccatcacgccgtgcgaacaccatctgctcggtattgtgctctcagttgccaggctacctgctgtacgcagtaacacttgactgcctggctccacgttcgcagcgctcgcccagacgcgcggggcgggggccgcggaggggcgggcgggagccctgattaagccatctgcgaggggagggggcgcgggcgcagcggcggccgggcacgaggccgggctgacaccaccatctgctggggcgcgggaagaacggcagctgctctgcgttgccccggcgagggacgcctggaaaaggctgaagccctgggcgtcctcaagcccgttatccacggggtccccgtcaccccagcctgctcgccgccggccgtcttttgtgattccctgctctttggttcgccgc

SEQ ID NO: 10863 - DNA, 8657 bp, Homo sapiens
  source 1..8657: mol_type = unassigned DNA
cgagacgcgccgacctctccgggaagcgcgagcgcgcgcgtgtctgcgtctctgtgcggatctgggcctgccgtgcgcgtgtgtgcaaaggtgaaacggcggcggagtttcaaacatttcatcttcgaaccatctcctgttgaggaactaaggctgccaggtcgttgctgattttgaagagggtctctttcaactgcgatccctttaaggaactcggctctgtccatttccaaggaatgtcccttttcctcactctccagacgctgcaggctccccgcgctgcgctccctcccaggctggagccgcagctggcgggacgcgccgtttccacggtatgccgggtgagagccgcccacgagcggcccagcgtggcggacctcggtcttgagccgcgcggacgcctggccacgaggggctcccgacccgggcggggagaggtgcgacctggggggagggggcggggcgcgtaggaaggaggaggagagagaaaagggcgaagccagcgcgagattaggaaggagaggagggtagagacggagtcggcgagatgctggagaattcaggattgtgggcaccctgagcgggagagaaacttcaggaagcacgtcggaggcggggcatctgtgggaggaaggcaaattttgcagagcgctaaaggatgccgggagggacaagttagccatggggagacctcccagaaatccggagctgaaaacagggcagttaagtaagcaagagctggttagctgaatacgaggtccctagaatgtaaattataaataagaaagaaagaaacgaaagaaaaagaaaagagcgcgcgcagggtcccgggtccaggcgctcagagcagcccgtgcgggggccctcccggcccacagtagccgccgccccgcgtccctgaagtggcgcccgcgtggctactcggggatctcccaggcctcgggggcccatttgaaaacctcgagaggccttgcacatcctgccaggactggagctgcggggacctttcagtcttccacggatgctcctctgcacgtgttttccaggaaaacatttaggcctcggaagcgtctttgagagcctagaaatgccggttgagcgtgaaatccagtccaacctactcacagagtactagacctagaaacgacgtttgaaagagatgtgggttccatgttgacttaaattttgttccatttataacaacgcttttgttttcaaagaaaagaaaaatttcttagccaaacttctcatgtccccggccccctgttcctgcctcgctctctccctcgacaaacgcggggagccctggaacgggagggccggtgaccgcgaatacggtagcgatgtgatttgatgcactgaaactacttacatttccaatgttacttcattaaaggaaacccacataaaagcgtctgtttcatcttaattgccaaaaaagtttgccacacccccgaacggtaactgtttccccgccagacaccgaaagctcataaggaaccacaatgagaaaggatcaggagtcgcttaggttttattgaaatgcctcgatgccgttttttcttcttccccgaattaagccgccgggggaggaggtgggtcgcgcccaccgttgccgggactcgggccggcagacacgggccacagcgccccctcgccgcccgcgcgcacgactcctggcctgcgtcgcctccttccgtccccgcgacacggaggacggcgccgcgcccggcgagcgccccggccttctcagtcggccgcgtccccggggagaccccgagcccgagcctccggggccggctgttcctcgcgctcggcctcgcaggaaatccccgctcgctgaaacttgcgtgtccacgtagactcgttctaaattctttggctgttgcagggacaataaagaaaaatagaaacagtgttaattttttccccacctcctagggcacacctaggaaagggggcagggcccaccaggaacctgaaactgcccccatcgcctgggttattgtgaccaggggtcgcgtttgcaaagcagttactgggttttccctgcgtgcctgctcattccctccctcctgctcggacggcaactgaaaagcctcagaagccaagtgccgggctctccccagcgaccccacaggcctgagcaccccgcctcgcccttgagcaaaacatcccaggccctcctcttcgggagccgcggccttgcagccctcgtggccccgagacggagtctgggctgagcccgccaccctctcaggcagcctcgccgggaccgccgcgccaagactccacgctggcagcatgttttctcatgattgattttttttttttttaagaagaagaccaagccaactttaacttaagaagaaggaatgtgatttttttctttaatatcagagagctttaaagcaaaacgtagtttatatatttcaataacaatgacgagtgttaagtttttaatgtccctgcgtaggcattttaatttgctacagtcactaccaataaaaacggcatgtagtaagagtcgactgtttaatagtgcaaggtagacggtttttattagtaacaggcagcagcggtatggaacatatagatttcagtggaggagtataattgctaaggggaaaatacacacaggacgggaagaggccatcttcaaactcccaacactgagctaaagagggggaagggcaggcggcgtttctggagatgcaccctgggtgaggggaccctccccgccactgcacgtgtctggttatatatttaattgatgtcagaatcgactgtatccagagcagacactccagctccaaactgaggatgtttgtataataactggctgttttctcttctgcccctggcagaggtccggcggggggaggggggtgggtcaagggagggggagggaggatgagccccaaatgctaatgaaaccacagcgggaaccgctctttagaaatggaaatactccaggccagtgctccctggtgataaaaattacacccgatttttttttcatttaaactgatctgatcgtaaaggaaccctaaaggttgccatctgatctgacagtgtttgtgtttgccatccagcgtgtgggcctctcatttacccctcttcttggaggaattccctcccaggaagcgcaaaaatgtcgcagactgtcgacggcttgcccaacccggctgctttctctctctctctgtttttcagctctatagtaattgattaaaaatatctgtcctggactgaattaggatgtcccatgtggagtcgcaacaaggttgaaaccccccgctgggtcgttgcagggggcccagcctgtgggaacggggtgtctgtgggtggagggagaggtggtcgtgggtgtgtgtgcgtgtgcgtgtgttgagatggcctgaagaggatgtgtgcaggatgggggtgtggtttgtaggaagagtggtgggggagcagtgtgggcgaaggggtgggtgggataactggtagggggcgagtggctcggctcgggagctcctggcgggaggggtaacgtgcctggaccgcgcctaccgggagcctgccggctcaggaggagccatcctcaagcacagcactgcagtttgcaactggttcccttgcacctggggaaagacagcctgatgccgtgagtgtttctcttgcgccctggaccagactggcaacccgggctccgctccctccgcgccgctgcagccgcaccacagggaggccgcaacatgccctgcgtcctgagatcactaaggctgctccgcaggctgcagggccagcaggggtgcaggagtcggctgcaggcctgagctgaggcccgccccaggccactgcgctctctcttctccaccgcacccacccgagacggcttccgaggatagaggcacctgctgggtgggtgctcccaataggccagcacagacctgacactcttccatccccctgagcgccccccataggtgacccttcggagtgggcagccagacgccctcttcggccatccccgagtggaaaagggttggagaagcgtgatggggagagggttctaggaagctggggtcctaggaaccctcgccaaccgcctcgcttctgagccccgcaaggcaaccgcccccctactccagccgcgcgtcacctgagctacctgtaatgcccactgcaccggcggcgccaacctgagctcctgcccgttctcgacgtgactgggaggcttcaggtcctgccagaggcggtttgtcaggtaacaatcatccccccagtgttttgacaacacaaatctgaaagaggagtcaacttagaaaaacaaaataaaataaaactctttaggggacggcgtcttcttagctgaagccctggcgtcattcccaacagtggaaagtcgtaacgttcagggccccgggggttgcgctgcggatttgggggcagaaagctcacctcagggccctcctggcaattcgcaaccaaggcgccccggatccaggtccatgctgggcggagtggaccgcgaggggtaggcgaccagacgcgaggccacgcggggagcctcgggccaggaggcagagcaggtccgggaccgtggaagtgagagccgcgcgcactgcccggaggaagacccgagccgcgggcgccaccatcctgacctccccacttccctgcgacttccggattggacacaggggccgggcctcctcggggtgcacagcggggcaggctgtgagtcccctaattggacccggcctggcctgaccgcgggcggcctctgcctagtccgtgagggtggagaagggggtgggggcggggtagtggctggaaggggcgggggccgggcaggggcgaagacggtggccggggacggtgggagccggccggagccgggcaggggacgtggctccgagtggatgggagtgggaggggtgcgcgccggggcacgcagcgcggccgggctgggctgcaggtccgcgagccgcgggctggggccggagctgctagagaggcggctgcgccacaaaagcctgccggtccctcccgccgcccgcctccgtcgcctccgccctcccccgcctccctcccgtctctctgcccctcccccggccgcggcccggaggctgcagcgggcggagcaggggaggggcgggcccccgaatatgcagatgagcgcgtgatggacagctgcgcgttccaatgtccctcggaaactcgagcgctccttcctcaactcctcactcccgactccagactcccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatggtaaccgggcgcgggcgggacgcgggactcctgggcgccgggacccagacggggctcaggcggagcggggctcgggttcggcgggcgggggccgccgggaatgtggcgcggctggcgactcaggagtcgccggctcggttggccgccccgcaggctgagccgggccccgggtggggagggcagcgcggcaggcggggacgtccctgagcccggccgggacccgcgcgccccccgcgcgtcccctcggctcgccggctgattttctctgagagcctgggaagtgcgtctccgccggggccggggtctggcgccgtttgtccctggtttccgcaccgcagcctggggaggcgttcggagcgggctgtgtgctcgcctgcattggcgtggggcgcgagggtccgcgtcactgcggcctctgagccgacggccgggcggttcgcattcactcgcggggctcagggcggtgggggtcaccgagttaggcccaggagccgagcattcagctgcggctccggagtccggcccgaggcgcccaggtttcggccttactctgtccagcggaccatgctttcaaatatcgtgcttgcgggcgcgtgacccgctaagggccgcctgagtcctccgtggcccgagcgcagctcctgctccggcgacctgggggcggctcgcgagtctcgaggttactgagctgggccaggcccgggccgcggcgaagcacgttacgggcgattgaggccattacggggttgtcgcgactgccggccctcggcggaatttctgggcagcgaccgagtcgctggggccttggcgaaggctgcaaatgcctcgaatttaaacgttaaaggatgaattaaaatgctaattacggcgtatttgaagaattcgaaacggtgactggcttctgagttgcaaattggatttgcccagctttagagcagtgaatagtgaattgggggctctggggtgtttttttaaccatataagggaggggaagagggagtagggggaggcagccgcactccaagcatctgcagaaatttagatatcaaagagctacctgtgggcctgtgtgcgcgcacgtgcaagggtttgtgtacattgccacgagcggctccggaacacttaggggaagatgggtcattttaggaaagtgaaatagttcagaaattcgagaataaaactccggtactttttgtgatcaacagctggtcccgaatcacactgcgtttttcctgctcttttgcggcgggaagcgcagccccagagccagactcacggggggaacggtggccgtgggcgggcggaggggtggcatcctctggctggttgcccgcggggtctccgcatactccactcacaggctcttgttggttccagggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaaggtgagcgggcagcggccggcgcaaggtctcggggcgctttcttcccaggcggggcgcagagctaaggcggggaggacgttgcccgccggacaccccaggtccgggccggagccccagccgcaccacattgccctggggtcgccgggatttgagcgagcgattcctcgggcccttcccggggaggtcaggctccgcctgtcacgtggccgggtgggggcgaggtgaggggtcccgtggggagggcccagtgccgcaggacagggggcggagggggctccaggtgcctgcgctgtcccctcgtgccacccaccgtgcccgcgcccccacagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaaggtaggcggcccgcggccggcggcgcccgggaggggagggagagccagccccggggaggcggagcgcccgggagacccgagggagggtccgg

SEQ ID NO: 10864 - DNA, 1059 bp, Homo sapiens
  source 1..1059: mol_type = unassigned DNA
cggaccgtccttctccatcccaccccccgggtctccattgccgcggccctgccccaccactttcagctgaggggtagttcggagctccatggtcccttccctagagcggccgccccctcgggcctccccagagccttcgaagagccgcgtgaggaaacggggacctgcccggggcagcagatctccagcggtgaagacgtagagcaccgggttgacgctagaactgaagaaggccaaggccgtagttcccgctcgcgccgcctggccggctccgcccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccga

SEQ ID NO: 10865 - DNA, 1663 bp, Homo sapiens
  source 1..1663: mol_type = unassigned DNA
cgcaacggggcgggggcagacgtcttcagctttagaactccgtcgggttcatcgctcagtgtggacgatcggcgcccccacgagacccatcgagggcacatagtttccactccagctcgcttcatccgacccagacgatcgccagcgcggccagcggccagcgcacagcgagctgcctgggcaactgtggccggatcctagggagcaagctggcttcgggccctacctagctccacccggctcctaccggccctcccacctaggagctggaggatggtcccggggcgccccagggggactgctggtccccggagtctccagccagacgcgccttgttgtgtgagccgcgtgcgcgcccaatttggaggcagccgcccccgccgctgacaggtgctgcccagagggcgccgggtgcggtccctggcgcagctggacgcgcacgccccggtgcgtgcagcttcccgagctcggtcagagagaagagggagccagggcgcggcctgggggacgccagtggactggagccgcggagcttcgagggaaaaactttgcaggcgccgcggccgggattcggttacggctccagcccaccccagcaggtgcgggaggaagaggcagcgccggagtcccgaggccagagagcctcggcggcggcggccgcttctttcccccgagctggcctgaagtcgctgggcactcccggtttctgctgctgcgcccgccgccgccgccgccgccaccgccagcgccgcggggacccgggaggaggtgcagccgaagagggaggagaagcaggaggaggaggaggaggaggaggggagaggaggagcagggggtggaggatggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccaggtgagtgccggtggcgcggccggagacaaggtgcgcgggaccacgcctccctcttcaggcgttcaccacccggggagcggggggcgggggccgggaggcgg

SEQ ID NO: 10866 - DNA, 2065 bp, Homo sapiens
  source 1..2065: mol_type = unassigned DNA
cggagtaggtcgacgagagatttctgagaaggctggcagaccaccgcggatctttgtctttttacgtggagccatgggcgaggcgctcaagaacttgctgaaggagctcgacttcttcaagcctcgggccaggtcctggagcatgaggtcgtcagccaggacgcccagaaatgcactggtggtggaactgaggatggtggcggccacctgtacggggcgcctggcagcaagactgccacttccaccaccggtcgcatctggctccgtggtgcctcgcaggcctggatcgccaagaaggcggcgcagcgcgtacgaggagccgggccgcaggtactggtaggcgcgacgcccgctgtgatcacgcacgtgcacctgggcacccagacgcaccaccagcagcacggcagcgtcctcgtggccgtgcagtgcagccaggtgcagcggcgtgtagccgccgtgggagcgtgcgttcacgtcgactggtgcgccactgcgccgcgcgacctccaccagctgcagcgccatctcgccgtcgccgctcttggcggcccaatgcagggccgtgaagccagacatgaagtcgcgcttggccgccaagccgcggtcgcgcagcagcagcccgtgcagctggtgggtccagcggcccccggcagtccgcacgagccactcgtgctcggacggctccaggggcaccgcggacggcggcggcgcggcgggcaactcctcggcgtcagggctcagcagacgcgggccggcgcgcgacaggcgcctcaggtgcggggagcggcccgggcccaggccgaggcccagaccggactcttccaccgagagccgcctcagcagcagaggggagctccgcgggctcggctcctccgacagctgccggcgcaggccgggctcctccgcccggaggcggagcgtggcgggggccgggacgcagcgcaccggcagcatacagggcttctgctgcggcggccctttcgctgccccgggcccgggctccgcgtctggcggatcagagcagggcgatgccgcctcagaaggggccctaggcggtggggccgcgtctgcggagggtctctcggtggcctgggctagctcaagggctggaagcggtgggtcggcggaccgctccccgggcggctgagcgggctcggaggccggcccccccggggtgtcctgtggctctgttggcagacccaggtcccctggcggctccactggccgcggcacccggaccaagggcggagctcccggggcagaggcgctccgcggcaagaccgtcgaagtgggtttcgacggctgggccgctgcccccggggggccgaagggtgcgggctcgggctccgggggccggggcttcttcctcagcaccacgaacttgacgccgtcgagctccttcaccaccgccacgttgttgacgaactgcttgaagcggtccctgcgggcggcgcggccccgcgggtcgccggcatcgagcagcggcttgaagcggctcagcagctcggagttgcgcaccttcccgccgtgctcctgcaggaagcccagcaccgccgcctggctcaccccggcagccgcagcggcggcggcggcggccagcgccatggtggggccctgggttcctggctcccggggcgggtgggcgccgcgtcgccgcgggacgcgcgggagcggggttccgggaggcgcggccgcgctcacctggtgccttccccgcggccagccgggcgtgtccccgaagctggacctcggtcgcgccagtgccgctgggccggggcgtctcggggcgaagggcgccgggggccgcggggagcgcccacccccagcgccccgccgggccccggccttcggggtaggtttctgcctttgtattctgtccaatgggcgcctgcttccatcccccgcgccgcgctcgccttacaggtgacagctgcccccgcgatgcagagggaaccggagcagaaattcccgccgccccccgcccgccccagaattaaaggcgcagcgctccagctctggtctcggttgctaggtgggtgtgttccctagggacgccgcggtccgc

SEQ ID NO: 10867 - DNA, 3487 bp, Homo sapiens
  source 1..3487: mol_type = unassigned DNA
cgcgcgcctccagcccgcccctggaggcagtccgcgggaccgcaggctggaggcgcgccggcgtgattccgaccgccggagccgggaggaggagccggaggaggctgcggggggctccggcccaggcgaaggaagggcaagaggctgttcgaccgggggcggcgccgggaggtgggtgggcttaacacccaggtcgggggaggggtttaagagacaccgggaagggcagccgagccccaggggcgggtggggtggtagctgtgtgtagtaggggacagggctgggcctctggaagctagagtgaagccttcctggctgtctcgcaggcaaccccatcctctggcagaacagctgcgaatcgccaagttgacccctctcgtcccttggccgagaggagaggatgtctcaggacccagggatgggcgggaagaaaccatggggagccacaagtctgcacccaggcggggaggaggcgggcgggcgccgctccgcaggcgcaggcgagtgggtgggaagaagggagggagagggaggaaggaggtgaggccgggaagatgccactgccgggggcggggcggggccggggatccggcaaagggactgcagcagcgctaggtgggggcgggggctgcaatgtcactcatttgagagtcaggtgtgtgcgtcccaaacggggtccgccacaagccggcatcttcctggtaccacccatggtgcagggccctaggcagagggctggggactgcggatccgtccctgaagcgggacgcgaaccggcagagttgggagaaggtaaacaagggccacgccccctgccgtcgccccgcgggcgcgcacccgccgctccggccgccgccggtacatttccactctcccagcgcctctccccagctggactaccgcgcggccccggaggtggaggctgcccccgaccccagtcctcacccctggcgccgaggctccgcaccctccacactcacctggaaagggtgtcccccgcccctccaaaaaaactgtctaatttgtgcagagcctccaaccccaggagccgagcatgctgcccccgcgtgcagcgcccgcgtgcaccgggccgggagagggggcgacagggcggaggcggtggcccccggaaggtgtctgggaccggaccggctgcacgtgagcccagcgcgaggtcatgtgcaccggctcagcccggttcggcgcccggacgtgctgcgtatcaacaaaatgaaactcggggagacaggagggcagatagctccaggttctcggagcccccgcccgggccgctcgacctccccaccgtacccatctcccgccgcagcccctacgcccggccggagcccgcggggaagttgcagccctggcgcgcccccgcccgcccgcgccccctcgccggcccgggggcgctttgccgcagtcattaataaagaaggtcgccaagctcacccttccaaaagttgttgttgcatgcgcccctctcagcctccccgcactgtactctttaaaacacgactgaccaacatgcgcaatctctctcccctgtgctgtgcatcccccccctctccgcgctggcttcctagaacaggcagccagcaggagagagagggagcgagcgagcaagagagagcgagggagcgaagagcgctggcagatctgttgcaaaaacgccaaataacgtcgtggagatgcgcagggcccatccgccgggggctggatcttaccttgctccgcggtgcccccctgacgggcgctgccctcggctacgcgccgctgcagggaccggcgcgggaaggatgctcccgaagccgggagctcctggggccggcgcgggagggcggggggcgcgcatccatccggggtcgcggcgagggaggcggccgggcccgcggcgtcccaggccccacgccccccgccggggacggtcggcccgcaggacctaagccggtgccgctaggagtgggcgcaaagtaactccatggacgctactcaccccccccaaaaaatagcctccaactgcgatggccgcggtcggcaccattcaccaaccccctgtgtatgtttctgtttctttttaaaccaagacttccttgtgatctctttagaaaaaaaaaatgtgttggggtgggggtggggtgggggcgggcaggaggagcgagggagggggagtagccacttttttcttattcactcggatctccgctcccgacacccccgtcgccgcccccccaaccccccgcccagttgtttggctccggcggggagtccaggtagcgttgcgggccccgtgggggaagggtgccctccctcgcagccccaccaccacgcctgctggcaccctgggcccggactccccatggactctggggcgcccctagcccgccctgtccccagggccgggcccgagcggcggctgcgcccgtgcaagtcccatcaggtctgctcacacttcacacactcacacacataccccgcccctccactctttcactcacactttctgctcacaccccgccccctacgcgccccagacccgggcggcgccccccgcaaccttaaaaaaaaaaaaaagcgagcttatacttaaaaaaatcttttggcgccatattaatgacgtacttaaaatttgccatttctccctgcgtcaaaaagacgtttctttgcaaataacagcctggaggcgacactcgcggagggaacgaggtttgcactgagcaccccgccccccggggctccagcgctggaagaccctcgccctaggccctgcttctgaatcgctggttttaaaatgcgaatcgaataaattgcgtggcgttttgcagcaccagaagtgagcagaaagtgctggcaggaggggagtggaggggcgaacgcgagtcttggggagggggcgcggccctcctccccgcacccactccaaatggaaaactaacattccgggcgggggaacttgaaattgtaggcgacctcaagaaaagaggggcggtccgtagagagggtccccattgggctcgtcgccccctcccccctcccgggtgcctcctggcgcctagcgctgccccgcatttccggggggtggagaaggcagtgatgagcgggtgggtgggtggttgcacatcctggccccagcaggattttgccccggggcgaccccttcctccttgctcttccttcccattaccccgaaaggttaaaaaccgaggggtaacttccaaaggctggcacatggcgaggaagcggggcgcccctctccccacccttcgcctcctcgcccctcctcctccggctccacttcccgacttgaccttgtggtgcacaaacagtacgctcggatcctcgcagtttctggaagaagagcctgcgctcgccaggcgggcgggctgtcgggctgctagccggcggtggcggggccttgggtctgttcccggagccgcgggccacacccacccaacccgctgcgcccgccgagctcaccttctctcga

SEQ ID NO: 10868 - DNA, 847 bp, Homo sapiens
  source 1..847: mol_type = unassigned DNA
cggtcgctccagcaaagttcccaacttagtcgacatgacgcgcggcgcagccaatgggaggcggagttggcgtttcttggtcgggggggggccggaggggtgggccccgcgtctccggtgtctgccgtgctcactgaatggagagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgcctgtgagtacccctgccccaccccacgcgggccacccacctgggtcccaccgagggggccccaggcgccagatccgtcctttcccctcgg

SEQ ID NO: 10869 - DNA, 909 bp, Homo sapiens
  source 1..909: mol_type = unassigned DNA
cgggacgggggcgagaccctgggccctcaggggcactgaggggtcgtccatgccgggggacatggccacttgggggcggccctcgtcaaccgcggagtggggaaaaggggggagggatggaggacgaacgcccggcggtgtctaaaggcacgacgcggagcaggaaccacagccctggtccccagaaagcgcgcgcggcccggggcagaacctgccgaagttccagctcggggcgcaagggatgtgggggtcactggaagacggggcgcgggccgcccgtggggaggagactggacccgaacccggcccaccccacccgagcggcgacgccagcgctgaccccaggcgtgtcccggcccccggcgcggctccggcccaaccgtgcacgcccgcggaaggcctcgcacccgcgtcagaagtggcctgcccggggccaccggcccgcaagtccccggtgttctcgaggtccctgccccgtcccgcgcggctgtagccggcgggaggggctgagaggcgggtcgcgctgggacctaaggcgccgccccctcgccagcctctccctccctccgtcaccgggtggccggagacccgggggcactgctggggtaccccaaagcatagggccagcctgagtgcgcaaggtcctgaaaagacgggggggcggcgacaaggagtagggaggggggctggaggaagacggcaaagtgaccccggaagggtccaggcgccccaagcccatcgaagacgggaggctctcagtggcgcctggggggactgtgggaaaagcagctcaagaaggggaatctggagcgaggtgggggagaggtcggcatggccttctctaggagcgccagcgccagacagagcggtgacaggccgcaccgggagtaccccgtctatactgaacgg

SEQ ID NO: 10870 - DNA, 2150 bp, Homo sapiens
  source 1..2150: mol_type = unassigned DNA
cgtctttcgtggccgggaaggccaggccgagcggggcggtcagccgggccgggaggagggggctctccgggccgcgcggccgcacaaagcggggagatctgctgctgcggcggcatgaggcgcgccccctcccgcgagccagcggagcgcgcgcgcccgcccccgtcccccgccccccgccccagcccccggagcgccattcgcggagcggcttacgctagtcgccgggcgtaccgcgccccagcggccggggaggtgcgctgcccggctcccgtaaagttattgtgaatggggagcgggtgacgtcagcgccgaatgtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgaggtgagtcccgggccccgggccccgggccccgccgctgggcggggtggcggggcaagtttgcggggggagcgggcgcgcggggcgggcggggaggcgtggggaaacggcgcgggaagggagccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggaggaggagcagagagtaataagtcaggcatggggagggcgggctgcaggaggcgcgcgtccgcgcgagccgcagcagctgtcagacccgcggccctgcccccggcccggcgaggcccgggtgtcccggcccccagcctgcgatcccagctccaggccgggcggcctcctccttaaccctcggcgtgcgcatcccgggctgctccgcgaggaccttggccgcggcgcctttgcgctcagctgtcagccgccgccgggtggcccggaccaccgcgaccggcggggaatcaaagcccaagtttagggtcgcaggaagaggcgagctgggggcctcgcggcgcagacctggatcgaatctctcctagcgaaagatcgggttgtcggaaagcgtcccgcgtagctaagacctaagggcgccaggcttctgagagggaaaccttgcacctcctctcccacagatcctccatgaagtcaaggtgcaacacacacacacacacacacacacacacaccctacactccagtctccaagccccagaagcttcacccaggagactggtttatgaaggggacactgccctccccgtccccgcgtcgaggcgctccgtggccccgctgtgcttcgctcacccggcgggtgttcgggagcccggcgccgctggagacggcggcgggcggcgctcacgggctaccctaggtgcccacgaggggagagactggagcgagcatctcggcgacctcggtctggccaagcatttgcaggaactcggaccgtgaggggaagcgtgcagggccgggagtgagtgtgtgaaggggtggcacactcctggcttctggggtcgcgggcgcatggggcatccccagcactctcccgcgcgtaggcgagtttggtaacttgagggaagttccggcgcggccgctgccggggtggtttgtctgtggcccgatgaggcgcgcctcgcagcctgctctcccggtcaccgccgtcgccgtgacctgtggcctccaggaaacgagagggaccggggcgccccacccgcgagacggacccgcagtctcccggcgggcccgcgggcggcgagacgcggcgt

SEQ ID NO: 10871 - DNA, 506 bp, Homo sapiens
  source 1..506: mol_type = unassigned DNA
cgcctcacgacgtccatgctagggcctcccagaccagcggagaaaccagcagccctggaccgcaagcggcggggtcagggaggcgacaacgggaagcccctgccggaccctggacactcaggacctagtgctgcccgggcgccctcccgcagcagccccagggcgaggaggatggggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggctcctcctgtctcaggaaccgcctgtcccttgccgcgaccggcgagtccttccgggtcttcctgaaacagtttcgtcccgaggctctggatctggaagcccaggggcatcgtccgggagcggggcacccactgtgggtctccgccagccagcactcaggcccggagctcggggacagcgggcgc

SEQ ID NO: 10872 - DNA, 1503 bp, Homo sapiens
  source 1..1503: mol_type = unassigned DNA
cgcgctcctgggtacccagaaataggctttccccgggaatccgcctccgaccgggcgtctctacaacacctgaagcttctcaggacgccctctgagctgggcaaggcgagaggactttctcccagagcccagccccgagcaatgcccgagctcgcgaggtggggctgggggcgacaaggaggcggagcggggacttagccaccggggactcctctccaagtcagttcccaaaccattcggcgtcatgcatccacagcccgcgcgcagcccgtgcgccctggaccctacccaagcactaggctcgaccagggccggtccgaaggtcaccgtctacggccagggcagaggggcggcgggaaaagggcccagtggaccctcggtccaggagggccggtcagctgttgggccgcgggcacccaaagttgcgggggtccgggtctccgaccccacgcccagcggggctctagtacccgagggcgcgcgctgcgactcgcagagcagcgggtgcagcaggctggcggggctgggaccgcgagttttgtttgcaaagttcaggcggggcagacgccagggagggggccgcgtccacgcgggcagccccggcgctgacaggtagcgacgcactccctcgtaatccgtccaccagcagcctaaagtgtgcactgggttcccagtgaaatgcctggccttgaaagtttagccaacatcgggtccagcggagtcaccagggccgccccctgccccgcagaaccaggttctggcctcggccacggtgggggtcccgtatcagcccgacaaccccgaggtcacgcgcccgaaggactctctgggacaagaagtggagtggggcggccaggacgcgggccgtggggatcgcgagggaggagggggcggccgcccggacttaccccgtggggtccccgcgcgcgggcgccccggcgtgtcggatcatgccgccggcagctccgggacggggaacggaggcgctcaggcgccgggccgcgcggaacgcggagtcccgggcgcccgcatgtccctggctctggccctctggaagggccaggccgccgctgccgccgcgctctggggctctcgctcccttctacttcctgtatcggagcgagcggggctttcaggaagaggctggccttggtggtcaagggtttttttgtcaaaagccattcggcagcggctcgcggcccggagccccctggggcacacggaggcccgggcggccgcgcccccggggccgggcctcggggcggggggtgctggggccaaggcgccgcacgggcgcccaacctcggggtgccgcctccacaggctgtggctggggctggggcgcgggaggcccgcggggcttcggagagggaaacttagagaaaagtcttccacttggcttggggccgcaggggaaggaagacgccctccgcctgtgccggcgccgaccgcgggccggcaggtggggaggcccagagctggcggggagttcgtcccactcgg

SEQ ID NO: 10873 - DNA, 907 bp, Homo sapiens
  source 1..907: mol_type = unassigned DNA
cggcccacgtgcctttcatcctggcccgcagaggcctgagtgctgtttcgggcagctccgggcagggctgggtagggcccagcggaccccacgggccgcccccccccgcctctccccagctatttgtctgtcgtccctcttcgtccctcttctcctgaggtgctgtcccggccctcggggcgggggcagccgcgggcagctcagtccgcagcgcttccagaggtgcccgagtctcctgaacgctccgcaggaaagcagctgtgctgcgtggagccctcccctcgtcccggtccctccgtccgtgttcctgtccctcccgttctgcggcgggaggtggcggtgtgggtctccggggaggcgcggcgggctggggaggtggggaagggtgtgcgcgtgctgggggtgggggggaaagacctgccgccccccccccccgcctccccagcccttggttgctatgcagtttctatggcagcggcatcctcagactcaactttcaccctcgtttagagccaattaaggtaaaatagtgaggggaggagggaagagcgtggccagggaagggaggggggagaggcaggaaattcaattcgaagctgcaagtgcagcgtttactctgccaaagtcgcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccga

SEQ ID NO: 10874 - DNA, 1925 bp, Homo sapiens
  source 1..1925: mol_type = unassigned DNA
cgggttctccgccgctttggggctgagcctggtgtcgctgttcacattgaacaggacgtcctcctccgtgagcggcggaaccgccacccggtaaagcgggtgctcgaacagcctggccaggagggaggcgtctccgccggggccggggggcgactcggaccgacgcgggccggggtctcgcagcagcggccggtgcgcggggtcgtggggtcttagggcgccgggatcccgcccccgcaaggcgcgctcggccggctcggccgcgggcggcagtttctccagcgagtgggacgagaggttggaggaggggtcggagctgaagtcctgcaggatgcggagcgtgtgcttgttgggccagcccgcgtcgccggcggcggaggaggcggccgggggctccccggggcggccccgaacctgggcccagccgggcgcggccacctcggcggcgggctgcgcgcacgaacagccgggctcccccgagggccgcgcgccgcgtcgctccagcctgggcagcaggtccagggcgatgtgcagcgcgcaggccaccaggaacaccatcaggatgagcacgcggaaccggcgcaccagcatcatcttcatggccgcgcgggccggcccgggcctggagcgcgttctgcccgcgcgcccctctagctgcagctgggcacgagcgcggcgccgcctcgcgggtcaaggtccatcggtgccgggcggctaccagctccggggctgtccccgggcccgggccgcgtgcagggcgcccgccgccggagcgctgggtccccgcgccatctcgggcccgtccccgctcggcctctccggagcggccgcgccctcagccggggagcccaggggtcctggtccgcggagccgggcgcgcggggggcggctggggccgcagcagggggaggctcggcgctcgcagccgccggcgcggggctcatcgggcgtgtgggtccatcccggccggggcgcgacgggcctgggcggtggcggcggccgcaggcgtcccgatcctcagcgcgctcctctccaggcgccgggcgggcgggcggggaaggggcggctcctccgggccgggctctgctctcacgccgcgcccgggagaccggggctggggggaaggggggggcgaagggcggaaggggtgggcgcggggagcggccggcggggtcccgggcaggtgcagcggccgccccgagcgcagctcccgcctggccgagcctctcggcgccccgcgtcccgggcgggcagatatcgagcgccgcggagccgccccccgcgtcagcgcccacagattggcggagccgccgccccacgagtcacggctgggcccgggccggctgcgctcccgctctccttcctcctcccctcggccgcgccccgcgacgcctctgagctccgggcccgctaaggagagggctcctcctgcccgcggtttgcagagggaagcggcggagaccgggagggcgcgctcggttctggccaggccagcagctgcggccgagtggggggctccggcctggccgcttcctgggaccccctcccgcccggggccgccgccgccagctgcagcctctcggctcctccccagaggagcgcggggccggggcccaggccaagtccctccccggagccgcggggcgtctgcgccgccggatgagctccccgccgggcggcgaccccgtgccccacgcccgtctcggcaaggaggaggcggaggcggccccgcgagagaggcccaaggagcgactgggcctggacccaggggacgccagggcagcggagctcccggcaccggtcccgtccccccccccccgcccacccgcgggacgcgcccgccttaaccctccaggcgccgggcccgctgggggcgctgagaggggctggtgtgccgggggcgccttcctgcttggggccgacgg

SEQ ID NO: 10875 - DNA, 1287 bp, Homo sapiens
  source 1..1287: mol_type = unassigned DNA
cgcgtggcccgggaggctcccggaggagggaagggcctatctcagcgaggggtataggcggagaaggtgcggggcgaggcggccgcgggtccctggcatccctctccttacgcccaggctaagctggcggtgctgctggtgacgctggtggtggccgcggtctcctacctgcggatggagcagaagctgcggcggggcgtggccccgcgccagccccgcatcccgcggccccagcacaaggtgcgcggtgacggctacttggaggaggacaactcggacgagagcgacgcggagggcgagcatggggacggcgcggaggaggaggcgccgcccccggggcccaggcctggccccgagcccgctggactcggccgccggccctgcccgtacgaacaggcgcaggggggcgacgggccggaggagcagtgaggggccgcctggtccccggactcagcctcgctcctcgccggcctcagtttaccacgtcttaggtcggggggaccccctccgagtctcgcgctgtcttcgaaggcccctgtctcccttcccccacgttggggacgcccctcccagagcccgggtcacctccgggcttccgcagccccctccaaggcggagtggagccttgggaactccccggccaagcacaggggttcgaaaatacagctgataccccgcgggcccttagcacgcgccccagcgccggagcagggtcagggtcttcttgcgacccggccccgctccagatccccccagctctcggccgcggacccgggccgcgtgtgagcgccctttgcacctcctatctccagggtccgccgagagccacgattttttacagaaaatgagcgataaagagattttgtactgtcctgactggagagtcccaggccgcgggggacggagcgcccctgggatgcacgcccggctggcccggcctctgggcgcggtggtgagaggccctgacctagggggaccgcggggtgtggggagtgcggagccccactgggggcggggcgaggtgtccgtaggccccgcccaccagcccctcctccctcctgaggccccgcccccccatgcctgcctgcctttgccagcctcagccaggagaagggagcgggggagcggctggcagagacagaggagggtgtgacggcgttgctggtcccccatgggtccagagggcgagacagactccgaaggcacaccctccaggggcctgtgtaggcatcctcggccctccagcgaccacccccgcgtcggacagggtccacttccgagccacgg

SEQ ID NO: 10876 - DNA, 2906 bp, Homo sapiens; identical to SEQ ID NO: 5674
  source 1..2906: mol_type = unassigned DNA

SEQ ID NO: 10877 - DNA, 2146 bp, Homo sapiens
  source 1..2146: mol_type = unassigned DNA
cgaaagcggccctgagagcgtcctcggggctccttcgaagtgtccaaaccaccagcgtggccagcggccccgactccccaccacgtcctcctccgcgggcccaaagggacctgggccccgcaaacccctgccgagggagacgcccgccgaccccgccggcctacggggcgccctgctcccctcggggcggcttctcaggcaggctgagagcgaacgggatgagcacaccccggacgtccaagggggcgcccagcgcctcgaagccgccgccctggcctgcgtcgccgccggcctcgccttcccgggcaggctggaagcgccaggtgcccgcgcggctcacgcagtagatggcgccgtccagggcggcgcagcggaagggctgcaggcccgtggggccgccggggaggcgcaggggcgcgacgcacgggctccactgcttggccaggcagtggtatcgggacacgctgaccccgctcggccccgccgcctgcgcctcgccgcggctgccgctcagatcgaagcggtagatgaagccgtcgagagccaccatgtcggccgagcgctcgcggctgctgctgcacgggcactcctgccactcgtcgcgccgcgggtcatacttgagcaggcgatagaagagggagcccccggacacgtagatctcgccgtggcaggtggtggcctcatgcgccacggcgaaggcgccccggggcagcggcgccacgggggcccagcggtcggcgcgcgggtcgtagcgctccacgctgagcaggcactcgccgcccacggcgtagaggtgaccgtccagggccagcagccgcagctgcgagcgcgcctggcgcaggggcctcacggcgctccagctgtccgtggccgggttgtagcagaagacctggtcggacgggcgcgcgcggccgtcggggcccgcgggcgccacgccgcccgccacgaagaggtagttgtagaggacgcacaggccgcagccccgcgccggcgcgccctcgggcagccgcgtcagctcgcgccactctccggccgccgcgtggaagcagtagacggccgcgtccccgcgcgcgtccgcgtcccccgaggggctctgaggccggctgcccgcgcgctcccccgccggcccgagcgccgcggccaagaggtgggcgcggccggcgcgcaggcggcggcgcagcagcaggtcccgctctgcgcccgacaggcggccgaacacggcgggctcgcgcagcacctccagatagtggtcgctcatgaagcagtaggcggcgtcgcgcagctcgttcagccgctgccgcttggccgcgctcaggacctcgtagcagttggccaggctcagctgcggccccacggcgtcggtggcgcgctgcgcggcgccgggcagctgcaggcggcgcgcgccggccaccacctcggccacgttgtcgggccgcacgcccgccatgcgcccgctgtaggcgtcggcgaggagcagccgcagcgccgtcaggctcactccctgcacccgcagcacgtcccgcgacgcgcgcgcgcggaagtagtcgctgcgcgccgccagcaccgccttgtgcgcgcgcagccggcgccccgacacctccagcaccaggtccggctccccgtacaccgccccgaaccccgggggtacgggcgcgggctccccgggctcctcgggggacgcggggtcctcaagccaaacgcgcggttcgggggacggcgccgcgggctcttccgggcacgcgcgctcctcaggggacgcgagctcctccggggacgcggcgcccgcgctgccggcctcccactgccgctccaccacccgcgggccaccgctggagggcggggaggtggccgcgccttccgccgctgaggcgagggactgcggcggggactcttccccggagctgaagcacagggacgcgccgagactgcagggtgtctgcgccggggacgcggcgccctcgctctcgctctccccggcagccccgggctcagtccctgggtagaggacgcagggggccaccgcgtgctccatggccgggctgtgctgcgctgcgcccgcgcgcccccggttccgcagcctgcaggtctggccaaggtcgagccttactccggggtttccagcctcacagcttttcctggcacgcga

SEQ ID NO: 10878 - DNA, 865 bp, Homo sapiens
  source 1..865: mol_type = unassigned DNA
cgggagtcttctcctcccgtgcgccgctgcccgggacgagaaacccgtggggcatccaggactaggacacgaggtctcagcctgggcaggtggacaagctgtggggtcccaccctccgcaggcgatggcttcccaaagtctgtacaaaccggtttcgccgggccggccatgcccgcccctcttctcggcgtgggaagccctttcaaaagtggaggggagcgagtgtcgcgccctgccaaccccgactgcgcctgggccctccccgcgccgggctccggagccgcccctcctgactctgcgaccacggccggggaccctgcgcgcgcccgggaatgcagagtctccagcgccgcgcagggctcgccccgacctcggccggccctgggcaacccgctccgcggccagtccccactccaagatgtggctcggctcccacctccgcgggggggaaatgtcgggcgacccccacactgaccttcctgcgcacccagcgcaaactacgaacccagagttggagctgcccgcagaccccgcgcagccagaccccgcgcctttatcccgccccgccccgccccgcccggcgcaccaatccccggccgaggaggggccgcgtggcgccgcggggggcgggccgcgcacgccccccgcagggaggactcagggacagtcagggccccgggagagtccgcgcgcatcgcccggctccgcggcgccagccatggcgtccgtgcgtggccccgccagggatggggcgacgcggtcagagccgcacgcgaccgaaatccgcactctggagccgcagagcgcgcggtcttgctgtttagcggctccctggcaagtgacgtggggaagaaacgcagggcgc

SEQ ID NO: 10879 - DNA, 865 bp, Homo sapiens; identical to SEQ ID NO: 10878
  source 1..865: mol_type = unassigned DNA

SEQ ID NO: 10880 - DNA, 1463 bp, Homo sapiens
  source 1..1463: mol_type = unassigned DNA
cgcaatttggggcccgcagacgcgcgtggacacaaaaacacacgctcccgagatccaccctccccgggccacactgtggggctgcgtccggggcacgggccatgcctgaaccttcttccaccgccgcgccccgggcccgcgccccgccggccgcccgcactgggtcccgcgtcgcccccgccaccacaccgagccgcccagtacctcctcctcctgaaggttggcctcgctcggggtgttctccttctcggctttgccgccgttgttcatcttcccggtccttcctcgccgggccgggcagggctggggcgcggggctgggcgagggcgcgctagcccactggagccttccccgggcgccggggctccctcgggcgggcgccgcgggctgtggggctggagctggagccggggcagtggctgtcgggctcgggttgggctggggctcccgcggcgagtctgcgacggcggcggcgggcgactcaggaagtgcaagggagagacggggcagggcgcgggccgggagcggggcaccgagacaatcgggccccgggagggcgacctggagagggagggcgggagccaggggaggaaggaagaaggaaggaaggaaggaagcaaaggatggggcgaggacgcgcgtcccaggagtaagcgcggagagttggggctgggggctgcagccgctggaaggaggggacgggggtgcctagagaggaggaggaggaggaagaggaggaggaggagcggggcggaggagcgcgggccgcggctgggacgctgggacccgagagccgctgagtacgcgctccaggcaggctctgggaagtccgggatggaagcagctccctttctctcgccttcctccctcccctctcccctccctcctctccgcgcctctcctcctccctccgccctccctggacgtgggctgccggctgcagcccggagggacggggcgcgggacggagccccccgcgggaggaggggccggcggccggatggcgcgcgccggggaggggcagcgggccgcgggcggaagcggcgaccccagcccccgactcagcggctggtcggagggcgagggcccgggaggccgagggcagggaggtcgggtcccgccgttcccttggcccccgggggccccggcgtctgcgcgccccgggacttcggggaccctgccccgccggggcctggaccgggacctgggatgtgtgcgacttttagtttgccggcttttaccgagggatttgcacccctggccctaagcccacccttcccgagccagacccggttcttcctctgctgcttgaatgacagcatgagaactcgagggacaccggggacagcccactccgggccggctttttcaggacagggcttcaaacccatctccagcgcgggtcctgcgacgcgcccggagccttccccgcttcgcttcctgagcgtcccgcggccccccga

SEQ ID NO: 10881 - DNA, 1437 bp, Homo sapiens
  source 1..1437: mol_type = unassigned DNA
cggtcccccggagctgaggtctgcgcgactggatttaggggcagaatgagtgcgtcgggaaccccaaaaccctagatcaagatacaaggggagtcgacggcccggaaacctcgctgcgggtgccctaagcgcgaggccgcccgggcagggccgcccagggaccggggcgctgggtgcggggcacggggctccacctcccgcgggctggggcgcgcagcgcgcggcccctttaagaaagttcgccgggcgagttcatcaaagtttaaaaactcgccgtggagaagggcgcgggggaagaggagagagggagagcgctgacccaggcgagagagaggggaaaggcccggccggaggccggcgccccgcggccggggccggggcgagcccacggtgggcggtggggattggctgcgcgttcccccggagaccgcgcggcgggcgggggagggggctggccgggccccagctgaggccggttccggccccgccccccgccgccggcgcccgccccctcccccggcgcccgccccccgccgccgctgccgccgccgccgccgccgcggcgcactcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtgggtctgtggccccgggacttgccgggtgaagcgcacgccaggcgggcgcgggagagggcgagcggggcctgccgcgcctcgcggggccggggtggccatcgctcccggcgccttcccgccgctgccctctcgcccgggtaggagcggcccgtgtccgcgggcgggagcgtgcggcctggactgccccgccggacaggcattgtctccccgccctctcgggctcgaggcgggccgcgcgcgccggccgccgtccgggcgtcccgcggtgggcgagatgcgccgcgtccgttccatgcctgccgcccgcgcgccccttgctccccaccccgtagccgctcgccgccctcctccgaggcgcacctcctgcgtggccaggaccccgcctcggcggcacggagcggagcgggattagcacggcccgagggcggcaccctcactccactgccttttccgccctgaccccctccccgtgaccttggaggcctgggccggccggctcctcggttcctgcga

SEQ ID NO: 10882 - DNA, 717 bp, Homo sapiens
  source 1..717: mol_type = unassigned DNA
cgaggagaaaggccgccaaacggagcgagagctcccatttccacccaccccagtgctatggtggcacatgccgaccaccacctgcgaggcctcttcgcagacttgctccctcggcttcgcagcgcggacgacccgcagcgtctcacggctatggccttcttcacaggggtgagcctgcttcccggatgggtggtgaagggtgaccctggacttgatccctgaatcgcagcggcctgcacggggaccgcgggcgtgctgaccccatgtgcctcgcctagctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgtgagagaaggggaggggtggagaggggcttggcccggtcgcggcgaggtctgcaagaggctgaccccgagtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacgtgagcaaacgccccgcctccgggtcccgcccctgccgc

SEQ ID NO: 10883 - DNA, 1713 bp, Homo sapiens
  source 1..1713: mol_type = unassigned DNA
cggtagcgaattaagctgcgcaggcgccttgcttccccctccatcaacatgttcgattggcctacgattgattacatcattggtccgcgcaaccctagcaggcttctgggcctgtagctgagccgaagctcttccttttgcgtagcggggcggggcacgatggtggcggggggggaggggggaattgttctactacgcatgcgcaccggggatggcgacagggcctctttctttgcttctctccacagctcttcccagccggggggctgagtgccctcccccttctctccctgcccctcccctttctcccccctcaccgcccagcggggcttctaactgacagttgtcgccgggccccgtccgtgcaccgcctccttctgcccgtgtcccccgcaggtagaggggggcgggagggggtgtgagggagaggaggagccggagccgccgctgcggccccctccggggaggggagaggagaacccccttcctcctcgccccctcccagccccccgctggcccgggagggggtggggcgccgaggccgcggcgacccggcagggcctggccggtgaagagcaggcgggcggggtgcggaggggtgaggccggcgagggccgtgcgcgcgccgccgccgggggggaggggagaggagggcacctaggctctcctcttctctcccccctcctcgcgcgccatgtaaccccgccccgccggcggtgagctcaagacccccgcgcgcaccgagccgagccggcggctgaggagagccaggcccgatgtggcgggggctacgcgccgcggccgagccgtgaggaagcggctcgcgctcacgcgtcccccagcacctcgagcggctgttccacaccgcccagcctaggcctgccggggcatgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggtaagcgagcccggtccccggtgggactgacagactgacacaaacacacactcacacgtgcccgaggatgggctgggccaggggcctgggggcggcgctgataggtgctgagtcggtgctggagaagcccgggaggaggagcggcgctgggcggggaccggaggggtgtggtgggtgtgggccgaacccggcttgcgcgtagactgagaaggaaacccgagtctgcagcgc

SEQ ID NO: 10884 - DNA, 699 bp, Homo sapiens
  source 1..699: mol_type = unassigned DNA
cgcgcgaaccgctttaccctggatccctggaatcgtgcctaggcacccgggcggcggggtccgcccaggccgcgtcaggcagctctgggccggtgggtgccgggtctcccctcctcccgccccatctggcgcgcccgcagcgccgccgccgccgccgcttctctccccagcgggcgctcggagcatcccgcgccgcgttctccccgccccggcccccgcccgccggagcggggcccacgccgctggcagccatcaagtggctcgttaaggaaatgcaggtgagtgcgtgaggccgagcggcagctgctggagacgtggggtgtgtgcctgtgagtgcgagcgagacgaggagggagcgccagcgagcgagcgagcgagtgcgggagcggccgcctcggctccccgcccagccgcgcccgcagccggcggccggagcgcgtgggggcagcgcctcgccccgacagagcctcgcctcctccttgccgtctcggctgcttctccgaggagccgggagccgctcatcggcctccccaaccctgcgctcccctcccagcccgagtcctcccgctgctctttctcctcctcctcccgagcctcctcccctccggcgcggcgccgccagccagcctcggcggggagagtgcaggtactttgccttcagaataattagcaggacccaagccggctttccgagcgcgc

SEQ ID NO: 10885 - DNA, 1191 bp, Homo sapiens
  source 1..1191: mol_type = unassigned DNA
cggagcgggcgaggacggctagttcctgcagtgcccaggcctgcacggaagcgccctggcacaactcagctgaggatacacgctttttcccgcgcagccggagggctgaacagcaaagcactccccgggggaactgtgtgtcagcgcagcctggagagagcaggcccagggggcagctccaccacaggagacaggacacgcctcagtctgggcaaattcccggcctcctttggctctaagccagcagccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacaggaacccgactccggcctccgctcccgggactcggagccctctgggccctggctgtagccgaggccgcagccggtgagaggcggagcctcgagcgggcccctcctcctccgttcccagctacccccgacctcgcgcacgccctggcccgctccctgcccgcggataccttggactacggtgccttcccgcccccaccagtggacacttccgggtggcgcttggccatccgcttggtggaggtcga

SEQ ID NO: 10886 - DNA, 536 bp, Homo sapiens
  source 1..536: mol_type = unassigned DNA
cggacgggatgtaaagtttgggtgagacggtcaccggacgtccactggaagggtgcggggacctctacgccgacaccccgcctccccgcctcagtccgcgcactcaccgcgcacgcagagcagtgacatggccgaggatcgggcaagcctctgccgcgccccagccgcgccggaccgctccctctttcctctcagcaggtgccgcgactgctctcgttaccggccccacgggtctggcagctcctcatggtcccggtcgcaggtagcgtcccgccgctgcctcggacccgccccaaatctcaccgtctgagcgaactccgggtagcggtgagtaccggccggcaggctggggactgggcgcggcacagcgacgccatcgctgggaggtaggagctgccgggactccctcccgtcattccacccgggatccgcgcgagcgcctgggcggagccaacccgtggtgccccgccccccagccaattaactcacgcccagtccaccgaccccgcccccccccgcgagcacgtaggaggcgg

SEQ ID NO: 10887 - DNA, 728 bp, Homo sapiens
  source 1..728: mol_type = unassigned DNA
cggccaacacggccaggcctcccgggcgccccaaggcctcgtcaactctggcaaaggcggtgctgaggtgaaccacgtggatctgaaaaggacacgagggtaggagagggccacgtctctggccccgctccgccccgctcctttgccccttctcggccagctccgcgctcacctcggcagggaaacggtggccttccacagtgtgctccgagcccggacgacctgcagccccccagtgcagatgcagctgcagagcccggtactcccgcccgggacccagagccatctctagcccaggaggcagggtcagttgcactgcgtagggagaggcaagtgagccggccccgcccggtagggccagcccaacccccgggcaggcactgccgcgacggttcccttccctgcgccccgccccatccccaagtctcggcggggagaccccctcaccactgtggccattgttgcgcaggcgcagttctgggagcggcgggagctggaagcccaggagttccagggggcgcagggccgggcagaaggcggcgagctgggggcggatatccaccggggactggaagcggcccgcgcaggctggggacacccggggccagggcgggtcgcctggggtgggagagtatagtgaggaagtctgacgcctaggtcaggaacttagggaacccgggtagaaaaggtgagggggtgggacggtgggcggcgggtgggacgcccgg

SEQ ID NO: 10888 - DNA, 1431 bp, Homo sapiens
  source 1..1431: mol_type = unassigned DNA
cgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcaggtgcgtgcggcctcggggtttggggacgccgcagcccggctcggggagggggcgctaggccgggagccgcagcgcgggagggacgagcccgggccggcggggggaggggagcgggaagcgtctttgttgttggcgaccgggatcccttctcggcacaggggaaaggcggggaagccactcctcatcgggtctgtgtttttgagaggattctctgatggttgcgtgaaggggagcggtaggacagtccctgcggtccgtggagcggccggagtcagggggtgggggagggaggaccgaccga

SEQ ID NO: 10889 - DNA, 588 bp, Homo sapiens
  source 1..588: mol_type = unassigned DNA
cgacctactttgcgagctcgggtgggagtcccaggcctgtaggggccgcgtggcgccaccttccgatcgcgatctccaatggcgagtccgtgcggcccccagtgcgccgctccctcctgcgggccggtggggtctgcgagaatccggggctgggggcgggtctggtagtggcgggcggggacctcgggtcgggaccgagaagcgcctccgaacggcagttatactggggctgctcagtggcctgagctcctccctgccccctccccacattcctttgttctggcgcggggggtcctcgcggcgccgaggccccgctgcgccgcccacccggagggaggagggtctctgggaggcgccgcgtgggggcgcggcccgtggagcccgggcgctagggaccggccggggccggcgtacgggtgcgctctgggttcgcccgggccgcgggagccagggagccagggagccagggaccccggctcccgcacggggcagacaggggcagcgcgggcgacccggagcgcctgcgtctccgcggccctccttccaacagggcaaatccaggggcctgactccgcgcctgttctgcgg

SEQ ID NO: 10890 - DNA, 1203 bp, Homo sapiens
  source 1..1203: mol_type = unassigned DNA
cgcttctctgaagtccgcctcccagcggcctggagcccggggcgtggtcggctcgaatctgctccccaggcccagaacggagcccgcagcccgtaacccgctgtggccgcagcgggtcgcgcccttcgtccccgcctcaggagcggccgaggatctgcccagctgcgggcgccaagccctggccgcactcctttccccggcggagggagccggctggcgctgcggccttcaaggcgcgcggacgtcgcggagggcagccagtcgcgcgggagcgggtagcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccaggtgagcgccggccggggcgaggccgggccccgggcggcaggcacggggctaggtggttctgaaacttggcgcagccgcgagccgagacccccgactcggctagccgcccgggtatgctattgtgcgcgcagcccgtctcgccgtttgttttggtcctgtgagggttgttgtgaggcccaagcctctggcagcgctccgcctaccgaccggctgctgctgatcctcctgtgtgcccggggcccaccccgcggtccgcccgcaggagcgtttgcacccaggttaccctggacccaaaatagacggtactgcaccgtgcagactcgagggttgggcgt

SEQ ID NO: 10891 - DNA, 5370 bp, Homo sapiens; identical to SEQ ID NO: 5724
  source 1..5370: mol_type = unassigned DNA

SEQ ID NO: 10892 - DNA, 1691 bp, Homo sapiens
  source 1..1691: mol_type = unassigned DNA
cgagaataaacgtcagtccctacctttgtggaacgtccaacgcagctggctgggggaacacgaggccttgcagggagcgagccccggccccggtctgacggaacacaggcgacgcacgtgaagtccaggccctatcccagcgcaggcgggcctccagcgacccacagttgtcacatatccggccagcgccgactcccgaaggcgcactccccatactccactccgagcaccggtcccatcgttagggaaggtccccctggatagcaaggccggggcccaggatctgcgagacccaccccacccgccccgtcagagcccaggagcagcaacaggtctgcgctctccccgggcggcgctctgcagaccctcgacgggccaagggtgcccccagcccagccgtgcgctcaggccggggagatgggcggaggactggggctcccgacttccttgacagtttctgcgcgtcagaaactgagcagacacggggcccgcgccacctcgcccgccgcttgccccactccgcgaggctgcgcttccacccgggtccgggagggccggcccgcgtcccgggtatgaatggggctcttctccccaacagcggggaaatcccgccaccgccctccaccccggtccccggagcccgcggtggcgcaggtttgcccagcaagcccctgaatcggcagacaaaggggcaccggaggaaaagccgagcgcttccctaaacttaccggccacttccccctccccaaaacaaaggagccccccgccgacctccgtctctccccgcaaggcgcgccggcacttcggggagcggccacctcggggtattgttcaggctcctgggagcgcgccgcaccccagtccgagcgccgcggggacagttggcgacctgcacctacaggagttccaggggcgggtggagcgttcgggcgccccgagccgccggccggaccctggagggtcagcgcgggacccgcctccccgcagaagtttgcggaccccgcgcccggcccgccgagccctgcgcactcacctcgtcgcgagcagcgcaacttgtggcggcgccgcgcgcccggccgcgctccgaacctccctccagccggcagcctccgagtcccggccgtgcggcggccgaagagggcccggcgccccggagcagccgcgcgccgcccccgggccgcccccgccccgccgccgccgagtcccggagagagcgcgggcgctggaaagtttcggtggcgaatggcggcctgagggcgctgcggcggcggcggggcgggggcgctggcggctcctcgctcccaagcgcggagtgggggcgctgaggcgggcgcggcggcggcggcggcggcagcgggagagggcgggacagcgggagggactggcacggacagtgacctccacggggagctgccgcgagcgcgcggaccccagccaggaggaccgccaggggtccgcccccgccgccggcccctccctcacggccgtgggaggggacccggcgtaccacccggccccgcccctgcgccccgggggagccgcgtcccgaaccagcccctcccctacgagggtagggactccggccctgcccctcccccgcggctcctagtggggacccgcgtcccaacccagcccctgtcccacggtcgggggaccagcgtccctaccaagcccgccccgctcccccacgc

SEQ ID NO: 10893 - DNA, 1223 bp, Homo sapiens
  source 1..1223: mol_type = unassigned DNA
cggaatgccacctgccccgactgccctcgggtggctacaggcgcgggggaaggcgcagggccaggggcgctgagggtgaaacggtcccggcgtccgggcggcggcggtggccgcctgcggcagctcagctgaaacgcagcggaaactgcagccagtcacggggctgcgggaggcaaggcaggaaggtggcgctgccgccgagcgcctggagcccgagcgctcatcatggcggcaagggcaatggccgccacggggagcgagcacgcccctccgcgcgcacacgccgccgcgccgggcctccggggcccgtcaccggcgccgctgccgccgccgcccgctctcccaccccccctcacgggctgtagcggaattttctctccagacaccgcctccaagatggcggctccccctcccggcaaccccctctatcgtcccctgcagcaggcgccgagccgccgccatcttgtcccccgtccctccccccccctcaccgatatttacatagcgaaaatcggcccggccggcctgcggccttcacctcacgcctgcagccttcgcctcctcgccaggcctcaccccggcgcggtgccccaggtcggccgcggagccgacccggggcccctcgaccgcctccggcacaaccgggcgaccctcccccaacccccgcccgcttacggagcgcgcctccgccgccgctcggggcagccgggctcctccccgggcctaactgcggcctcctcggggcctgctcggcgccgcgcgccacgccgcccggcctagcgcgggagggcgccttgcgggccgccgaccaggccgagaccaggccgctgtgcgcgcactaggccccgcggccgcggcggcacccgggactcaccggacggacgtgcgggcggccggcgacggtggcgggtgctgcaggccggcctttctctggagcactgggccgggctccggctggtggggcgggcggagggagggaggaggggccgagctcggagctgacaaaaagcggcccagctccccggcacgggcccgccgtcagcacgtcacgtcaccgcccgggagagagacccaggaaaatgcggaagggtagacaggccccctcctccgcccggtgggtcctcctggcaccccgtgtcggcgccgctcccgccccgcgaccggggagcccagtggcctcgctgcggcggggtctccggcggccggagtctccgtgacagcgc

SEQ ID NO: 10894 - DNA, 1103 bp, Homo sapiens
  source 1..1103: mol_type = unassigned DNA
cgaggcacgcaccaggggggacctcgcactcgcagtccctcgtcccgcaccccgcagcccgggacggcccctggcccccggcctcagcgaggccgccgaagccgcagtacccagccctggaaggccaggcagccgggaccgcagggaccagccccgagcggcggcggcggcggggcagaagggcagccgctcccccgggacccaggacgccggcgggcgggaggcacacacgcgcgcacaagcggaaagaaagcgggcttactgcgtggggatgctcgcccgcgcagctgtctcggcggcggcggccgctgcctgcaccgaggccgaggcgcggcggtggcggcggcggctgcggactgagccccctccgccgggcggtggatgtagggcgcgggaggggcgcgaggggaggggtgcgcgcctgggaggcggggagggaaagaggggaggaagcaggagcgcgggggcgggcgcggctagccaggggcggggcggggcgcgcgcggggccgggctctgcccactgcacggaggctgtgtgcggggcgcgcgcgcgggagacggccggacgggcgtggggagaggggcggcttgccacgcaccccgcgcgcccacgtgcccccgccactggagagggccgggcacgcggagagggtggctgcggggacgcggtggcaggctctttcccgaggaccggctcggatccgaagaccgggaggagggcgggccgggggcgcctcgggccccctccctcgcgcagcggtccttagaggcctgcgggagtcacgaatcactgcaggcggctggggctggggaggtgggagcaacaaagacagccaagtgagggtggcgtctcgcctcaccggggtcctcgctaacctgcgcactccctgaaaagcggccccgcttcggggcccacgccgtttcggcctccgacttcggaacccggtggcttgcagcggcgccgaaaggcccaccgacgacccctccccttagtagcaagccggagggagctaaataagccccatccataatcccagtgccaccatccagagcgttttaacgtcactcagaaagcaccgatggcaaagcggcgcgtggcgt

SEQ ID NO: 10895 - DNA, 616 bp, Homo sapiens
  source 1..616: mol_type = unassigned DNA
cgcatccaatggcgactcgacagccctacctggcaccggtgcccggctcgtggggcgggtggagggtcgggcagtcgcagggcgcgggctccctcgggtggacggcgcccggccgggccgggccgggccggggaggcaggcgcggggcgcggggcgcggtgcacagcggggagcgcgcagggaggcgaggaggcgcggactgggctccgcccgcaggagaacaaacaggttttctccggccgcccggagcctcgcccctcgcccctcccctcggccggccccttcctctgcccctcctggggtaggtagaggcgcctggcacattccgcacattctcccgccagcgtcctccgcccgcccgccccttctcggccccgccccgcggggctgctggagaaatcaagtctggggctccccttgtcgagcacggggcgagctccagaaggctctgccgtgatggaaaacttccaggcaaattcctccgggcccgtggcccccaggccgggaagcctccgccacgtgaagggcccccgctcctagttgcgcgatctggccccggcacagggccaacgacttccacagatgctgtcgggttaattcagtcgagaactaccgt

SEQ ID NO: 10896 - DNA, 206 bp, Homo sapiens
  source 1..206: mol_type = unassigned DNA
cgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgc

SEQ ID NO: 10897 - DNA, 1141 bp, Homo sapiens
  source 1..1141: mol_type = unassigned DNA
cgtactaactggcgtgtgcaggcgctgctgcttcgcgctgcgcacggagaagcgccccgaatccaccgcacgatgcggagccaggggcagcgagtgagcggcggcctccagccctcccctgccttctccttgccccttttgggaatggcagggggtttcctatgacaaatgcccgcaaacaggacagggttcggacgaccccagagccggcgccttctccctacactctcagccctagggccggacccgcccccgcggctgccatcgcccctgcctcgggcgccccgcggggaccaccccgccaggtgagcgcctccaggagcctctctgaaactcacctgcgtgaagtacaagttcatcagcgtgagggtgaaaaactgcaggcacacagggaagcagtagagcagccagaagacgaaggggctgagcgaattggccgccacgaagtctttgaagtagaaggagaagaggacggtccgcagggaggcccagaagaggcagagaaagaggaagacgctctggtagctgagccgcttgtggcggtaacgcagcaccagccagagctgcacgtagatgaacacgaagagcagcgcgtagaacacggtgtagacgacggtgaggccaagcttcacgtaggggggcacggccggggtcagcgtgggcggcagcgagtcgttgcgggctgggtcccacggcggggtctccatcgggccgggggcgctgccgcgcggccggggacgctcgggcctcatcggggctcacggccgccgccgcccccgcgggggtctccgcgcatcgcgctcagcctgcagccccgagactggaggaaagaaaacaagccgcacttcctcccccggcaccacatgattcactgggacggcctttgtctgcgattggcagcgccgcgcccgccgcccccgcgcgccgaccggccccgcgcgcccccgccccggcccgcgcgcccccgccccggcccgcgcgccccggcccgccctcccccgggcaccgcgcgccttcgccccgcgaaccccggcccgccctatcctcgccaccgcgcgctcccgcagtgcgcgcccccagagccgcacgcctcctcccggccccctccccatccccggggccgcgcgctcccagactgcgg

SEQ ID NO: 10898 - DNA, 1819 bp, Homo sapiens
  source 1..1819: mol_type = unassigned DNA
cgcggacgcaggacgcagagccccagcaccggcagtcaagaggacgcaggaaagcgcacgcactcacaggctcagagacgcggacgccagacccaggcttggacagagcagccccgcaagtcccaacacactttgtaaaccccgaagacaggagagagccaaaatactctccctgcccgcacgcaggccccttctgtcccccacggcccgattctgggaggcggatgaggatatccccaggcctggatgggggccatgggacatcccactctagaccctgccacgacctgggctgtgtccgttcggtgctcccggcccacgggctgcacaacttggcggccccgaaactggcgtgggggaggggagggctgtccacccgagcaggacgcggctgtccactcagtcggaggtgaggaacgacctccctatcccgttgccgggtccaagcggggcccgagagccgccggggagagccaaagggaggggaccgatggatttcccagagtgaaactgtgcgtcctggagagttccgaggcagcctcgcgagccctcgaggaggtcgctgtcgcttggcaaacacaaacaacaataaaaggaaggaaacccaggcggcagtgcgcagaacgagcacagggtcctgtgagggcgcgcagggtctacgcgggtgcccctaacagggtcccccacgtaggcggcgcgggcacggggccgggggcgcgcggcgctctcagcgggagggcgcctggattaggggtcccgtctcccctcagcgcactcccgtctcccctcagcgcacccccgtcccgcgccaggcccacccgcagggtcctctccagcacgtccgcggccgcagcagccagcccagcacccaccttcgaagtccgaaatgatcccatccagctgcgcgttgaccgcggggtccgacatgatggctggtgggcagcgggtcgcgcggagggcagcggcgaggaagcgcccccggcggggcccgggccctgcgcgctggctggggcgccgcgcccgcgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtcagagaagccagggacgggcgacgc

SEQ ID NO: 10899 - DNA, 1813 bp, Homo sapiens
  source 1..1813: mol_type = unassigned DNA
cgagtccactccaccaacgccaaacccgccagccccgccagccggctgcaggaccgagggagggtgcaaaaggcggggggcggagggggggtagatcagattaggcgaaactcaataagctcccagccctccagcccaaagcttccaccatcgccgccaccaacgagccactccaattgagccagcatcgccgcccacccgccggcccgccggaatcgcgcccatctcctgcaacctcgcccggaccggcatcccgccccctcggcccggtctcccccttcccgccgggtgcaaagtcaaagacccagcaaggcgacgtgaacttttgcatgcagggcacacacgtcgcccccggttccgggagtgcgggggcccgcggcgcggagggaggctgggcgcccgggctcccgggccaaggtcgccgcgcgtgctcacccatgtcccggcggctccggctccgctggccccggcgctcgctcagatcccggctcccgtcgctcgcccgagcccccaaaggtgctgctgcggcaactccatggcgatgagcatctgtcaaacggcgagccgcgagctggccgccctagctcggggggcgccggggcccccgggcgcgcggaggcggcggcgagcggcgggcgccccggccggccccgcgcttcccgcccgactctgccgcctccgccgcgccaccgatttatggagagagatatcaagggggaaaatggcgtctccggagcccgaggagtcctggagtaatcacattcacacacacacgcccgcacgcacacacactcgcacacactggcacacaggcgcgcggcgagccctgctaattttagcaggagccaaaaaaaattttatatatatatatatatatatatatatatatatatccccgtctctccgatcaatgctttttctttttttgcttttttttttttttttttttttttttttgcttttcttcaaaggatgggttggagcgttaaaaaatgttggtgggtttgggctcgcaggaggcggcgcgcggagggcgagggcgcttttgctgagctgtgcagttcggtccgctgagcccggcggccctgcccgcccgctcgtccgcccgcggtcgctagtgttgccgccgccgccgccgccgccgccgctgctgctccatggccgcgcccgccccgcgcccccgccgcgtcccgtcgccgcccgcccgcgtccccggtgagcgctggagtggggtcgggcccgtgtgcctgcctcccgcgccctctccgaatcccggactcctagtgaaaggaagggggagggcgcgggcgcggaagggaggtggatcggagcggcagcgcggcccagccgaacgggtaccgaccgtcaccccgcgatcttcctcgcagggggcgccggcgcccaagctgctcgcccggagggcccagagccgcttcccagaccagagccgggggaggcgcagccagtagcgagccctgagcgacctctctccccactcgcccccctgccccagtgaatttctgtcagttgaagggagcggggctcttgcccggggaaaaggaaaacagttcgtggcctgggatctgggaccccttgccgcccccagcgcccctcccgctccccggcgcccttgcggcccagtggctcctgcgcgccggagtccgccgcgaagactgagcggccgcggggatcgccgcgggctccgcgcgtattcctgggctcaacactgccactatctgacacaacaggagcagtgtcgggggggtactgcgcgcccagacgtgagctgtgataggctctcgaaactgggcgc

SEQ ID NO: 10900 - DNA, 1872 bp, Homo sapiens
  source 1..1872: mol_type = unassigned DNA
cgtggacagaaagcacgcgcaaggggttccggggacaggaagccaccagcctggggagcgggaggcactggacatttccccgccccgcggtcggtacgggtgcgcgtgcggcagcggcggcaggggctccccgccctgcccggggtccccggtcgtgccccgccgcccgggccgcgctcggggttgattcgtaccaccttgcaaggaagtgaacgcttcgcacgggaaggggaggcgcctgcgccggccgccgcgcagctccggggacgcccggggctgccgccggctcggggccgcagacgaccgcgggacgcgcgagtcccccgtccccccttgcccgccgtcccccccgccacccttgcccgagaggagtcaaatccggcttttagagctcggggagggtggggatatccggtgcctctcccgcgccaggaggaagggggagggcggagaggatccttggccagtctgcgccgagcagattcaaaccaaaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccggtgagcccggcgccccccaaccccacgcccccgttctcgccccgggctcgcgccgcgccgcgccgctcccgcagtccccagcccgcccgcgtgcccacactccggcgcgcgctcgggcgcacagcctgagtttgcgagatcccgggaagttgaacccgccgccatctggcgaaggcgaatgtgatgtgactgttgctggtgtgaatatccgatgccaccgaacgtcctcataactgagggttattttaatttgggattcccctcccctcctccagccctccctcctccccctcccgctcccgaaataaaaccgacgggacccagaaggggaggctccccgccgggccgcccgcgcgcacccacagttcctgcgttgacataatctttagggtggagcgggagcagcctggacgcaaactgcgacgtttaggtaaacgtgcttcggaggaaggaggctgggacccggctggctttccctgttccctccaggttggcagccgcctcgcagtggcggagcctgtcgttggatgtgtgggtgtgcacctcgccggtgttgtctgcgtgctgtcagtgcagtgtgactgttgtctgtcccctgagtgttaacgaccgccgcgtggcgcgtgtcccgggcagctgggccagggtcggggtgggggcatggctgcctttgccggcacgttttgcagacattcaggtgacaccgggttgttgcgagaccttctggcttttccattccccgcgctccccaccgtcgtgtttccgcctcactcatctttagtaactggcgaagcaacagggaggaaacggacctcactctttatcggagccatgcccgcttaggtctttgctccgtgggtccctggctgcccgacttgactggcaaggcgc

SEQ ID NO: 10901 - DNA, 652 bp, Homo sapiens
  source 1..652: mol_type = unassigned DNA
cgctttcccggtggagacggcgacgtggcccacacgcgagcccctcgccgaggatgaatcaccagccagctcgagttgccacactttatctcagtacagttatcgcgagagtcccggggccgcgccggcgtgctctacgcacgcgcagtctttcgcggggccggccagtggtgccgtcgaggcggggggagtggccgccgcgccggccgagtgaggtagggtcacacgcaggcgcactcgcgcgccgacagctcgtgcaccgtgtggtagcggctgtgcgcgtccaggaaggacacctcgtcctcgtaggccgtcgggcggcagcagggctgcgcgcgcacccgctcccgccgcaggcgccgccgctggcgcagtcgtcgcagcccgaggtcgtagacgcgcgcggcagcctcgcaggcgcctgcgcagtagcggaacagcaccgtctcgtcggacgcgtagcccaggcccagctcgctcacgcgcacctccagctcgcgcagcccgcaaggccgcgcccccaaccgcgcacgcgcgcgccgccgccggggccccgcccgacggcgcggacctgggggccgcccagcccagggcgtcagctcgcgcagctccatcgcatccggggccccctgcaggagtgcacggtctgcga

SEQ ID NO: 10902 - DNA, 722 bp, Homo sapiens
  source 1..722: mol_type = unassigned DNA
cgcctcccgcagcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccggtgagccacgctccgaagagggccgcgggatggggggacccaagggaggttaggaggagggcggcctggacccagactccggcccccatagcgccccgctcgctccctaggcctggggccctgcacgcgccgtgagtgaacgc

SEQ ID NO: 10903 - DNA, 858 bp, Homo sapiens
  source 1..858: mol_type = unassigned DNA
cgcccgactcaggctccgagttctcccctcgaccctccccagcctaaaggctgtacccgcttcaggccttcccagcccggccctccagttccttcttcggcctccctcagcctggggtccgggtttcctcctcggctgagcagccgggtccgcgactcccttcaccctccccggcccgggcttccggttctttccagaggtgaggcaggggccacctagaattccgcggccccccacctcccccaagaccaccctcgccccagcttcctgttccccattctgtcctcccaacctgggttcccgattactgcctcgacttcaccttgccgtcagggaccaccagccgcctcttccgcgcctaggggacgcgcagcggcagcctctgctgatggcaagggtctgcgcacccggaaactccagggtctggggcgtggtgcggcccctgcggccagcgggctccgcttgagcttcagggctctttcgttgttggactacgtttcccacaggcctcagggccgcggatgaacttcgacctttgcttccttttccggtgttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtggttagtgctattgtttacgacgtcattgtggtgtgtgtgtgtgagagacggagaccctagtgtgtgccgtgggtgctgtttgatcggactcaggacggtgagtaggggcggggtctatcgtgtgaccctggtctacggtgacgtgatcgt

SEQ ID NO: 10904 - DNA, 598 bp, Homo sapiens
  source 1..598: mol_type = unassigned DNA
cggagacacggccacacgagtaaccccagcgacgctttctccgcgcgtgtccgctccggcatcccggacactcctaccttgacagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagcgccccggaggtttctgggagtgcccgcccgcccgcgctcagtgcgcaggcgtcagacgctcagggcctgcgagagcgagctgagtggtcccagggtctacccctggcaggagagagggtgggacccgccggccaggcaggtgcgggggaggagctggggccggtgcggggacccgccggaacctcgg

SEQ ID NO: 10905 - DNA, 1281 bp, Homo sapiens
  source 1..1281: mol_type = unassigned DNA
cgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccagggcccgcgcggccgcaggtgcggcgcgtgaacgtggtgctgagcggcctgctggagaagtgcttcccggccgagtgccggctgcgcaggctggcaggccaggcgcggagcctgcagcgccagcagcagccggaggccgcgctgctcaggtgcgaccaggccctggagctgggtgagtcggctgcggggcgggtccgcctcccctacacctgtccggcccagcagcggggtggggagctggccggtgggcccgaggctttgggctttcga

SEQ ID NO: 10906 - DNA, 1788 bp, Homo sapiens
  source 1..1788: mol_type = unassigned DNA
cgatgcagcccggagagagcaccgcccgcgcagcgacgcgcacagaccctcccttggagacgcgctccccggcgcgtgcggccgagcccgcgtgaaatgcacagaccctccggtgaggctctgcccacgtgtgaccctgagcactgcgaagcccttcccttccatcctcgcgtggccacccaaagtcttgcctacacctcgtacgtgcagatgccaattccatagaaatacatgatgtaaggacagaaatgggaacgactggaggctgatcttctcgtgaccacgtctcgccaacgcggtgcgcccatgcacacggcgagtaaacgcacacagccggtaaacagccatccccaccatgctcagcccacagtcacgcgtggggagaaggcagcggagagggcggcggtggcaggagaagtgggaagtcgcgcgcccgcgtgggctgctccctgacagcccggcgctgccccctccccctcccgggaacggcgcccacccgggggtcgcaggcccacgcgtcgggcgcgctcgggggggctccgcagcgccgagaacgggacaatgaggacgcggtgacaggctgggtttctgccgcggtagtggcggcggcggcagctggagctgcccgtgcagcccctgccgcggccacctccaccctcgcctccccggtccccacttacgttccgagggtctctttgaactcgaagatcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagagccccagcccctccgggagctggaaacggagcccagtctgggggcgccggggctttcccgtctccggcgggagggggcgcctctgcgtggctcggaagcgccgggcgggcgggggtgcgcggcggccggatgcggggcgccgagggcggggcgccttcccgcgctgtggcctgtggcccgggggacccgaggggcaaggcgtggggtggggggggtgggggccggttgttatggcgacgggcggcggcggcggctgggatggaggcggaggcgggcgggagctcattcgcattgcaccaaatcggtttcacgtcagtttcgggacagacccgcgaggagcaagccggggagcctctgggcgggtacgcgcaggacgcgccagcagctgcctcgtggtccctttgcgagcaaaactcccgggggtgtttggcagccgcgcgggcgccctggtgctgggctggagcggccggcgggcctggccgg

SEQ ID NO: 10907 - DNA, 626 bp, Homo sapiens
  source 1..626: mol_type = unassigned DNA
cgtgaggacctccccggcaccgcctcgcgcgggtccctgccccgtgcccaggcggaggcggggtggccactgtccttccttcccgctccgcgccctcggcggcttccccgcggccccctgcgccgcgccccctccaggaggcgtcctgaccccgcactccggcctttcacctcccgaccgtcagcctcagggccgccgcggcgacgcgcgaccccttccctctgaggggcgcgggctccggacgcgccgggctctgccaggcatctagtggagggtcggaggtcggcgaccagcccgagcccagccgtcccgggagctggcgcgagtgtcgccacgaccctccctgtcccttgcgctcgcgctgcccggccgccgggcggccgcctcagcccccttatatagccctctaaaaatagctcgcctcgcaccgccttgtaaggcagcagggagatccgcagcgtgccaatccgcgcccgccgccagggccaagccccgccccaggctctgctccgggctccccattggtcctcagtgacttcatgagccccctgtttaccttacatggtcacacgcggcctaatggacgccctcctcgagatcccacggctgcgcggagaaccgaacgg

SEQ ID NO: 10908 - DNA, 1037 bp, Homo sapiens
  source 1..1037: mol_type = unassigned DNA
cgggcctgacttccgcgtcccgctagcaacagtcccccttgatttggtccaaggtctcggctctgccgcccctaaaaccgtccgtaaggtccagccgcccgtcgggcttctccgctgccctccaagtttctcccaactacttgttccagaccgcgttacctgcaacctgctccgggctggcgccatactcggcgtcccggcgcttctcacaagtgccctcgcccatgaccagcgcctgcaggggcagctcggagcccgggtggggatagcagcgcagcccctggccgcagcgcggggtgtagacgccgcacgcctcgccctccagccgggcgcacaccgagcagcagccgcagcccggctcccggacgagctccgcgcatggcatgcgggcgcctccggccactgcggccaccgcggcgggcggcgcaaccggcgggggcccgcaggcggccaggcgctcgggtgtgcagggcgggcagcggaacagcacctccgcgcgcgccccgccgccgccgccactcgcgcccagtagcagcagcagcagcggcagcagcggcggcggcggcagcggcagcgcggggcagcccactctcggcagcatgctggcggtcggcagcgcggcgcggcgggcgagcgagcgagcgggcgggcgggcaggtggcacggccctgcgagcgcgggagccgcctcctccgcttcttcctcctccctcgccgccgcagccgggtcctaaagggccggcttctccccgccccctgccttctcccctcccccttttggagaccactcccttcccccccgacactccctcgcgccggcaagtgagtgcgcgcacgcccgctcgcccacctccgcgttggctgcgggctctgggggttccctgctcttcccgggccccgtccctccgcactcttctggcctgactatgactcctgaaggagaatacggataactcgcgggtttgggtaggaccggcgtggcggtggagaagagcgcgtgcttttgtctgctctcagttcagttcgcgaggacttcgt

SEQ ID NO: 10909 - DNA, 977 bp, Homo sapiens
  source 1..977: mol_type = unassigned DNA
cggccctggcgctaatccgccggtttctggttccctggccctgtcatctctggcggggttgtgggccggtttaagattataagagggtcccggcgggaatcctcggtggtgctcgagggatccaggcaggccggcgattcccctccaacacaccccctgaagctaccgagacgctctgcacctgccgcgcctccagagcctgtcgtccccaggcctcagccctgaggctgcggtgacacctactgggcacctcgggccttgcacgcctcgcaggccggccgcaggcagtcggctctgctgccactcctccctcccggccgctggctggccctcctgccttggaggcacagagggaccgggcgctgaaaggtgtagtcctgtctgtggagggatggatacccggagctgaagacagcacaggagagaggggacctccacctaccagtgaaggcgccgccagggcgcttgcctccatgcctcctccagatttgtgataccgccgtgcggtccagatccccgggggcggctgtatgctagggagggagcacttcagggccctctgttcctaagggagagggacagcaccctcccgggcttccagctcccttgggtgtggcgggagagttctgggcgaggctgcgcctacacctgcacctcggccggctcctccggctgatttcgctctggttgatttcgcgcacattcctctcccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgg

SEQ ID NO: 10910 - DNA, 6206 bp, Homo sapiens
  source 1..6206: mol_type = unassigned DNA
cgtcacgccacaccgagagaagcggagacgacactttcacccggtgggggcgggggcgaggctcccccagcgcggactcgggttcggggagtgcagggcgcactctctttgtgggtctccaagcgaaggcacagttcgggggccggggtggagggcgcgctctagcaggccgggcgcacgggcacctgcaggaggatcacctgtctgttttcggatgggtggcacttgttgatgtgccgcgtaaggccgggcgagctgtagaaggtggccgggcagtacttgcaggggaacacctgggcggcgtgcagcaggcgcaggtggcgctcctgagcgcccttgctggcgaacgactctccgcacactgggcacaggtggcactcggcggacgcactcaggcccagcacgccggccccctcgccgtcgccggccgcctcctggggcgccttctcgtcgggcccggggtacaaggccagtaggtcctcggccgggggcgctagcggcgcgcccttggcctgcagcgcctggtggtgcgccagcaggtgcttgcgtaggtaggcctggcggcggaacttcttggcgcagtgatggcactcgtagagcccgtcctcggagcccgactcggacacgccgccggggctcggcgtgtcccggtcgctgccgccgccgggtgcctcccgcgcctcagccctggctgctgcttctggctccggcgcgcgggcggcggcgggcgcgggccgcggtttgtgccagcggcggtgcgaggccaggttggccgggcagctgaagaccttggcgcactcgggacagcggtactccacacgcacgatgcgcgagcatttgtgctgcgccagcgcgaacgggtcggcgtactcctccttgcacagctggcagatgaactcgcccagcggccgcgccgcgccccccgcgcggccccgcggcgcctccaccgggccctccttgatcttgagccccagcacgggcgacgtggtcacctcgtcctcgaagtgcagcttgcggatggccttgggcttcttggcgcccggggccttgactgccttggcgggcggctccgcggcggtagggggcgggggccgctttcccgggggccgcagggcggcggcagggggcagtggggggccggggcccgggccgcgggccgcctcggcgccagccgagaacgccgtgcccatcttgagctcggcgggcgcgaagagcagcgggtcgccgccgcaggtgccgcctccgccagctccgctcgcgccgccgccgccgccccctccgagcagcgcggcgggcgtggggaaggactcggccgagaccggcgagcccaggttgaagctgcgttcgaagtacttgtgcttctcgtgctcgcggctcacgggccgcgtgggactgtagagcggcgcggggtgcgcagcctcggggttgccgaagtgcgcggcccgcgggccctgcgggggtggctgcggcccaggcgcgcaggcaagcgcggcggcgagcgctgcatgggcgcgctccgcgggcggcggcggcggcagcggcccggggaccgggctcggcgccgggggctcggcgcgggcgcccccgcagctgggcgagagcagcagtgcgcggtcgccgtcctcgccgccgcggacccggtaggaaacgggcgtggacttcttgctgcgcttcaccaggaagccgcggggcatgttggcgcggcccgagggcacggcactggctcggtcccccctccgcgctcggccccggcggccctcagtgcccccggcccattgcccgggcgcggcggctgcgggactcgcgtggcgccggcgacggctcggcccagctctgcgccctgcacgcgcgtccctgtccccgggcccggcagccgctcccttttaacggggggagggggccattgttctcgcctcccgcttcccctggagccaatcagcgcgtccgcagctcctcagcctggcagggtgggagggcgatggggcggccaaaagggggccgggactcgggggtcgcccggtaggtgcggcagatgtacctgagggcgcggggcccccgcgcgcgcccctggtcgccccgcccggcgccgccgccccgcccggtccaggcacacgcccggccccgcctcccttcacggtctgctgcttctctatggggaggcgcacgtgcctgggctttgtgtctctcctccggggggcgcggagccgccaaatgggcccgtccatcagcgcgacaatgcacgcccccctcccgcgcggggattacccgcgggtcgctagcaaaatagcaacaaaggagaagaatggccccaaatatgtcaggagggttcaatccgcgagccggagccgagggggaagttgtgcgcgctgattgggtgggggcgggggcgcgccggggcggtgcgggggagatcgttgcggaggcgcagtggctccgcgtggtgtttgggaaataaacaagaatccgagagagcagcagggtccggacggcctccgcccggaccttggacggatgggccgctggacccaagaggccaagcaaaagggttccccggggttccaagtgtggacagggggcccggccttctggcagtggccgagggcgatgtttgtgctcgcagcctccgcgcgcccacggggctagagaaggtttctttcgagtttgagaaggaattggcacggccttctcagtctcccgaaagcgcgggattggagcgcgggcgggctgggctgggttcccagaggaacgtgaatttctgaacttttgggttcttggaggcttgggaatggcatctttggcggggcccgacccaggccgcccggagcttccgcgtggtccaaggctcggttaatccgggtcgagttggccgaagcccgaaacgcgcggtcggcctcgtgcgccccagtgaagttggctttctcctccccgcgcggcctcatgcattttcattccgagcgggcattttgtttgccggttgacatcagatgctaaatcaagggctccaatcaaggcgctgcgaaataaaggggctgcctgtctgggcgcagcccccacggagccgtgcccccttcacctttgtgaaggaaattaacctcctgctattgagctccggtcgcggccaatctggacgcaaaagagacgcgtgctggacggggggagggggggcaatctgtactctgaggcaggctgaggcctccgagaggacaagccgcctcccctgtgccaccaggaagagacaacagcgaagattccccccgcccccacccccacccccacctccgctgccgttccgtttggacccagactgggccgcctgcctccatcctctgtccagcccagccccgaggaaacacaaaaggcagaatcttcgggggacagggcagagaaccccacgagtgcgtagtggccctgatcgtccaacactggggaacaaatagccaagccacataaaatgtcatatgctgtgaggaaaatgtcactttattgaaagagaaggaaacatttttctgcaaagctttgtataccagacagattttgctgagttttacttacgcttaattccactgaaggtatttaattgttttggattttccctctgaaaataccctggcgtagaaattaaacatgtaaaaatagagtccacatgagtcataagttgtgatggggacagttgttaggcttaattaattaaggggttaatcaggttggttaatcaagggaaagatatttgataattttatgtttgtaatattttaactcacacactgaaaagggaagaatgcatatagtgaaatatattttgaaaagtctcaccctagttttaaaaatgctgtggtgagtgctagtctccccaaaagttagaaatcttaaaatgagtttatctaaaatttataaacatatttctatctaaaagtaactgatgttatttccttgctcttttgagctctgattaatagtgctgatgaaattagaagtgggaaaaggattccgagacagctttggccaattttattttctaatcacgaatcccatctggattgtagaatagcatagggcgggggctcggcctgccccattcggtcttgcatatgtaacactccttccattcaacagataacagagagttagtcaccttgtgaatcctttaaaaataacaacacccataattgtaaataagccgtggggatgggaaaccggcacctctaccaacaaaaaaaacaaaacaactcctgcgtgagtgaattcaaacagggctctgaatttagccaagggaatctattaaacgctactgagatactgagattcaatgaatccgtttctttttctttatttgtggcttccagtcttgctagcgtaaatgaaatctgctttcagacgggtacagtcaaaataaatggaaacttgaaaggtactagtattggaaactaatttcaccacccggggctggaaggagttaggctgcgcacgcgcgcacgcacacaccagcgacctccaagcaggtgtagcccagcccgggccgtggatcgcagccgccttctgcgtgattttctcagaacctgtgcacccgcatgcatggggacatcgggtcgagatatttgtcttcgcctgggaagagcaaagcgccatcacagtgcgcccccgacgccggccttggcgcacgcgattcggagaatgggccgcgtgaagttaagttgggggaaacagcgcggatttgcccccctccaggggggcttcgcgaaagtcagtgaacataaggatccaaggcagagcacccaaggggccttccccggcttcaggtgactcctccccttccttcggggtcctggccagcgctttggaaaaatcccgggcctcttcactttcccttgcggaccccgcggtgggttcttcctccgacgactgcggagcccgaggccccaggccctccaatttctcctatcctggtgtgcggggatgccgtcggggagcgcgccggggttcactctgaccctcaccacggctggaaatcaaagtcaaggcaacagggagtttgtagaaagcgcgaagcttggaaataagagcagaagcggggaacttctgcggaggagttggctccttggggtgtctaggagaacaggaggccctggcctcacgggaggagccgggcgggcccgcattctcaccccgcagagggtatcgcgtttggagacgtcggcgttgggggtgaggtgtcagcgcccctcatcaccactctgctgcagacttctcttctggcttcacagaagcccccactcccggccctcagtcccccgagccacaaccggcaggaaccgtgcgttaccgctgcagtgcccgccgcccggagggaccagcgcctccctgcgccgggtgcgcccgacccgagccggtgagaggctttgtatttgcaggaatgaggggttgttgtgtcagtcccaggggcacgcgagagacacgcgcagcccgcctggccgccaccccgcccggcccggccccaggcaccttccgggcctcccgcccgcgggccgttgcctttgttcggcgcattagcataaagctgccagggatctcccgtttagataattccacacaaaaggagagtgcatgaaagagagcgaacaagggacgatccgcgaggctgcgtcgtgcgtcctcgcggggagggaccgcgctcaagtatttccctcccctcgagtttcaagtgccccctggcaatctgctgcgcgcccattattcggccgggggccgacggcgtggctggccacctcttttatccccccgagagtaccgtcggggccactgcacgctccttgaagtgccctcagggctgtttgtttttgcctcagtgggaccgtcgggccagggagggaggagagcgggtaggaaggcccgggcgggcggcgggaagggcgacgtcggcgaaagctggcagaggcgaagcccagaaggtgagaaagtcataaccaaagaattaggtcagggagagtcaggacggcacgggacccatcgggatgacattgaccttggggcgcaagaggtgtcctccacctgtgaggtgctggcggccgctagtccgtgcgcctcggtctcaaacggaactgacaaaacccagcgaaactgaccagaaaggctgcggcgaccccgatcctttccccttcctcccaccccactcacacctgcaccccgcctcgcctgccgcaggaggacga

SEQ ID NO: 10911 - DNA, 574 bp, Homo sapiens
  source 1..574: mol_type = unassigned DNA
cgccagcgccaacgaatgtggggacagttcgtctggcgcccgcggtcgcatccccatcgggcagttccgtacccctcctccgggcttccaagccgctcgccccggctgcgggagaccccggcgaatcacatccgagaggggggcgcgtggggcggagccttcctcccactgtcctcccgccaccagccgcccctgtcgccgagcccgcagtcgccagcgcgccccgagcccctccaggccagaggctcccgcaggcgatggcggacaagagggcggggaccccagaagccgcggcgcgcccgccgcccggccttgcccgggagggggacgcgcgcacggtccccgcggcccgggcccgagaagctggggggcgcgggtccctccaccccgcagcgggccccgggaccgccttcccttcccctgggcgcggggaagcggcctccacggcgactactccgagcctggaaaatggccgggtccgggacgaagccccagaaacctgtggtgcagaggggctagggactcgggcaggagccagcgagaaggccgaggacgcgaacaaggaggagggcgc

SEQ ID NO: 10912 - DNA, 3438 bp, Homo sapiens
  source 1..3438: mol_type = unassigned DNA
cgtgcttgtcccgccctggccgcctgaggccggagccatacatagtctgcacagatccgagacacccggtcccgagtgatctggaaacgagtgtgctctcactgcgttcaaacaagacgaggacatttacaaggtgcgagtccccaacccccagctactggcaggggctgcgcagcggcaccgcccaggctctctctccaggcggccgactcatttctgcggagagcacgcttctcgaagagggttgtagacgcgctcttccagcatttaatttgccaccccacaagattgagttaagttttagttaaaatacactcattttattaaaaataggcggcccaataccacgccgtaccccagcctctccgagggcgcaagagaatagagagttttcagattaattggaggcaaatattttaccttctaacatttaaaaataatctaggcgcgtctgcaccggtgtggctcacgcgacccctacgcgcgaggtcagtcgggctggtccagcgcagacagcggccgggactcactcacccagtgcgcgcctctcctgcctttcgctgcgcgcgcccaaagctagaaagaagaaggtgacgcgggaggcgggtcgggtctccgggtccagcgaattcgcgatctatccggtttcggcgcctgagccgaggtctcagaaagaacccgttaattctagccatcctggatctgggtagggagggtgcgcggctcccaagcccagtctggatgcctagtgcggtgtgcttcggtctccccgtctgccctccggggaggtttctcacccggtggccctgggccgcttcactgtggcgcttccacttttggctaccggccttcctccgcccaggaccttccggcccagggagcagccgacgggcacccccgaacgctggggcacggaatttcaacggggcgaccagagcggagctcgcggctcgaggctcgcggctgagtacgaagacgggacccgaggacctgtacatcgctcgaggggaacctgtcctgggctctggtgcacacatagtatgcgttctgggctggcttgggttgggccaggtaggggagacctggctgggtacgaggcgccgtccaagccttccggccgtgggccgggcggtcgcggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcga

SEQ ID NO: 10913 - DNA, 4088 bp, Homo sapiens
  source 1..4088: mol_type = unassigned DNA
cggcccggcctggcccgggacacgtctgctccgcgcacacacagtcagtcggtcctgcccgaaacgcaccaagtcgcgcccagcggcaaccgccctccctcctcccctcgccgcccccctcccgactccggcgccacgactcccttgcgccccctcccccccactgcaccacctttaccgctccgatcctttccgaggggctgatgtcaccagcccccccactctcctcggccacttctccccgccaaagcctccctttggcgaggccccctccgccaccacggcgccccccagcgtcaccccctcctctcctcgcccctttcttcccctctttccctctcccaacaaatctcacaccccacggaggcgggtccccctccctctacccgccacccggtttcctgtccccgaaaccctctttttgtcgcagtctccggagccccatgggctccccctccccctccccaacacgcacccaaacccctggcgtcgtgtaggcctcgcggaaaaagagagaaagagagaaagagggggagagcgagagcgagagcaagagagagacactgagcgggcaggccgggggagggggacccgcgcccgcgtcgccacggccccccgccccgtttttgagcccccgcccggccgaatccgcgcccctgggtcccccttccggcctcgccccccacagacagagcccgcgaacgggcggggggctcgggagcgcgcgcccggggcggggggcgggctcggcgcgcgcggcctgcggggcgcccttcgagggcccccgggccggggccggcgccccccgcccgcccttacccagcagcagcaggcggtgcgtggcccggtagacctgcttgtccttctgcagctgcttctcgatctttttgttggcctcacgctgcgccttctcctcgttgcgctggtcctcggtcttactgttcccgaggcagcccatggcggcggcggcggcggcggggcgcggccgggctgcggcggcggcgggcgcgggcggcctcacgcgggccgggagggccggggcagcgccgggcgggcgggccgggcgcgggctcggctcctcggcaaggagcgcgcggggcggactgcgggccgcgggccgcggggcgcgcggacgggcgggaaggggagggtgtcggtcggaccgaggggcgcgcgcagctccccgcccctcgagccgaggccgagggggctgatggccgccgccgggccgaggcggaccagagcaggagctgcgggagctgctgccgccgctgccgccgccgccgctcttattgcctcggccgggcccccgccgccgccccgagccaaaagcgccgcggcgggcggggggaggcggggggaggaggaggcggcggcggcgaggggggtggaaggaggaggaggaggaggagggccgaggagcggccgcggcggcggcggcggctgggagggcgggagccggcggagggaggcggccccccgggagcccggggagggggtccctccgcccgcgcccggccggggacgggacgggccggggagacgccccccaccccccgggctcgggcagcagcccggctgagccgaggggggagagggggcgtctccgcgccagtgacgacccctcgcacgacgccaacgctccaccccccggaccgcgtcgcccggcgcccccgaggcctcctccccctcccgcgggcgccgccgaggggctggggtgggcggaaggggagggagcgcgcgcccggacttaggaaaattttcgaaagagcgagagacacagagagccagagagcaggagtgtggaaaaagcgaggcgagcacgaaccaaaggacagagcaaccgaaaaggaaaatgtgtccacacacacacacgaacacgaataaaaacccacactacacagcgatggtggtgtctggtggcggtggcggggtggggggtctgactagatgagccgctcctcgcgcccccggcgccgggcgccatggcccgagccgaaggcgcctctggccccggagcgcccgcggcctctgcgcttggcgcggccgcccaagtaggagaagaaggcgcagcccaggaacactcggaagcagcaggtcgccccgaacacgaagccgcagccgcggccctgctccgtgcgcttctgcagcaggaagttgagcacccacgaggggctgcgcaccgagaagaccaggaacaccacgaggggcaggtgggcgctcagcgcgccagccttgagcggcccgggccgccacacgatgcccccaacgcgcggcgccgcgtagtaggcgtcgtcctcgtcgctcgagtccgtgtcccagtcagcccaggccctactcgtgcccccggcggcggcgccctcctcggcgcccccgacggcgccctcctcggcgccctcgtcgtcgtcggcggcggccgcggcggcggcggcctcggggcatcgggcctcctcctgggcttctggcaccttcttcttcttcttcttcagcatcttctccatcttcttcctctccttctccttcttcttctcctcctttcgcctctgctccagcagcttcttctcgagcttcttgcgctccttgtctgttaggaacttttcggggagcgcctcccgcgccgggttcttggggttcttcgcgagcttctcggggtccccgctcttccgcggcgcgagcggctctctcggctcggccaacgccgcagccgccgccgcagcttcggcagccacctcggcagccgccgcggccgtcttcttctcgctctccgccgcccgggctttgagcttcatggccatcttcagcatggtggcccggccacctcggggagctcggctcgcgcctggcccgggctccctgcttgcccccggcctcgggctgcccggcccccgtgcgccccgtgtcggggggcttggctgcggttcccgccgcgctgccccggggccgcggagcgcggctgcccgggcttcgggctgctgggctggctgcctaagagttagcgccaaaaaggatgagcaaacgaaaaagggacaagaacaaaccaaaaagcacccaacaacagcgagaaaccaaaaagcaccaagaaatgtcaactcaaaaagaaaagtgcaaaggcgcggatggcaggagtctgtttaccctcaggcgctccttggtttggctcttgggcacgccaatggagaagagaaaagagagagaattggggggtgcccggaggcgccccggggcaaggcagcggcgcccgggcgcccctgccttgtcccggacccggcggctcttgcctgcgccgggcgactcgcacttccgcgggaggccccggcgctccccgacttacatgtgagtgaggtgcactcacacgcaaggcagcgcctgccggccgcccgccgccgccccgcgccgggacaggggctcgctccagccgccgcgccgcagcccggagccagagagcaggggagcgccgcgccggccagccacctgacgcagcccgctccgcggtgccgacgcgactgagtgtccccgccggggagcagagcttctaaccggccccgatgacgccccagcctcttcagaggaccgacccatagcagcggcccctataaaccgaaggggaagcgcgaaaaatcggcccaccggggacgcacccaaatgggccgccgcgcaccctgggggtgcaggccggtgccgggaccgcgcgggcgtgggccgggggcgcgggggccgcgatggcggggggcgcgggcgcgcccaaggcggtgggcgctcaaccccgcctcccagacctgcctcccaattttcggtgagtggtgtagccctgggcggcgtgcaaagtgtgcgacggcggcgcttacccctgctgtgcgcctccttacctccagccacccaccccgccctcccagcggcgcgcgcccgccgaggtaggtgtcagagagccgaattcgaattatttgcgacgcccggacggagtttcgtatcttcggacgagaaaagtgcgatgggagtgcaaagcctcccctgctcgaagcagcaggcgcgccggtgtcacgggagccgaggagcggtggccgtggctgtggagtcggtgctcgaggcgt

SEQ ID NO: 10914 - DNA, 522 bp, Homo sapiens
  source 1..522: mol_type = unassigned DNA
cgatacagcccccggcgcgccgggcactgaggccctggagcacagcgtggggggcctggcacagacacgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccgg

SEQ ID NO: 10915 - DNA, 2260 bp, Homo sapiens
  source 1..2260: mol_type = unassigned DNA
cggcatccgggccgaagcgcctggtccgcgtttccgcgcgggctcccctggaaccgtcccgggacacgcggccctctcgctgctggacttttccccgagccccagcttgccaggcagggactccctgggcgggcggcggggaagcgccgagtcggcggccgcccacacccctctccacgcagcacaaaggacactcgccggcaaactttcctcgcttctgacccgggccgagccgggaactcagcgccagctctgttcctggcggggctgaggcttccctcacattccaggccacctggcaaacgtcctgaggctgccactccttctgggctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggagctcaaggctcacgggctgaggtctgtccccgcgtggaccgccgagagttcggtagatccttcccaaggctctgacttcaatactttcagtgccttgtcaattataccccttgcccctttctcttaccaaggccaccgccaagacaccctttttctttcctctccccgtcgcccgccaccttccttgccctcctcttggccctctttccagctccctgggccccctttccgcgctgctctccagccccagctgccttccccggttcacatcccggcagccctcctccctccccgtccccgggcacctccctcccctggtcggcccctgaaatccagcaggctcggctccggtcactgcctttttttgcctgtttctatctggcctgccttcccaactatcgctctcccacacctttttttttttttttttggcaagggggacggggggaaacggggcactatattctcgtttcccgacttcgtcattttccccagctccgtgagccgcgccccctcgtccccctcaggcccgcgatcttaccctgaggttccccagaccccgtagggtctcccacgccaccaagtttgcctcgacttcccctcgctgcctcccacacctcctgccgcggcgcggccggccagggacttaccccgaggcccagctggtgggggtgttggggtgcgcgcggacccggcacccacggcggcggcggcggcagcagcagcaggaggaggagaaagacgaggaggaggaggaggactagctgagcggcgcctccttcccagcccgcagcgcgcactggctccttggggcacccccgggagagcaccaagaccggagactaggcggcgacacaggcaaccgctgctgcacggggctgggctcagtcggctctcagaggccagggcagggggaggcaggactgggaaggagggtcggagaagtggggtgcagagggcggggcagcgagcggccaggtccggaggaaggcgccccaggcgcctagggatgccgccgcccgggctgacgccgtcggcccctctccccgccaggcgggcgcttgcagccgcgggcgcacgggcctcgcctcgttcaccggctcgttgccggcgcccgcggtgcgccccgctttgtgctccccgcagccggcgtgcacctggtgtaagcaaaggcggtcagctgatgggccgcgcgcggattggctgctccgccgtctcctcccctcccgcccgaccctcttcgcggcctcccgcccccgccctcggcgcggccccgtgctgggcaccatctgtggaccgcccaacaaaggcgcagcgcggcggggctcgggtggccgggccgcggtcgccgctttttgtctaggggacggcaggctgcggctgggcagggaggcgaagcgcactgccggtttttagcaaaagacagaccaaaagaaaatacacgtccgtgctaggaggccagctaggcacaatggggccccatctctttgcggcgtagaactcgggctcgggggctgagaaccagacacagttcggcctggggctgtgggagccaagtttcggggtgaaatccgaccctgcgtcttaaaatacagggcgcgtcctcgggctgtgtgtgcgcgcccgggggcgtcctccgcagacctggcccgggccggtgtccctgccgcgggaaggaggattcggacgcttaactcagcggcgaagtcgcttcccattggaggaggctttccgaaaacgt

SEQ ID NO: 10916 - DNA, 1502 bp, Homo sapiens
  source 1..1502: mol_type = unassigned DNA
cgacggtgagcgtggagcagcccgcggtctcgctgcccccttcactcccggacccccagcctccccagagtggaggggcaagcacacagtaagtacttgatattcgcccgactcctgagctcctcatctgtaggagctagggggcttgttctccgtacgtcctttgttggagggaggaacgagggaaggagaaaacccacgctgaggccgttggccgatcactttctttacctcccggacaacattgatgggccccactaaggaaagccgaattctcgcatgcccgaggagtgtcggaggtggttgtgcgcctagtccctcctggtaaagggttcgaagcactcgtttattcaaaggcggccgagagccataccatttgcttgcatgacgggagacaccgaaacgccccttttgaacgcgatgacaaacacctcctcccactcagcagcgacgtgcacgtgacagtttttgggctctcgcaactacgtggaaacttggaataggtctgcggctgcacaccgcccggacgccggggttcctgcgtcccccgccccctctgatcgcggctgggtagccgagccgcaggcagctgggggcccccgaacgccgcctctgcatcgcgccgcccctgccccgggctccggtagctttcgggcttccgcactgcccgccgcgccctgcccacagggaagcgcttccccaggcggcggcggtcctggtgcggaccctccggccgcagccatgtgggacccgcgggcagctaggtgcgtagcggcgcgggaagcactggggcatctctggccttccgggcccgccacccttcctggcgggaggcggccgcgcgcggggactggcgaccctgaggtagcggccgaacgggcccgcccggccatccctgtggggcccacagccatctaggtgcagacccgagccagttgcgcggggtcggtcgcgggggacggcttcggccttttcggtccggagggaccagggcacgcgctgcgacaggactgcggcggcgcgcggcctgcctagctcccaccccggcatcgaagccgcagctctcgggcccacctccgcatcctcaggggttcccgggggctgccgacaggttcctgaccagcgagcgcgcccccggggcaagcattcttggcgggcagaaacctgggagcggagcacagcggtgcaagggaaccgtgccaggcgggaagggcggaatttgcggggaacttggagcgcgctggcctcttcccggcagtaggaggccttcttccctgcccgcccgattgagggctgctgggctggctcaaactggactgcacggtccatcagcctgggctcaccgagtctagggggaaggtagtagtagggacccaaggctgggaagcggagcccttagaagcccttgcttctgcctcggagcgtttccgaaccggagctcggagtctgttgcctgggaggcgcgttgcgtttcctcccaactccctgtctccgtcccgcgg

SEQ ID NO: 10917 - DNA, 510 bp, Homo sapiens
  source 1..510: mol_type = unassigned DNA
cgtcccttgtcgggagtcactcgtcagcttctcttctcagcccggctgcgcagcgctctcaacccaacccctggactcatcttcgccccagcctccttcgtgcccagcgtcccttgtaaatgacccccccggccgggtgccccgctttctctctcggcctcttccgcgtggtctgctctccgcccgcctgcgctcgcccggcctccctgcctctgcgccttcacctgaccgcaaaggcggccagggcagcctccgcgcggcctgacagtcacggctcccagtttgtccctggacgtgggaaactcgggctcatagcgcctctacgtacactgcggcacagactggcgtttcctacggcgccttcactggaaagcgcccctgtggtcctggggagagggcggctccatccgccacccttcccggagctgcccccgcccattctcatgggaggaaatcgcagggcgtgtgagcccccgacccctcgcccccacctcttccaggaccggccgc

SEQ ID NO: 10918 - DNA, 940 bp, Homo sapiens
  source 1..940: mol_type = unassigned DNA
cgggcaactgcccgggccttgcccacccctcccgcgggccgcacctgccaaggccgcaccgccagcgccccctgccgccctctctgcacagagacccgcgcccacccccgcacccgcacccgcacccgcacctgcccccaccccgcgctcgccccgcgccgaggccgcgcagcctgcgggcagtggcgggggcacgaggatgcgaatccaggcggggccgggagctgggcgcgtcccccagaacccccgccacggccaggcctgagcctcacctacctacgccgtatttctcctcctccgtgggggtccacatggccgtgccgggcgcggccccgcgggcgcggcgaccgggcgacaacgcggcggggacggccgcgggcccggctgtggcgcaccgcgagtcgaggcggggacggtcaggcggcgcggggcagtgggcggcgcatccctcacaggccgtccgggatgccgccgccacccccgccacgtctggaccgcgaggctccgcgggtggcccagcagcccctggcggcgcgggcgaaggctcgccacctgtccgtcgccgctgctcccgtgccgccgcttgcttcttcacagctccgccgcccggctcccggcgccgccgcggctcggctcgccccagcgggctcgcaggacgcccgcgcatgcgccactccctgccgcgcaggggctcgcgctgcccgggctcgcgccgtcccgagcccgcgcgcgaatccacgcgccgctgctgcgcgccagcggagggaaatccgcgagaagctattggactgcccggccccggaccggcttctagaatcgctggtccggggccctcagctgcagcaaaccccggagggggcgaagccggtcaggtgggcgactccctctacccggactccccactcgcttccgcttccagtgcctcctgcctgcgccccga

SEQ ID NO: 10919 - DNA, 2718 bp, Homo sapiens
  source 1..2718: mol_type = unassigned DNA
cgtccgggccgccccttctgcccagccccgagcgcggagctgtccaggattcccagacgggtgcgagtcactgcctgaagccccttctcctccgtcggaagaggatgtgcttaaaggatcgccggaaatcctggttgaagaccgtgtagatgaccgggttgagcgagctgttgcagtagccgatccagaagaagaacttgaagagcgggccgggcacctggcaggcctcgcggcagatgccgtacaggctgtagctgaagaagaaggggaaccagcagagcacgaacacgcccatgaccacagccagcacaaaggtgaagcgcttctcgcgcgcctgggccaccttgcggcggcacacgctgctgcgcgcccggcgccggcgcgacaggaagaactcgacggagcgcgagctggcgcgcgacaggcggccaccgggccccggggacctggaggcggtcagcgcccccgactcagccgcccccggccccgccccctgcccgtccgcaccgcccgcgcccccctccgcgcccgctcgccgccgcccgccccgccgcaacgcgccccggcgccgccgcctctcggccgctgcgctgctctcgtccggctccacgtcggcgggcgggggcgcgcagtgcccgttctcgcctgcgcctgccgccgcgcccagcccgttttcggtagtcggggacgcaccgtcggggcccacgggggcgcgcttctcgctgagcgtgcgcgtgcgcagcttggccactcggtagatgcgcgcgtagaccaggcccatgatgaggcagggcgcgaagaaggagccgatgcaggaggacaggatgtaccaggtctcgtcgttgaggccgcactgcgggtaggcggcgccgtcgggctggcggtagagcgagaccagcggcgggaaggagatgacggccgagatgagccacacggccacgatggtggccttgacgcggcgtggtgtgcgcttcaggttgtactcgacggcctgcgtcaccgaccagtagcggtccaggctgatggcacacagatgcacgatcgacgaggtgcaaaacagcacatcgagcgccaggtacacgccgcaccacacctgcccgaagtaccagtaggccatgagctcgttggccaacgagaagggcatgaccagcgtggccaccaggatgtcggccgaggccagcgacaccaggaagaggttctgtggcgcgcgcagcgcccggctggtcagcacggcgatcaccaccagcacgttgcccaccacggtgaagacgatgaggaagcccaccacggcagccagccctgccaccgcgcccgccgagtactggccgcgcggcggcccccaggaagcccccgaggcattggcaaccccgccgctgcccctctcgcccgcgccgctcgcattggggcccgccgctgccgccaccgccagcgccgccgccagcgccggggacgccatggtcctcccgcgagctacgccgtccctcctggagccggggcgcagccgcggcagctcgggcgccccccagccggggtcggcgcccgcatcgccgcctgctgctcgggcgcgcccgccggggaccgcggcgcccagcagccggccctcggccgtggtggctccgcgggcggcgcgccggagagcgtggctgccgggctccccgcagctgccgagcgtgtaagtgcagagcaggaggcgcccggagcgagcggcgacgcggctgcggggggaggggggcaggtcccggggtcctcgcgcggccccgccctcggcccggctcacggggagcgccccggcgtcgagcccacggcgacgcggcgcccgagcgggcgtgcctgagcggccccgcggtcccggagcccagccggggcgcaggcgacaggcggcggcggcccgggcgctccgcctcccatccggccggctagggctcggcgcgccggggcgccggccgccgctcctccgggcccccgcgcccgcgcgctccctccgtctccaactttactttcccgggcggggcgccggcgccgccgcgagtcctccggctgctcccgggcgcgggcgccccccgcggtccacgcttggccgtgcggccgccgcctcgctcgccggagctgcgccgccgccgccgccgccgccctgcgctgggcgcgagtgcggccgcctgcgatcggcttccaacttgggtcgagttgcgcagcggggcgggcgcgcggggcggggcgggccgcgggccctggggagctggccgggaaccggagcccgcggccgcctggtcgaacctgcccgcgcggcgccggggaggagtccggggcggcggcgcggggcgcgcgctcggcgagggcgccccctccagggccgcctgcagcctgcgggacggggccgagcggcggccggcctgggtggtgagttccagaagctgctctttctaagactggagcctccttcgcctcccccggcgcaggcatgggcgcaggcgggggcgcgcacacgcgcgcgcgcagcacgggcggctcggggtccatggcctgatggcagagcaacctctcgcagcctgggggaggacgcgacgctacctgcgtgcgcacaggtcctgccgagctcagggtccggaccagatcctggatcggcgctccccgtcagagccacctccgcacccaccccggcctcagttccctcggcccacttcccagcgctgctggagcatgaatcataactaacggcgg

SEQ ID NO: 10920 - DNA, 2661 bp, Homo sapiens
  source 1..2661: mol_type = unassigned DNA
cgcgggcaaagcgtgcctttcggtgggttataagcagcgcccggtccttccttctctcgccaagttgcctgatccttccctccaggcgcgcgcgcacacaccacactcacacaccccaaaaccaagactcgtcctacaggatctgggaaaagaaaaagaaaaaaaagccctcaatcaccacctccttctcgccgactccccctcaccccccgcctcccctccagcgggcagccaaggagagctagaggcgggggaggggagagggaggagaagcgacgcaagtgggtagcttttcagcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtgagcgggccgctgccccagttccgagaggcgtggcgggtccctgggaaactcagagagggaggaagggaacgaaggcgcccggccgcccggctgagggtcccgagtagatccctcgtttgttttggggtgtgtgcgtagctgggcccccggtccgcagtgtgtgtgtgtgtgtgtgtgtgtgtgtgtgtgtgtgtgtgtgtaggatgggaggtagaggggcagggtaacttattccaaatggatcagtttagggggttcggtggctgaacggttggttcgcgggcaggaacccacaatgtttcgccttcggtctttttgttgggctgaggggtgccgtgctttaaagcgagtagggctgaataacgctactgataaattcttccgtgggacggaaaacaaagtgcacacgctatctcttggtagatgtctctgcaaaagtgcgttaaaccaccaaaggcttaggtggagacgagcagagccacaggcgggaggaaggggaggcgggcgtgggctggggcaggcggggccgtccctaccaccggtgagccgggccgcggggagcaggccggccgatggggcgcgcacccgggctgcgggggcggtgcggggttcagtccctgcggccccagcgcctgggctagcagctgggagctgtgggtgcgccgagccgacccaccgcaagggtacaccctggctgtaccgcccccaactctagttttctccaaccgccatcacttggaaacaaacccacaacttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtgctggctagagaaagcgcggagcagggccgcgc

SEQ ID NO: 10921 - DNA, 801 bp, Homo sapiens
  source 1..801: mol_type = unassigned DNA
cggttattaagcggctcccccgtgagccccgcccaatgcctgtgcgctcaaactagcagcgtccgaggaacgcgttaactgggagaagtgaactgagggggtccggcggccgctgaggaggggagcgcgcgggaggaggggcgaggagcccggaggcgggcgcggctggcagcttagagggcccgggcggaggcctgagagcagggctggaggggcggaggaccggggagacccgcccgcggcgttcccggccggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggaggtaactgcccgcggattccttaccccgcgatcctggcctcctcgtaagctccccggacccgggcgtcctcggtctcccctcatctactcttctgtcgggcaggtccgcgaccttccgcctcccgggccgtctcccgccgcacccggccctggtacatccccactacccagtccgggcccgtcctcgctctgggcctaccccagcctcccagcgtcgcctgctgacggagcgcgggagccccaaggggccggggtcacccggccggcgtgggtggtgccaggctcgggccacacctcggcaccggacccgagtcccccagcttctcgagcaggatccggaggaatagaacgtcaattttcctcgc

SEQ ID NO: 10922 - DNA, 311 bp, Homo sapiens
  source 1..311: mol_type = unassigned DNA
cggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgggaaacgttccgttgggcgctaagaacggtgcagcaactgaaaaaccgctcagtgggcgctactggcaaaagcgttgctgcaaaaccgccagctccgcattagaagcagagccgccagacagaacccgggacctgaaaccaccgaagcggagaccga

SEQ ID NO: 10923 - DNA, 1048 bp, Homo sapiens
  source 1..1048: mol_type = unassigned DNA
cgtcctcgcaaatctcccgggctccacgccctgcggctatcacgcctgacagagaaacaaccagcaccagcggctgacccggctgcccgggccctcgtgcaggcgggcgggagcggacaggccctggcacgcatgcgctcggggcgggactgcgccttaggcctgcgcgttgccgctagaccagcgggggggcggggcggcggcggacacgcgcctcaggcggcagccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggaggtgagtgccggcccgggggcggcgggcggtggtcgctgcatcccgcgtaggcggcgggactagggttcccggccccggctctggccctggctctcccgcgctgcccggccgacagccccagccagggtcgaggcttccgtcgtggacagcccggcctgctcccgt

SEQ ID NO: 10924 - DNA, 301 bp, Homo sapiens
  source 1..301: mol_type = unassigned DNA
cgggaagcagcaggcgcacggccgtctggatctccctggaggtgatggtcgagcgcttgttgtaatgcgccaggcgggaagcctcgccggcgatgcgctcgaagatgtcgttgacaaaggaattcatgatccccatggctttagaggagatgccggtgtcggggtggacctgtttcagcaccttgtacacgtatacggagtagctctccttgcggctgcgcttgcgcttcttgccgtccttcttctgcgccttggtcacggccttcttggagcccttcttcggggcgggagcggatttcgc

SEQ ID NO: 10925 - DNA, 1395 bp, Homo sapiens
  source 1..1395: mol_type = unassigned DNA
cggccctgtgaggcccacgcgggagcgcggaggctcctgggtctcagggcgccggcagatggcctgcagcgcaccgcccggcccccgcgctggccacgtccgccagcgtcatctctctcccccgcctcctacccctaaaaatccggcggtcgagtagctccgcatcccggagggctcccggtgcaaaactgagtgggaaagagaaaggggcggagagcgacgagagagggaaggtggggaagaagagcccggccgcccccggccttttccggcgagctctgagtttccagggctcatccgcccctccaagtcgaattacagaaactcctcattgccatgctaatgacgagaggggctgtggggagagggtttcgaagaccctcctggaagaagggaagtttcttttcttgccctcgtctccttcacgcccacccgagttcctcccagccagccctctgcgctcttccccctccattccgagcttgaagagccggtggcccagcctcgccctccaccacggttctatgcgctcctcacagccccacggtctcccagcccagcctcagaacagaggaggtggcctgggaacccggggcgcggtgtcagccggattccccgccttccggctgggcgcgctgcgggctgggccggcgtacttgcggccacccggcgagctctggcccactgattcccgccccgagagagccgggagccctcttcccttctcacctctcgccagttcatctttcattgaacggtggggagggggcgggagcgggggacgcctcccagcccccacctcccggaggcctggcggggcgggcagcggagtcgggcgcgcgcagaacgcagcttttgctcttcttcgctccagcactccaaatcggcctttgcagtcgccgcagcagctgccgccgcctaggctgcctgggggggcgactgcgcgtcacctagacggcggagcgccggggatttaaatgccactaaaacggtgatccatcactgcggaagccggcaaacttttgcaggaggctcagccattggctgacaccgtcacgtgcccctcctccagcgtcctccgccctcccgccccccctcttgcgcactgtacattcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgc

SEQ ID NO: 10926 - DNA, 766 bp, Homo sapiens
  source 1..766: mol_type = unassigned DNA
cgaccccgtcttatgtcggtcgcaccgtgtccctcccaggctccactagcacctgggctgctatggtgagatcaagatgggccccgcccacaactaacgatgttattccgcagcgagtcaaagccactccctaccctgggcccgctacgcgacctctgccggcctccgccccacgcggttttagtacggcgccaaggccccgcccacaaatcggccccgtcccctcgtgtccgggcccgccgctcatcagacgccgttccggcgcagcgagttgagggcacgcctaccctccctccgggtccccagtcctcaaggtcccagcacaatgccccaggaggaagactccaggccccttcctcacccgacgctgtttctgggcgagccgaggccccgcccacccgccggcccggctcccgctctcacctgacgctgttcttgtgcagcgagtctaggcccgcgcccgcagccgtgccaccctcggagctcgccttcttgtccaggttctggaagcgctcgcgggccgtcaagccacgctgcgagctctgcttaggaacgtccagccgcccgccgaagctcagcatccccgcggcggcgtcataggtgaacagcaccgggaagcagtcgtggccctgcgcggagggcgggggccattggagcgccgcggaggggaaaccgaggccggagggaaggccaggcgggcgtctggccgcccgggaggcagatgccagctcaaggatacagacgggccacagcgagggaggcccga

SEQ ID NO: 10927 - DNA, 691 bp, Homo sapiens
  source 1..691: mol_type = unassigned DNA
cggcgaccagcccccgcagaggcggggtccgagtccccagccagagccccaacaagcagtcgaagaacgcgggcagaggctccgacatggccaggagagcacgccgccgcccgtaggtgctcgggcctcgccgagaccgggaagaggtggcgccgccagcttttcccagacccaggggtggcccgacaggcctaaccccgctccccgccctgctcccccgtcccctcctccggcgacgcccggcccgcggttggccggcccgccgcgcgctccgggacgagggcgggaggcgagcgcgctggccgccgcgcactcaccattgtcaacgccgccgccgcgtcccccctactccactcctcttccctcaggagaactcccagccccggctccctccgctccggcgctccgtcacgtgacctcgggccgcccctcacacgtgaccgctcccttcctctcccccacccccgcacccgtccctctcccagcctcctgccccgccctgctggccgccaggcactccggggagaggccgcttggaggcggggcctcaggctccacccttcggagggtggagaggggcgggcaaattacgtcgagtgggcggggcctgaacagaggcgggttcgcgggctcctcctcgccgtctcttcggtcaccggacgagcggttccgtgtccggcctctttaccgc

SEQ ID NO: 10928 - DNA, 1024 bp, Homo sapiens
  source 1..1024: mol_type = unassigned DNA
cgcgcactcaccctgggctgtggagcccagctggccgccgcccgcctcggccacgcgctgcggccccacgggcccgggagcgagggcttcgcccgcgccggacatgggccgctccgccgagcccgcgccgcgccgctgccgcctagctcgccgcccggcagggcgcacggaggaagggctgtgaggtgctgggtgcagggaactgactgcttctggcggaaaaatatacaaaattaaaaaaaaaaatgtttttagagaagagcacaccacccctgcgggacgttccctccccctccacttccctccctcaaactccaccccggggaagttttgatttgaaacttgcgaagaaaactgttacagcgcaagttgacagcggcggggtcccaggggtccgaggtggacccagcggggaggggctggaaagagagatcgggtttgggagaaccccggggatggggatcaaacccctcctcttccccgcccggagaccactacctacctccgcatccccccgtagtcgctccaagccccttcctcctcctcctcctcctcttccgccccggaaagttagcgagcctccggcagcggccgcattttcgccccggtggcctgacgacggcggcggccgcccctgcgcgtcctcccgcctccctccggctcagcccagacgccgcagtggcggcaactgcggcagcggtggcggctctgactccgcgcactccgccccctctttccagccagctcactccagccggctcccctgcgagggggccttccccctctctgcctctctttcccctcttccactcctacaatcctgaaacacttctccctctgttgctctttttcatcacatccggatcgggaaggcctcgaactcttggctagcggccccgatgctgggagcggcgcgacccgggctcggccgcgcgatccctcgcgccctgcgctgtctgggtcaggaggccagagccggcctgggctggctcgggctccccacccgggcgctgcgccctcccgg

SEQ ID NO: 10929 - DNA, 1339 bp, Homo sapiens
  source 1..1339: mol_type = unassigned DNA
cgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaaggtacgagcggggaatcagagcacagggtgcggaccagaaagagcagacggtcagtcgggcggggaaggaagttgccgagttgcaggtgtggaaggggctgccccaggcccacccttggcagacgagggggcggggagtcgcgccggggacgaggagactgcggaccgggcgcgctccttgcgcagtcgctcgcccgcgtgcccaagccccccgggaatggccctcgcccaggggcccagctcgccgccgctagccccgcagagcctgcagctgctggggcccggcagccgccagggggcgggagctgcgtcgcgaacaatggccgcgcttggtcgcgggccggcgggaggcggagtggaggtagagccggtgccgggcgcgcgcgccggccgggcgtgctggggcgcgggagcggctgcgcaggcgggggcgcgcggcgcgagcgcgggagggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaaggtaaataccctcatcgggggcgtccgggagaccccgacttccgcgccgccggcgaagaaggcagagggcgctggggagccctgcagttccgcagcacggggaacccggagaaaagcagcccccttcgcggcctcccctcccccgcgccttccctcccacatcgggctctcggggcagcagcggggaggggagaccggcgggggagggaggacagggaggcgaaggaattggggtggggggtgcgtgtgtggtggagggggtgggacgacacaggtgtcctgaggggaggagccgggaggaaggcgaggaggccgggccaagtgggggtgcggaggtcggggagacaggaacgcggctgcgggcgcgggaggctggggttctagggggccggggtggtagcggccggaagagaggacggcgagtgcagccacggtgtggctgcgagggagagggagcgcctagagtagggcaggggagggcggcccggggagggtctgcgggaaatgggcctgggggcgctggaggcgg

SEQ ID NO: 10930 - DNA, 2273 bp, Homo sapiens
  source 1..2273: mol_type = unassigned DNA
cggcctccagggaccgaggggtccgcagagtgacccatcccatccccgggaagctgccgggagccccgcggacccgccgcggcctccagcctctatgtgcaggggcctcggggttggggcttggccagtgcgacgccccgcccgcggccacctacagttgttgaggaacagcagcaccgcgaagccgagcgtggcggtggccagcaggatcaggcaggcgttgcagggcaccatgaagcctcgcaccagcagggaggcgccaggcggctgccgggtgtcccgcgccagcggcagcggaggcatggcccggggctccggctctgcgccccactctcagagcgtgggggctcctcacggggtgcccttgggcctcttcagggctgctcgccccatcctgggacccctggggcggcggacagcagctgtgccctcagagttcacccagtcacagccctgggggtgccaggtcccggctccagtcctccaggctcatcgtgggaggagggcagaattctcccggagtagaaatcccaaatgtgggctccgaggtaggcggaggagggactgggagcccgcagccacccctgctgcccacagcctccccgggctggccgccagcgctcggtcttcccggagcccccggagccgcgcaggccggagaggcggtgcgcgcggcaggtgcgcgggggccgggcgccgagggtctgctgtccccgtccccggcagaggcggaagcggcgataggagcgggcaggcaggaggggcggccgcgtcgggagcgagaagaaagcgccgcctgcggaggccgcgccgggtcccgggctccctccagctcccctcgtccccgcggggctggggaggtgagtgaggggcgaagacgccgcggagggagggcgggagcagagacaaaggaagccgcctccagggaccccggcgtccgcggggagttccagaggatcgggcggatgcggacgggagagcgccgcacaaaagggaacgccgggcaggcggggccgggggtgctcggctggggctggggctggggctgggcccggggccgggagcgctggggctggggctgggccgggactggggctggggtggctgaggctggggccgagggtgggcctgaaggtgttgggactgggggtgggactggggctgggcctgggggcgctgaggctgaagctggggccgggggtgggactgggggcgctggggctgggccgggggtgggactgaggctgcgggcgttcaactgggattgagtcgagggcagcggtggggctgggccgggggagcaggggtcgcgccgggcagcgtcgcgtgctggagcggaggcgggtgcggccggggcaggtcgcgggaggaggaagcgcctggggagcaggagctgggccgggcgggtccgcgccccgcacccgcgggggtgaatcggagtcgccgcagggggctcggggggccgcgtgcgaccgcgtgtgcgcgtcgtcgtgcgtgtgcccgcgagtgtctgcgcccgcggccccgccctggcggggcgtaggtgggggagggccccaggtgcggcgcgagctggagggtggagtgaggtgagcggcccagaaatcgcctcgcccactttcccctggggattgacagtggctcctccagtcgccggcgcccccgactcccgcgcggggcggggtcatgcaaatgagccccatgcaaattgcggcggggactccctgcgggtccgtggggctggaacgcccccaagaggccgttccgggaacgtccgggccctgacgtcactgcggcccggggcggggaatgggggtctgggcccatctgggactcctgacgcgtagtccggcgtccccacacccgcccccgtaggtcgcccctctccctggccgctgcccagccgggggatccgggggtaagggaggggcccgtccggtccggtgtgtgcaccatcccctagagtccatgccaggcccgaccaccctggaggccagaatctctcggcgaccgcacctcagcgcccccgcacacccctggccacccgcagcctttggaagggacccctgcgcacccattaccctgccctctcctctgtccctgcaatgaccgaccccattccccaagccccagctccaggaaagcaaggacccggcgccagggcgcttctgctccgccagtcccctccagcaccgcggaccaagccatctgccacactcggtctcacccactctgcagacgacagctgccggcagccaccagtgccaccgcgt

SEQ ID NO: 10931 - DNA, 5586 bp, Homo sapiens
  source 1..5586: mol_type = unassigned DNA
cgggctcagccccgcacacggactcgccaggagtaggtggtcagcacgcgctgctggcggcgcaccacgcaggtgtaggtgccctcattgacggcgttggcgatgatgctcaggtgcgcctcgcccagggccaggtagccggggtaggagaactccaggggctcctggtccttgtaccagctgcaggggggcggggcgtctcctgcaggcacagccccccccgctgcctgccccgcacccctgccccaaggccgcccgcgggctgcccaccccgaggaccgcccggggcgctcactcactacactttccctttcttgtggaggatcttctggccgcagcggaaggtcacgttcctgccctcgggcaccagcctggttttggtcctggggggcggtggggtggtggccaccgtggggaaggggaattctgctccgggtgggggaaagagccccgtcagtgccccctcagccccgaccatggccaaggcccagctcccacgcagccctgtcccggccccgtgggcatcaccgtagcagaagtcgcagctgctggggcagagcctcttcatgagccgccggcgagcgtcgcagaagcccctccgcgcccaggacgcgcacacgaacagcctgtcgaggcatcctgtcgggagcgtggggagcacggcctggctcaggaccgcccggtccccgccctcccgcccgacaaagggactcaccgtagagccggtgcagcccccacagctcgtcctgggacaacgccttccagccgcgcagcgtggcgttcaggtgcatgagcgcccggccgtgttgtgagtgcatcaggcccagcgcgtggccgatctcgtgggccgccacgtgcaccaggtccgtgagccacacgcctgcgggccccgggggtcagcgcctgggagccccgggcccagccccgccgcccgtgggccagctccccgaggcccggtgtatctgctggagcgcagccgcggagccgccctcggccgcagccacggaaagataagaatgttctgggcccaggcggtgagctcggcccccaggaatgcagctccagctcccgctccagaggcgcagggggatgggaaagggagttcagggctgccgggatgggggctcccacgggctcccctccttgcctgctagactccagtggcagccaccaccccggaaggtccctcctgccgtctgccccaaagcccgaccgcggcagcccactgtgctgcagaggagaggcctccaggaggccagcctggacggtcacctttcttccagctgtagcgcgtggggcccaggacccagtactcgctgtcgtcgaagtggatgccgccgtgcggggggaagaaggcgtgggccagctcccccgtggggccgtcgaagcagtggtgcagcgcggagaccaggcagtccgtgtggttgatcgggtagaagcctggggggagcacggggctgagaggccgggcgcgcagggccgggccggggcgggggcgggcgcccacctatccggaggtcgctgggctgctcgggggccacctcgcggaagctgaagggggacacgtcgctccacatgcggaaggcggcagctagggcccgccgcgtctcccgcgggctcagcaggttccgcgggaaggagaggatcctgcagggagagtgagctcagcgggcgccggccgcgccccctcccccggggcccagccagggcgcacctgtaggtgaggttgaagtggtcccagcgcagcctggctggagtcagcgtgtagcggcgtctgcggggggccagtgggcccgggacccgggtgggggggaccgccgagaggcccagcgcagcgacgtctcccttcagggaagaaagcgtgcgtgggaggcatcggtgacggtccccaggaccaaaaactgccgcggaaaatggactggaaggaaacgggggtgggggtgcccagggctgggagcgggcgtggcgggtcctgtctgcctgtggtttcgggtctcctaacctgagcgccctgttgcacgtccctgggaacgcggcccagtggaggggaaggggctgaacagcagggcgaggcctcccacccctcccaacaactggacacaggggcgtccaaccctccgacctcgggacgcacatccggaccctcaaacaccccgcacaccccgcacacgtcctgcgggccccccgatagaccagacccacagacgtgaggacccccccaacccggcacctggcctcccccccgccgctcacctgcgctgcgctccaggccggcaccgccggggcccccagccgggccagcagcaccagcgcggggaggaggcacagggcgaccagcgcggctccaagccagcggcgctcgacgcctgcccccggggcctccgaggggacacgggccccgcggcccatggcagacttgctgtggggctcagggctgcatggggcagcaaggcgcgggggcccgggccgcagagcctccggggaggatccggaggggaggcagtggctcggcggctcgggttacagcccggtgtggtgggggggagggagacggggcgggagagggggcaaggctgcccctgaagggaaccagctggcccgtccgttggccgagctgcctgctgtctccagccgggggcatggggacccgcgtcccgtgggccaggggcagaggcctgggcatggcctgctgggcggggtcctcggaggggggagcgaagagggccccaggcagcccgggaagggcagcgccagggctcccgcttaggaaagggtagcagtgggggtccccaagcccccactgctgggcagtgagtgatctggtggcttttttcccaaatggaatcctcaaaaaacccctgagccccacatgagcggagtctccatcctggcccaggcagctgagctgggccgcaggagacgcgtcgctcgcctgacagtgtccccgagagctgggaggggatggccggatggggacgtggcagtgagtatggggcggtggagggggaggcggggagggggtgcgtgggtaggcaagggccgcggagggtgccaggttgcggggcggagggagggaacttgccagggtctcccggggagccgggaaggggcgggccctggctgcgggaagccccgtggagggtagcgcgtgaggtggagggtgtgtggctcctaaatccccggctaggccccagcaaaggggagagggagacgggagggacgggaaacggagctaagcgccgggcctggaggtctggaccggtcctgattgggggcgggggcggggagctcggagacccaaaggttcgacggggcggccggcgtccaggcgcgagcggctctgggctgggaccgagaccgggcaccggcgtcccgcggggcgggggtgggggattgggcagaggagcaggagattccgagccagaccggcctgtgtctgtctcgtccctccccgttttccgcgccggcgtcgggcccagggtgacggcagcccggccaacggggtcagcgccaagcagctggcggcggccgcgggcggttcttggaaagcgcgagaggctgggcctggccgccgtatttgctccgacaccgccccccgcccccccagctcgtcaccccgcctgcgtgcgcccggcccccagaccctgcctgggacgccccccaactaactccctgctgggacgggaccccacagccctggggagtgtcgggccccttggatcagagcgcgagtccccgcggccgcccccaggacggaagagcgaggggggcccgggggcagacacaggagtccccgccccgtcggacccgggcctggggggcgggaggcggccgtgcccgcgcctgaagggtgtcctggcccgaaggccgcagtccgggcgggagtctggacccgagagcctggggcgggcggggcggacccagggaagggccccccctcctcgcccccaggctcgcccgcgtgtcccgaggggaggaccccagaggcgcccggtcccccaggcagacagcagaggcaacgtccgagaatctttctttttataaaacacagggcgggggcacgcgaaggcagctcgggcgcggcggacggcgcggctcacacgaagatctggatgcggtcgcggatgggctggcggcagatggggcaggcgctgagcgcggagccgcagggggcgcatgcgccgtggccgcactggaacacgaggcggatgtggctgtcgatgcagatggggcaggtgatgcgttcctccatctgccggtagcggctctgcagctcctccaccagctggcgcggcgggccgggggcgggggcggcgctcgccacctcagagccgtctgcggggtgggggacgggtgtgagctgggaggccgggtgggggaatgcggggagcagggagctgcgggggggcgaggctgggggcggggtgtcacctgggacgggttgtgacctgcaaggggggctggcggggtgggtgatttggaggcagaggtggggcccgggtgcgggcaggaggtgagccgtggaaatcaggcataaggtggtgtgcgggctggagtcagggctgcaggtgggctgtgagctgggccggggtgtgatgggggggcggtgctctgggtgggctgtgatctggggtggggctatggagggagtgtgatctgggaggggccgtgaaatccagcggggctggggtgtgatgggggaggagggtgttaccttgaggcggggctgtgggccgggtgtgatctggagcaggcggggctgggggctgggggctggggggccgggtgtgagccttgggagggcggggtgtaacctggggaagggccatgggcggaagtgtgggagggaaggggtgggggacggggacccgcgggccaccagctgagcaggaggcgtgttgggggcgcagagcctcacccacctgggcgcagtttcttgctgacgaccacctggcacctgatgcacttcttcatcctgcgcgcgcactctgcgaagaggagagcgcggttggctgcggccctactagccgggcctccccaccccggggccccccactcaccctcacacacggtgcggtgctggcacggcgagaacagcaccagcagcgccagctcggagcacaccaggcactcagcggcctcgggccccggcgcggcgcccacgtgcaggttcgtcacggtgttgggggtcccgagcgtttgcctggggcccggggccgcgcccccgcccgcctgccgctccctgcagggggaggaggcggcttgagaggggcccggaggccgccggaccccatccccgccgtccacggactcaccggaagcgctgggcgcagccctgaagggccttgagcacgcgaccctcggcggccaggtccagcgggctccgaccgcggtggttggtgtagctcacgtcggcgccctccagcgccaggaagcaggcgaccgccgcgcccaccgtcagctccgcgctgccggggaggcccgaggcctgtagctgggcggcaggacagacgccggtgagggcgggcgccggggcaggcccgagggaggcgtctcctggcacctggcagccccagcagccggcgc

SEQ ID NO: 10932 - DNA, 1264 bp, Homo sapiens
  source 1..1264: mol_type = unassigned DNA
cgcgggtgaatcgagcgtccctccgctcccctggtctgtagttagagacagtcccccgtcgcccgatcccgcacccgctgaggagcgcagggctgtgcccgcacctcgcctcgcacctgtctgcccagggaaaccgggagctccgcgggccccgccgcgggaaggaggcggcactgggtcccaaaaacccgtgttgaggagaagccgagcgccccaacacactcgccgccggccgggccgggcccccgcgcgccccgacgccgccccagccccgcccgcgcgcgcccgacacgctcgtccccgccctcgctccgacacagacacacgcgcgcgtcctcgcaccactccagaagctcatccggcccgcgcgcgcacccagacacgcgtggctcacacccgccgcacacgcccctcgcacaaacacgcgcgcccctcacgccctcggccactccagacacacggccccgggccccacgcaggctcgggcgtcgacacaccctcgcggcatggacacgcgtgtctcccacccactcctcggccaaacgcacccctccctgcagcccctcacccttgctcctcacactcactccccactctcgccccagaaacacgcccctcacaccgggcccgccggatccccacacttcccactcgcgccagaaacgcgcgcaccctcgtggcccctccctgccgcgcgtaaacacgcccggtccgcgcacgccctcccggcctggccccgcacactcgcgccagaaacacgcgtggccgcgcaccacgcccccggcccgcgagcacgcgtgtccccacgccccggccccgcccccgccccgcgcgcgcccccgccggccgccgccctcgaccgcacgcgccctccgcctagccccgcgccgccgcgcacctacccggacctgctgagctcggctcctgctcgtcaggcttgcgccgagccgccgctcactggctcccgcgccccgcccggccccgcccggcccggcccagcccggccccgcgcccgctcagctccactcgccgcagctggaacgactcgcggggctccgggtaccgcggtctccccgccactgcccgagtgcgccgcccggaccaatggcggggcgcggcggtgagctcaccggaccagaccccgccccccaggccgcgtggtccaatcggaggatgcgacgtcacccggagccgggcagaggctggtgcggggcgcggagccgctcggcgcggggactgcgccggaactgcgcccgagccgcgc

SEQ ID NO: 10933 - DNA, 716 bp, Homo sapiens
  source 1..716: mol_type = unassigned DNA
cgacgggcgcgtgaggcccagagaggagcagccccgggacccgtccctccccttgcctgaccctggctaggaaaaggggcctggagcgcccccgggctccggaaacgcgggaccctccgcaggcagccgagcagggcggccgccggggtcaccgctgggcgccgccggagctttaattcgatccatgtgcgggactccggccttttgtgcgggagcttccgccctgcgcgccgggtccccggctcccgctcccgggctgggactcggccctccgccggcctcactgagccctcgccccggacctgccgactccccgactccggggagagagaccaagagactgggacgcaaagggcgtgaggaccgcaccccccacccgcaggcccctccaggggcgccgcgccgggggtcccggctggcgaccgagcaggctccggccgagcactgccggcgctgtcacctgtgtgcaccggggacagggacggagggacgcgacccccacccacccggcccgcttacctgggccgcccgcgccccggcggctccgatccgacgcccgagccagcggagcccggagccgctgggcctcccgtcccctccgcccgtccgccctccccgccccctcggctccctccgccccgccgccccgcgccgctttaccataaaaggtgaggctcggggggagggggcgcgggattcccgccccgcggaagcgg

SEQ ID NO: 10934 - DNA, 619 bp, Homo sapiens
  source 1..619: mol_type = unassigned DNA
cggtggaccgcctgggcgggcaaacgctctctcacgctggcgggcaggatttgaacccgggttcctagggctctgcaggccgccactgtccccgtcctctctctgtctccggcttctcccgcctggcctgccgcggcccgccgccccctccttcctcccctcttccgcccgccccctgccccctgcctcctccctccgccttctcccaccccctgcccctcgcgacttccccctcccccccgatcctccggcgccgccccctcctcctccttgtcctcgcagcccaaatacgcgacacctggagcaatagcagccgcccggcggcctgggcctcattacaggccggcccttatcgcggcgtgcatcacattatttcatttcaaagaatccgcagagaaacccgtcccggccgacaacagaaagtaaaaacacagctgactcccattagggccctctcacaggctccgcgtgaggtaatgaaatatggaagcggtgagatatgtaatgctttattaagcggtctcagctacaacggcgtgcatgccaattacgcctgcaggctaccgcccgcccccggctgccggaccacccagcgcgcctccccccgagtcccggacgg

SEQ ID NO: 10935 - DNA, 293 bp, Homo sapiens
  source 1..293: mol_type = unassigned DNA
cgctttacggggcaaactccgaggcccagccccgcgtgggagccgcagcggggcgggcccgctctgggctgggcgggtttctctagcgcagcgctgggggttgcgggcctctcagcagccggagcagcatcctgagctccggttgttggagcgctgggacctctggctgccgcccccgcagcagcagcaaccactactccgctgtcggcggcgtctccttgggaagcagcagcaactggtggagctggagccgcagcagcctgagtcgccgcagcagcccctgccggagccgc

SEQ ID NO: 10936 - DNA, 2748 bp, Homo sapiens
  source 1..2748: mol_type = unassigned DNA
cgaaccggtctcctccggcttcgcattctccagggccgcccggcgagctcttgcatgttccccacccgccaagcccgtcactcggccccgccctttcacacgcgcattggcacgccccttcccagcccccagcgggcgggcagcctgccgggtacccaggaagctcgggtccctcggcgccggaggacccacaacccagccaccgcaacaagtccgcgcagccaaagcagctcgcctgggcaccaggccccaccgtccttgttccgtggccccaagagggcccgtgccagttcccgaggcatggccgcctggcgtccggcacatcccagatctattcctctctgagggcaggggctctccggggagagaaagagcagttccggggcccgcttcgggtttttttgcatagactcttcaggcacggagaacaatggaacagctctgcgcgcttcctccactcgagcaagctttgttcctcccttcccgcctgctcggcttccattagccacagggcaaaggcttcccggtcaaacaggagtctcggcgctaacgcccagagctttcgacacgccctaaaagacctgcgggtgtaggggttggggccagagccggggctgaggtatcggacatgcgcccagatgcgcacagctggcagcccgcccgcccccggccctagacgcttcttttagccagaatcctcacaccgcggggaaatccgacttgcgctcccactcgggatccacagaggaagtggagcctcagctgtgttccggggccaatcagccctcacatctgctctcccacatctgtcctctagatccgggctctcgctggacgctccccttgcaatgcgggatgctcctgtcaagcgcaggccacaccacaacggaggtttccaccagtcccaggttttgccatattgggattctggctctatttctgagagcctgtaaccccctcaccccccatcccattgtccagcctcacctcgggcaggccagagtcgagcccgggttcccgcctgtaatgtctttaagaaggtacacttgagccatgcgcatctggaggtgggccagctcagcacatctgggcgcaatgcccatcacagcctgatcgtgaacaggagggccctccgggaaggcgcaaggggagggggcttcgctttccccacaccttccccagcagctggttaggagaaagccaggggcggggcggggcggggcggcaggacttacccagcatctggctgaagagcagctgctccaggtctcccagcacggtcaccaccagctcggggtccaccttgaggaaggcgcgctcctcctggcccttggcagaggggacaggcccagagctcttttgcgccttggccttgctggagagcagctcgtcgtccgatttgccatcttcgctcacggccgcttcaggcgccttgctgagcggcttgacctccgcatagggtcctcgagggatccggctcggctttcccaggttgggcgcgagcggagccaggggggtcttggcgccgcccgccgggctgcccttggcctggaagagcgagtgctccgacttggacagcgtcttggacatcagcggagcttcacggcccttggaccccaccttgcctaagcctttgggcgccttggccatatcgtcgctccattcgggctcataaagctgcagctttttctcggagtccgtgagaaaagagaggttggtgagtgacttctgcttgcgcaggttggaggcgggcggcccgccggggacacggctgtccacgctgccggacttgaagaccttcagctcagccgcgctggccttggccatgccgccgccgccgccgggcgccttggcgcgcttgggcagcatgcctctgccgtccgccgctgccgccttcctgccggcgccccgcggttcgtccgcgccctcgtcgccgccgccgctgctcagctccacctcgggctgcacgctcttgacgctgctgcccagcattctgcccgcgaggagcgcatggacgatccgcgcgtctgcaggcacggggggagggggcagggggcgggagcgcaggaggaggaggcgggggaggaggagggggagagagaggacggaagaaaccgaggaagaaggggagagaagggggagagagcgagggaggagggagagaggcaagccgagggcgcaggggaaagaaacgcgaggaaggaagccgggaaaaaggaaagagcagggaagccggggagcgatagggcggggtcggaggaaaaggggcggggcggcggggaaaatacaaattaaaatttaaaaatcagtcaaaggaaggatggaagccccgcggctcctccggcgcccagcggtgcttttgctttggtgtccggatcccagcccgcggcctgcctgcctgtcagtcccgtggacaccgcactgccgggcagcgccccggccgcactcagccagccagccagcccgagtcgaggctgcaggctgcagctccgagcagaggaaggagggaaggggaaggcggggagcaaacaggaggaggggagcgagtgtgcgcacggggagggaggtgggggagagatagtgtgtctatttctggctcgggagggggaggtatctgcgagcggagctccaggggcggatgagtggggggtagggggaaataaaggaaaagcagtttttctcccagctttccgcgtagaagcggggcgggttcttggattctcggagggcacggggaccccctgccgt

SEQ ID NO: 10937 - DNA, 433 bp, Homo sapiens
  source 1..433: mol_type = unassigned DNA
cgggactgggcgctagccagcagcccgcaggaccaggcggggacaggcgggcagtactcacaggtaagccgtcagggggtccaggtcccccggaacggcggacagcccgagctcagagcagtcggcagacagcatgatgccgtcctcctggcagtggcagggggccgggcaggcggtgggccccgggccgggctggggggcgccgccggccctccgggaagcgcacagcgcggcgcaaagccatagcgcccggagccccggcgggctgggcatctcggcggtcgggctactggggcacctggcggccgggcgcggacgcacggcgcgatggccgcagctgcttcctcccggtcccggcgggctgcaccgtcggtggggaccgccccaggggctctattgggcggcggcggcggcggtgggagcgccgggacgg

SEQ ID NO: 10938 - DNA, 1376 bp, Homo sapiens
  source 1..1376: mol_type = unassigned DNA
cgcgggatccccactcctgcgaggcctccagagcccttctgggaggaggcctccgctggaacgtgtctgggtgaggagagggagatcggctcccaggcagggacggccagggtgcgcgcaccccagcttctgggccatcccggcgggagtctgcgctccttttaggcgcgacccccaggaaggtctcgggtggtgaccgcagattggagagtgagctgggctggggaaagagtgaggcggatcgcccccaacctccggcaaagtgtgcgcccccgccccaccatccaggggcggcggctcttgatgagctcatgggggcggggcgccaggagtcccgcccgcgagcccccccctcgtccccgcgaagcagcagtccggaatccgcggccagggacccgcgcaggcccctccttagctgaggggcggccgggtactcgggtcccgacccgcgaccaccgcacccatcaccaccacagcgggaactgcccggcggcccccagaagccccggcccggccgcagaggtgggcccccgagcacagaggccccgaaactcggctcgcagccctcagccccaatgtcggggggcgcggtggccccgggcgaccccccaccccgctcctggagcccacaggtggccccacaacttcgcggcccgcgctgcgcccgcggggcctagcacgctgccgcgggacctgcccaacgtggagtgtgtgcctgccccctcccgccccggcccccggcgcagcccttacccagaagacgaaattgaagacgaagagcaggtacttgatgcacttggtgcagccctccactcccatggcggcgcgggcggcgggcggcctgcggggcgcgggccggtcctgggcggcgggcgggccggcgcggggcctggcgggtggccggcaagggggcctggcgggccgaggggcgggggcgcgaagaaaggggcgcgggggcgcgggggcgcgggggcgcgtggggcgctgggcgccggaggcctggcaggatgcgcggtggggtcgccgccgtcgccgccgttgcgcgctcgctctctggccgggcgcgcgcctcgctccgcagtacttatagggcgccgcggtcccgcccctccataggccccgccccggccagctcacgccccgcccccggccccgcctcctgccgccagggcgcgcagccgaggggtatggggtcgctgcacctacccccaacttggcgcgtttcggccaggacctcagggcccaggtgcaccgtgctgggcgcgggaggcgtccccaagctgctgtcgcgctccgagcccccaagggggtggcagcagggccgcgcctgaggacaggcatgcagcgtctgcccaggagtgcagccccggtgccgg

SEQ ID NO: 10939 - DNA, 3393 bp, Homo sapiens
  source 1..3393: mol_type = unassigned DNA
cgcagcggaggcgggaggagagtctctggcgggcatttgtcccccgcgcccctcgcgcgcccaaggctgggctccggggcatctcacccgggccgtcccgggtccagccccagtttagaatgactccacaccccccacatctccaagtctcagaaaccatcgttctgagaaccccaaggaggacaccctttcccgggtcttctgcagcgccgagccccggcaggcctccccggcgctcgcctgctgcgagaccttcctgccgccccgaggagcacgagaccccagccgcctgcagatcacccacatttgcggagggtggcagcaggggcttggctggtttgaaacgcgccggggaggcgcgcgctgcaccaaaccccgtccctgtccccaagggcagactcggggtaaggggaccaagacctccgacgcactcagcgccatggggacagccatggccaacactctgtctctgcggtcaatcccaaggttaccaaaactctccatccgcagagagcgcgcacagcagtgcggacactcggggactgccttaaggaaggctgagccctgggagcgcgtggactccgccctaccgcccggcgattggctcgcggggctgggggcggagaccgagtccgcgctgtataaatattcatgagccggcagcgcggcgcgagcggggctggagccgggaagttgggctaagggcgctgctcccgccgaggaggaggcggcggctgggcgcgggccgcgccactcaggtgtccgctccgccttccggtctggatttgctcctgggtgtccagcaggaaggagactgtgtgcacctcgcccgactgcggccggagcgcggcgctgacttttccaggcggcgggggtccgtctgtcccggcggcggacggacgaaggacggacgccggagaaagagggcggcggcctgggccgaggcgggtccccaactccggcggcggcggcggcggcttggccttgggggcgggcatgagcccccgggggccgagtggtggccgccagggctgacccggcgcggcaagcggcccggcccagccatcttgactgcgcaccgcggccccagaggaaacttgcggcgcctccgccctctctgtccggcggagtcaccgccgcccggcgcggcggggagaagtggtcgggcgcgcggagaggaggcgagcgagcgcgggacgatgagccgaggcccggccgctctgcgccgcgagggctgagcgcgacccggggccagcagagcggacctacggactgtggcgcgcgcctgcagccgccttcaaacccccggagcggcggaaaggagtgcggaagggccctgcccaggctgcgggccgcgccgctgcggacgcgcccctagaaggggttagattatcggcagacccccctcccgggcgaagcataagggagaccccagatcacccgctgtacccgtctgcggctctctcgtgggccccccccccggcacccctctgcgcgccgcctggagggcgagggcaccgggccgaggcgcacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggcggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctcttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgc

SEQ ID NO: 10940 - DNA, 1381 bp, Homo sapiens
  source 1..1381: mol_type = unassigned DNA
cgtctcaacgtgctgctctggtaccaggacgcgtatggggaggtggagataaacggtgcgtggggcccgcgtgggcgcgaggaggggtcgccacggcctccctgagagtgcgctgctgagctcggctttggaggcgtgcggcggggaggggttagcccccgggtgctctgtgcggcccggctggggttaaagtccggggcgggtctgcccctgtgcacgtgggagatggttaggggtgttggggaccccgagggctggtgtgaggcctcgggagccatcggggtgactggccgccgtccgcagacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctggtatcccgggccccaccccgtgccccgcccacccggagggcccgccccgccccgccccatgctccgtcccacccggggccccacccccaccatcgagctccgcccccatccccgcccacccgaggccccgcctcaaaaacccgcccaccccgcaggccccgcccctcccttagagctctgcgtccggcaccgcccctgagcctccggccccgccctcccccgcccccgcccctgcgccgccgacgcccgccctcccgcagagccctccgccgacctcttggtgaacctgagccgctgccgacgcctcatcgtggtgctttcggacgccttcctgagccgggcctggtgcagccacagcttccggtgggtcccgcgcggggttgggtgggccccagcgtagcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcgggagggtccggggctagcggcgggttagagatgggcggtgcccgggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaacccgtgggcagccgcaggtgtgctcttgggggccaggacgccaggggcttccgaggtgttcacacctgcaaaccgccccgacctggcccccagactccttcctccgatttttggaaagaagtgcagctggcgctgccgcgg

SEQ ID NO: 10941 - DNA, 493 bp, Homo sapiens
  source 1..493: mol_type = unassigned DNA
cgagctgcccttgggcgcgcctggggctgcacctgggtcacgtgggcgccgttgtgcagccggcacctcccggccaaccccgcggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggtgagtggtccctggagtcactggctcagggcgggcccgcgggatggggcgggcggcccggggcgcagccggccaggccgttgctatggcaacgcggtggaaaaacgggcctctgggtatctcgctgccggccggctggtaaccccccagcggagggaccgggccgagcccgcggacccctccgagtgtctcctggggcccagccgttggtaccccatttcccccgggtccgg

SEQ ID NO: 10942 - DNA, 922 bp, Homo sapiens
  source 1..922: mol_type = unassigned DNA
cgtgcccccctccgtcacttggtacggcccgtgcccccgccgctgatctggcaggctgcgcgcgcacactccggccgggtgcgggccggcggggcacagcggcctctacggcccgcctccgtcagtcattccccggtccctcctcccgctgctcgcgtgctccgggccggcccagcaccctccgagttacgtgcccgcgctccccggcggggaggagcgcagccgcgggggcgcgccccggtgactccgcccctcagctcccctcccctgagcccgggagcccggctcgcgcggctaggtgcgaggagacccgggaccccacgcccgcccgccctgcccagcgccccagccccggcgtgcgaggcgccgctccctcctctgccctgcgcggtgcatggaggggcccgttcggatcgcagccgccgccaccgtagccgccgccgcgcgcgcgcggggggatgacctgggggtggctttccgagccggctgcagcgcaggaggtctggaggcttagccagccccgcggagaggtgcgggggtgggggtcccgccgcagggtcggagggaggggtggcgcgcgggcactgggcttggggggccttggcttaggggacgggaggtcccggggacgggcgggccggcgttccctggagggcgtgggggtgcagggctgcgtgcggggtctggatgctgatgcttgcccggcggggagccccggcgttccgcgtcctcgggggctcggaggcacctcgcgggaggaggcggggtgaggtgtcagtgacacgacgaaacctcttcttgacgatggtcctcgggggcaggtgagatgccgcagagcggggagctagggcgcccgcgcgttttcccaagggagccgggtccctggcctctctcaatctccatccctgcagagcgcccgcga

SEQ ID NO: 10943 - DNA, 719 bp, Homo sapiens
  source 1..719: mol_type = unassigned DNA
cgctcgaggatgctggaggtgggggccgccgcttcagtccgggcgcagggctgggggattgggggcggaaactttccgcagaactgtcccgcttgctcactccaagggaacggagaggatccggcttcccgcgaaaatctggtccagggaaagggaccccggaaagcagctccgcagggctgtggcagccccaccccgacccgcgctgcgcccacgtgcagggcccgaccccctccgggaggcgcggcgccggctggggtcaggcggccgaggaccccgcggctccccgccccgccccgccccgcgggcccccgcgcaccgccgccgcgtactcaccctcacgggtggagcggggcggggcagcacggttccgcgcgcagctccgatccgctaggcgcaccgaccggcggcgcagcgctggcgcgacggctcgactcggccgggtccctgtcccgggcgcgggtccggcctgggagcgggcgagtccgcctgcaggggaggcggggacccgggcccgggttgggggcggggaaggggctggacacgcttgcgcacacggcggcccgactcccaggagctcccgggaggggtagaaagggcggggtggaggagggggaagggcgggggtgatgccgcgcggtcgcaggcttgggatggtgttcgcgcctccgagacccggacagaggcaagcaggggcgccgtgggtgccagagaggcgg

SEQ ID NO: 10944 - DNA, 958 bp, Homo sapiens
  source 1..958: mol_type = unassigned DNA
cggtgcacggggtcacacagtcggaaacccttgccggccccgggttactccctttctgaaacggtcttcctcggagccatcccctggaggaccccacttcgctcggtgcccgggccccgcacccaccctccccttcccggcccgcttcccgcacggcgcctactctgttcctcgtcctctcgtcccaccgccgccctgcccacactgcctcccgtgggcgcccccggccgctcccccttctcgggtctcggcctgggggtgcccagcccgcccggcgccggctcaaggccgcgcgactccgcacgctctcgagacccgcctcgccgcccgccgcccgggccgcactcaccgcgcccgcaggacctgggggtctccgctctgctcgcgctccggcaccgccgccgccgccgccgccagcggaaacagggggcggggcctgcccgggaatggcgagcctgcggggcggggcggcccgggggcggagcggggaggggcggggcggagcggggaggggcggggcggagaaggatcgcagggctgagcggggcgccagcgccagtgcccggcactgccccgggctgggtcccctgcgttagaggaaggggagcccggggacggggcacggggcccgcgaggcacgggtgctctctcggggttccggaagcctccctccccgccccgccgcccgcatgcccggaccggccgctcctccgaggtgctatgatcccgccttccccctgcggcgaacgggcctcttcccggggtaggggcggggaggtccgggcctggcagtgcgctctcctgggctctgcgcccacacggcacccaagggccttcctggcccaggcctcggctctctccctcgcgccaggctgcctggcctcgccaccccacccccacacctacgaaccccttccctggtgtttcgggcggactgtgcgagatgctgacagcgcgg

SEQ ID NO: 10945 - DNA, 3843 bp, Homo sapiens
  source 1..3843: mol_type = unassigned DNA
cgcgcgtggcccccggagaggcgcccatcacctgcgtggcgcccccccgcgccggagtgcggccctgctcccagcgccagtgcgccgcgcggctcgccggcctcgtaggattggctaccgcctcccattcatgtaacctgcgtgtgcgtgtgcgtgtgtgtgtgtgtctctctctcgctcgccctctctttctgtgtgtaagagagcgagggtgggggacggaggcaggcaggcgagcaggcagggaggggaagaagagaagggaagctattaaacacacacacacacacacacactcacacacgcgcgcgcacacacccgccccaaccccccagaagcctcgggattgcagctgtttcatgtggggcagcagtgctggcagggacgccggccgggagcggccgggagcgggagccggtcgtgcgcgcgcggctggaggctcgctggggctccgctccccgcgggagctattgttggtctcgctggagctgagcgcagagcccggacctgctccttcctgggcgccccgctacggctcgcggagcagaggagccgcgccgccgagagagagaggagccaccggcgcggcgccttgcctccctgccgccgtcctcgccgcttccccggcggtagcagcctgcagccacggtaaggcggcgtgatccgctctacggaaaagcgccttggggaccgcggcgacgcctcgccagctccatcgccctctgcactgctggcccgggcagggttcgggtagctcacgcggctgccgagggctccgggagatgtttgcttgctcccctggcccaggaggagggaggctagggcgcgggtggccgaagaggcaagctgttctggagcctggagccgccgcagcccccggagcccgccgcggactggagcctgggagcaagggttgggggagggcagggaggtgggaagcgggtgggagggaggcggcgcgccccaggttcgtctgcctctcccggatcccgttccccgccccggcccggtcgcctgcagcccctctgcagactagctcgccccaggcccccgtcgggcgctggaggagcccgcgaggcggcgccgggcttcagcggctgcagcctgccctgcggggcaagtgccggctgcagcagccccgcacgggcggtggttggagctcagatcctggagatgcgaccccagctcctcgccctctgcaacccgcggggcgcccgcctctcctcaccgggcgcccggccgcggtattgatgttcgtctaggagccaactgaggctgcagccgccagatggacgcttggagggctcccgggtgtgagtgtgactgtatgactactctcacccccagcttcgggaaatgtgctctgggttgaaatgtgatcaccgagctcctcagtcattttaattgccatttttaaatgcggtcgttacattggaggagcagactggaaggtagtggggcggcgtgtgtgtgtgtgtgtgtgtgtgtgtgtggacacacacacgcaaccgaggaatacacaaccaactacttgggtgaagggcggggggttcacctagtgagtccttcttggcgggggggtcgggcgagttagctgcccgctgcccgccccttctctgcctgcccccgcctaggcgaggttggaaagtactggaaattcagctgcgtggtccttaactttggaaattggctccgctttcagggcaaaatgttaaggcgatttatgcacccgcgtccatgtggatgagtgtattactgctcagttgggtgcagagccctcaacagtaccgcgccaagcccccacccgatctctaactccctcccaccccctaaccgtggagagagggtttatagaaatgcagttatctgtaaaccatcgacgcagtgaaaggggcgcagggaggcagccagagttttgcctgaacctgcatactggcttggtgtttgtagcacacgagatcaccccgctgctttgtagaaggcggtggtggggcaagctcgggattccaatcgccggggtggggggtggggggaagagggtgcccatgtactgagctctgaggccgagtaaggagagagatctgctgagcggcatcgcgggcaattacataagctgcctcggtgattacccggaactgtgatgcgagctcccggttctcgaaagacaagcctgaaagtttgcctgcttggggagtgtaagtaccggggcgcccccaccccggcctgggtagctaggatacgcctcgcaccacggcgcccacttgtgcgatgggcgtcgggtgctgatgctgctgtccccaaagaaccggttaccgaggcagggactaagtgggggcatccggaattgatcgcagaggaggagtcagtcagaactgaggtttcattgggtcttcagagctccaagtcttccctcggaggtgttggaaggccttccagggaacgccgttttcagaaactgacttggtgtcctggggagccccaaagcccctcttttccgcccttcctgggcgcccctccttgtctttcaagccctgtgcccttcacgtgtttagaaacctgcccgcggtgcctggtcccccttggagatgcccaggcagcccagccatccaggcccacgctggcgaggggttagagggagtagaacgctggctctgccgggctgccacccttacctacacctattcctggtttcctgcgctagcccggcgctgatggggacgggatggggctggggtcgggtatggcttccgttccttcgcctctcgcctctgcagacagcagtttgcttctgttgcgtttattctccccgtttcgccgcttccctccagcgccgcagcctgtgtatcacgttgatgggctttgatagagaaaccacagtaagagtatgcttttaaatcttgattttcgtctgtagggggataagccaccccagccctgacacagccgtggggaacgctgaagtctgggacacattggccctgaactcccttccccccagcccgcagtcaggagatggtgatgtgcatgggtggggagtgttttgtttttgccacattccagcgtcctgaaacctctcgtcccctcccactgaaatccccgatctgtctgaatctgttccttgctgtaaaataaatcctccctcccgcagacctgtggggcccttcggatttcctgccgctgccatgatccttaacaatgcgattgaaaagccagtgctcggctggaaaaaaatccccaggtgccagccggccgcgccttgaccttgctgaaggagcctttaacccggctgccagaggggctctggtccagccgtgggaatccaggaagaaggagggcgccccggaggcggctgggttagctccccgggcagggcgggaatcaggtcgcggcggggaccgcagagggggaggggacgggactccgcggcaacctgtttcccggcgagccgggcccgcgcatcccagctccctcgccccagcccctcgtggcccgcctcccccgccggcctccagttgtcttcgtggtacaggagtcggccgcgactccctcgcgctctccgccggagtccgcgggacgccgccaactttgggctcctcggtggccggagcagcggtgcgaaccagcggggcggccgggtgggcggggcctgggcgggaaactggagccgagaagaccgcgttccaggccaagttccagccgcaagcgccgcgcggcacagtgcagggtcccggccgcgcctttctcccgtccccggcccggccgcgttcctgcggactcacagcgcgctccgggcgctctgcagttgggctttcagcgggggagcccttctcgtcaaagttacga

SEQ ID NO: 10946 - DNA, 384 bp, Homo sapiens
  source 1..384: mol_type = unassigned DNA
cggttggccgggggacgtgtccgcgctgctccccctccggccgccagggggcgcaggaagaagctttggaggtctgtcccgggaccgcgtactcgtccttctttcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccgg

SEQ ID NO: 10947 - DNA, 1432 bp, Homo sapiens
  source 1..1432: mol_type = unassigned DNA
cggacgccagggggtgcccccagctccagcgcagaaccccgccccgcacaactcaccggatcagccaggccgtcgaagggcaccaggtctcagctaccacgacgctccgctcgacgggtcgcagccatgcaggagtggcagaggctgcctgacgaagccctccttgggggtcgatgcctctctccgggtgggaaggggcgctgtcggtgagggctatcctggcgccggcctgcgccgtccgaagtcgggggggaggggaggtctccgttcagcaggggtcacgcccgccccggacgggggccgcgcgggcgctcaggcgacgcatcttcgccggggcccgtgatcgccacgtccggcgggcggcgctgcgcctcccctcggggccccgctcaaggctgcagctcggcccgcgccgctcccagggcgccctctccgcccgcgctgggagcccggcggccgcggcccctttcgccagccccagctgcagcctgtctttgttgcttcctctcgctcgcccgcccgcccgcggcttgcagcccccgggttcgccccgaggtggagggattgtctccttcgggggttgcacgcacccgcagcggccccggctcctcgccggacatacaccggcccctgcaggttgcaaagaacagcggcgagaatgcaccggcccctcctcctcctgctctgagccccgggtgtggggggaggggaagccggcgaacagcggcggcggcagcggcggcggcggcggcagcgggcgacgcaagctcggatgcagcctcgggggcctcggcgctgagaaacagccgatcccagtggcgcaggacggacacgaggacggcccgggggactgtgcaccgggtgtgcgagctcgcaagccgcagcaggggccgcgcgcgctgggctctcacgcgcccatggccccgggcggcgcgcgggggctcccggggccgcagcctcgcgccgtctggcgcgcgccggcgcctcgcctggtctcaggcccgggtgccgcgcgccgcgccccacaggcgccgggcccggctgtccgcctcccccggccggcgcgcgcagcctctccgcggagcagccggccaggcagtcctgcccgctgctccgctctggcccgactgacaggcgcgagcgccggcagcagcccccgcgtctcgtcccccgcccgccccccgcggcccagcccaatcagcggcggctgagaggcggttaccagggtgacgcggcaccgcgtcctgcgaggggcggagccgggggccgccacgcgcgcttttcgcggcaaaattcaaaggccggcagggcggctctccaacctcctcccccaagcagggacgaggcggaacttgcctcgcgaggactgcaactcccggcatgctgcgcgccggcgccgggtggaggggccccgactgggggcgcagggcgt

SEQ ID NO: 10948 - DNA, 325 bp, Homo sapiens
  source 1..325: mol_type = unassigned DNA
cgctgccgccgctgctcctccggcttccttgtcatcatccctcacgccctgcagccctgcctcctgttcacgggttgccaagccgcggcctggccggtggtggcagtggcggagttagacaaagcccccgcctcccccgccccagagccccccaggcgccccaagtggcgggaaggccgccagctccccaggccccgcgctctttgtctggcgtgggggtggggagccgcgcctggccccaggagcttcctggcctctgccaacccctcgctcctgcacactgcgctcattgtctgagatgcgccgagacggccttcgctgacgt

SEQ ID NO: 10949 - DNA, 1242 bp, Homo sapiens
  source 1..1242: mol_type = unassigned DNA
cgctcacagacaacgctctcccgccgctggcgctggtccgggatgcggccccgagacccctgcagccgcgcgctggctcaggggacctccgcaggacgcgggcgggcgccggggccgggtcgggcttgggcagagtgacaggctcccagtcgtgagcctcacaagcagatctatttacaatatcccggataggagtccaggtcgcgtcgctcgcgtcgcccgcggggacccggcgtgaattcacacgctcccctcccaccgcctcgccgcctgtcacggccccgagacccggtcagccccttcgggggttcccttcgccgcgcagtactccgcccgtgagcagcccccgcctgcgctcctccctccctagggcggccgcctccactcccggctcccacccagcggggatccaccagggcgagggctgaagacctcgcgggacgccgcgcgccggggacagcgacgcacctaccttcccagccacctgggaggctgcaggtccgggccggagcccgaggctcaggggcgcgcggagcagtcctggttaaggcgcagggcgcggggttgcatgggggtccagtccagcgtgcacaccgtgcacctcccagcgcagggctccgcgctctcccgtagcccggcaacggccgccaccccagagccccgcccactaggagccccgctcagggcaccgcccacccgggccccgccctcaccgcggctctcgccgtggctccgcccccgtccagagccccgcccccagcgcacactgcgtcagccggacttgctctgcagctgggttctttggaggcccccactccgcggctactgaagcggatgagtgtgaggctgactgggggcttggggatgggggaccggagaccaccaagaacatggctgtgttgggaaactttccttcagagcagagagggagggttcctttccgccggggtgttccccacctttcagcctttcccgcgtgggcccgcatcccagccagaggggatacggcggccaggtctgcgctgctgcgcctgagctcaggtcggcagaggtcgcagacctcggctcctcagccggcagggactcgcaggtgcgcgttcccacggacgcctcccggggaagcccgagttcgcctcctgcaggccgggaagcactcgccccgagacggccgcaccctcgcagcggaagggcgtctgcaccacagctgtagcaccagcgcgtgcgaggcggggccagggccgg

SEQ ID NO: 10950 - DNA, 1460 bp, Homo sapiens
  source 1..1460: mol_type = unassigned DNA
cgcgtctctgctccctcccgacctagtcgtaaattccgagcctcagcggccgccctctctctcctccgctcttcttgacccaaggtctcaaaagacaaacgtgtcacttcccgccccgcccctggatcctggtcccgaccgaatgtagtggggaccgagaagcgcaaggtccaggacttgttagaggggcgcgccaagggcgcccctgttccgccaggacatcaccgcctgggtactctacttcaccctcccgcagccttctttggggccgggcggggcggggcggggcaggggggccgggcgcggcctacgcgccccctcgagtgcgcggtgcgggacgggcgcggttgacgcgctcccgccggtgtctgtgcttctccgcaggccaggagggcatcctgcgctgccacccggacctggcgggcagcgagctgcagcggggcacgctcacggccgagtcgcagcgggaacagagcggcgcaggcctgaggagcctgggcgcggacgagcggctgcggctggccgagctcaacgcgcagtaccgcgcgcgcttcggtttccccttcgtgctcgccgcgcgcttcagcgaccggacggcggtgccgcgcgagctggcgcgccggctgctctgcccgtccgcgcaggagctgcgcactgctctgggcgaggtgaagaagatcggcagcctgcgcctggccgacctcctccgcgcagaccccgccaagctgtagctgccgcgcgggccagggacccgggacgcacaaccggacgcgcgggggccacggcccggagctgtgcgtcctgggcgggaggcggactcgggcctggaacagcgtccacacacgtgcacaaaggaagtggagaattgaggcaatcatacgagtaatgagtccttttgtccgcccacccacacgcgcacgcgttgccaaaatatccatattgtttagtgctttgccccggatttatccagctcactgcttcaattcttcactccctttgcggcccccgacaccaccggcctttgtggattccaaagcgtttatccagttctccccaaccctctcctgctaagcccgaactgcaaagcaaaacggacggaaaaggaatcttttatgccacagcggtttgtctgtttttctcttttcccacttcatttgctgcgcccgacctttacatgtgagcggaagcggtgttctcgctcttgggcactaggggagcagactgggagccaggaaagtcaaacgctggcctcggtccggcctggggagccggggaagccgcaggaaggaggcggtgggccgggaagagccctgcgaagggaagagccaaccgaagggttgggaaggcgccccgtggggacggacggaatagttgcagccatcgctcctaaaaggcgggaggcgtccagctaaagatctctcccggaggtcggctttgggggggtggctcgactgccccgg

SEQ ID NO: 10951 - DNA, 1064 bp, Homo sapiens
  source 1..1064: mol_type = unassigned DNA
cgactggcggctgtgtggcgatagcgcacgcctagttcctggaaagctttgcagtccatcaggagagtctccggggcgcctccctctctggctcctccagggacctgcgggtagtggaggagttctccatagcgaggcagcgcgcccaagccggacaggatgcccacgcggcactcctctgtctcgggctggaaggcgaactccaggctccgcgcgtccagggcattgctggtccccagcagctcttccacgaccagaggcaagttccgagtcacaacctccagctgggtgaagaccacctccacctccagtaccagtggtagcactactgcccctccgggcgcgtcatagcgcagctgcagccggacgcggtcccgagacgggctgcgcgcgcccaggtgagagtagcgcacctcgccagggccaaagtcgcacgggaagcgcttgggactcaggcggcccggtcgctgggccagtgcgtcgttgtctagtaccgaaaccgcgcagcggtccccgggctgcacctgcaacaccaggtcatgcaggggatccagccagacttcacggccgaaaggcacccggagtccgcggttcgccagcactatggcctcctcagcagggacccctgcagcccccgcgagaccaggggacagcaacgccctgccgaaggcagcgggctgtgccgggacgcggcttaccagtgacaggagaagcagcagcagcagcagcagccggggcggcggtggcggtcctggttgaaagctggtggagttgcctgtccggcgcgaggataacccgggagtcccggctgagtgcatggtcccggtgttcgggcttggacaggtcagcctgagagcatgcgaagtcggtccccgggcagacaacaagagacaccgccgggaagtgccaggaactccgcgcgttgcccgcggggtcctcctgtagccggggctgggccagaaggatggcaaagttgcgcggcgccgtccgggctggagccgcagccgaggagccgaagccttcccaggccgtccagctccgccgctagcgcctcaatcgcgcgg

SEQ ID NO: 10952 - DNA, 622 bp, Homo sapiens
  source 1..622: mol_type = unassigned DNA
cggcctgccacgcgctcccgtcggggcccacccgcacctgggccggggctggtgtccacgcgcgacggctcgggagcacggacctctgctccccgcagcaccgccccccgggtggagccggcggccccgcctcgcagagctggggctgtacctggggcaacggggccgggcctggacgtcaggtcggaggagtagcacctgccaggagcacgtcccgccggcaggtcgcaggagccctgggagccgccgccatgggtacgctcggcgggtggggggccggccgggctaaagactcggagctacgcggggcgggggccggcaccgagggccgggaggcgcgaagggtacgcggcggcgggaagcggggcgacccgaaggcccacgggggccgggaggttgcggggcgcccgggatcccctcccgggtggtcaccgtgcggccggggcgcggaagccagaggtgcccagaggcgccgactccgccgaggttgcgatcctggcccgcccgcccgtggggcactgtaatcctcgtattcccaccctgcgggccgggagtgcgcttggagcgggacgggacccagcgggtgacggcaggggcggcagaaacaccgtctaactggcgg

SEQ ID NO: 10953 - DNA, 1622 bp, Homo sapiens
  source 1..1622: mol_type = unassigned DNA
cggccccaccgggctgcaagggccgggaagctgtgccgggggcgctttagaggccagagccagggagggggcccgcgacacaggcgggtcttccaggcgggcccagggccaggacagcgcggcatcacccggccagtcctctgcagccaggatgaaggccggggacagacgttcagtcctagaccctccagacagggctgggcagtgccggtgggtgcctgggagaggcggaggcgggcgcacttccagcaccaggttcgggaaggacacggtgcccagccgctggagcccctggcctgcgtgccccaccctgattttctggcatctggtgaacggcccctccgcagggtgggggtagccaggggatctgccgaggaaagctggggacagcgggcttggtggcgcggcccggcgcggcgcgtgcctggggcgcgtggccggccacagaacccggggagggtggaggctcccgggcacgcgccggggtggtgggcagcccgggacggcagcggcgatccgtcacctgaggaggggcggggacttcatcgcggccaggccgaggcgccgagggtcccttgcggcttccgcccctctccgctggccccgacgccgcgctcgggccgggactcgagccccggttccgcggggcaggctcaggtctgcgcgctgcgcctgcagccgaggcagaaatccgtcccgaggcgcgggcgccgggtccgggtcccaaggatgcgcgtcgggctccctcccgcggggacagccgagctccgccggcgctccaggtgttcccgcagtgcgtccgggcgcggacgcctctctgccctcggaggggaagcgggagggcccttggggtaacgccccgacctcgggcttcctaacctgggtcgacagccggctggcacagggaggcctgcgcgggagaggggcggagagagcgcagcgcggggcacagcgggcggtctccgtgccgcgcgcgcgactggaaacggcgtgcagatcctaaaacgagggttccacagagggccacgaggggcaggagagagtccccggagaactctagctccccgacacggctacctcttggcaaacgagcgagaattggggcgcagagccttgggagggccgttccctcggcgggagcggcccgagcacagcctcacagcagatgcgagcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgc

SEQ ID NO: 10954 - DNA, 324 bp, Homo sapiens
  source 1..324: mol_type = unassigned DNA
cgacctcccgagggaggagacagcgccgccctcttacctgcacaggtgctcccgtcgtaggtctcgcacacccactcatggcactcacacaggggcccgaagaacatgcccggctcagtcacgtggcagatgcagacgccgcagtcgcagcggccccggccgtggcacagcgcggcccccgggggctgcccaggtgcgcggcagcgtcgctccgactcggcccgggacagcctgcaggcggcgcccggccagctcctgcgcgggcgacaagcaaccggcaggccgggtcagacgcggacgccgccccctgctccgaacccacgt

SEQ ID NO: 10955 - DNA, 1881 bp, Homo sapiens
  source 1..1881: mol_type = unassigned DNA
cgcactcggttccgaagaaggcgtccctcggacaaaaccgaggaatctgtcctgctctgtaaggaactagggcttgctgattcccagattttaacgagaatccctgctccccgtaggcgctccataaatttttactggacaacttcaccgcgcgctactgggcctccgggagacccgtgactcccacccgctctgggcgcgggcccgcagagcctcaacccgcgcccccggcagccgggattccccgcccggaccggctcccaggctggaaacatcatggtccgcacccggggcgcagccgagacccaccgcgccggaggccccgggacccgctcagaccgctgcttggccactctacgcccctgagccccccacacagccagccccgtgacctccgagccccgtgacctccgagccccgtgacctccaagccccggaagccgctgtaggcagcggcccagccaggccccgccccctccaccggagctccacgcgtcaattccagccaggccccgcccccggccgccccaggcgtggacccaagccaggccccgccctctgcctggctactccaggcgcccaccgccccaggcgtcctctagcccaagcccaatgcccggctgctccagacgtcgacagccccatgccccgcctcctaatcggctgctgctggcgtcctctggtccaggctccgctccctacccggctgctccaggcatcctctaggctagaccccgccacctaccggccgctccaggcgtccgcagctccaagccccgccctccgcccggctgctccaggcggcctccggctcaagccccgccccctgcccggcggctccagaggtccgcggctccaggccccgacccctgcccggctgcacaaggcgtcctctgggccaggccccgcccccagcccggccgctccaggccccgccccgccccctctgtgcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaaggtgggtgcgaacgctttaaggcgccattttccccggctgtccagtgggagtcggggaaagcgggtctgaggtgcgggggacgtggggcgtgccgggatcgcggggcggaagcgggatcgacggcgcctgtgccccgaggggcctagggcgcctgtgcggcagcgctcgcggcccggagtcgcggcggggcagccggggggcgcggggcggaagcgaggtcggtggcgcctgcgtccggaggggcctagggcgcatgtgcggcggcgcgcgtagcaagtttctaacaaggcgggctccaagggtcccggcgcctgttggccggatcctgtgcgagcgcgcgcgcgcgcggatggtgcggggccctccaggccgggccggaggcgcgagcgatttcgcagagccgggtattaggccgcgaagtcgcccaggcggcttccggggagccgagctggggtcagaggcgcgcggggaatgcccgggcgcggtcgaccttctggttccgcacagcctcgccagtagccgagggccgcgctgcggacgagctcagccgaggagcaagcgccccggcgggactggaaggccccgg

SEQ ID NO: 10956 - DNA, 944 bp, Homo sapiens
  source 1..944: mol_type = unassigned DNA
cgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggccgcgcggggcaccggcccaactcggaggggcggcggctgggccctggtggatggcagcgtcgccacacgccccctccccccagacccgtcctctaggccgggggcggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcggaaaacaccgcggcctcggcctccagaaaccccggccttgcgcaatcccccgcagcccgcgcctccctgggccccacgcgg

SEQ ID NO: 10957 - DNA, 1514 bp, Homo sapiens
  source 1..1514: mol_type = unassigned DNA
cggagccgaatccggtgctcctgttcgcctggggctccgccagcgcgccgtaagctcctccagaaacccaaattctgcaggccgcacccccaactcgtatctcacccaggcccccgtctggcgccgatctgccccagctcaacctccggctccgcagactaggcactttccgggacgcggggcagaccctgcgctcgggtcccttcccgcagccgggctgtccggcctctgcgcgcgcacaacaggcggcacggcgcagcccccgggagcgcgggactcgggtgctagtcccggcgcccagccacagcgacacagacctgggtgccggggcccgccagggagccctgtgatccggggacctccgcgatgcagagaaccagggaccgcgcacggagcccaggcgcgcagtctgcagccaggaccagcctcccgcccccgccgctgaagccgccccgagctccacgcctcccccgctgccgggctcggctgccctagggcctcgtccgcccgtcccagagtgagcgacctccgactcacggagaagcgaccttaccaccggtgcccgacacccagagctaagggagcgagaagaaggcgaagaaagaggcggagagcggtgcactgccttcgctgggactcgcgacttccagaaaccctcccgaaacccagtcccgccgccgccccgccggcagggggcacagcgggcgtccggggcgcggcggctgagcgatggggcgagcggaaagggcccagacgcctggttcttgttcatacctcggagaaagtcttgagcaccaggcgttgggctctctggtcacccctctgactcttcctaccggcgccgagcctgccccactcctctcagccccttggccccgccagccagaggggcgctccgcgtccgccccgccccccacccacgcctcccgacccgacccgcccccccgaatccccgccccctgagaccccgcccccgacccgccccaactggccgcggcggcagccgagccgcgggagctgcgcgctgagctcgcggcagtacggggagcgcccgcccgccccgccctggacccaaccaagcgtcccgcggaggggtgcggccacttgggggcaggagaaagcggagtacgccacccctctagggacccaggaagcgaggcgagcctcaggtggacgcggtggtgtggaccacggcgatcagggcctttccccctgctgtggagacggaggtgcgaggggacgccggcggctccccaccttctggccgagtggccttctccgcctccggctggactccctcggggcgctccctccagagccgagtcgggctggccgggggcggctgtttggcctgagtgtcgtcttactaaagcggaacgccggaggggaggccactccgagagaaggcggtccccggcggaggtggcttcgtgaatcctgcagccccctgcccgcccgccactcgagacgccgcgcctcgtgggtttcacgctggatggagggggcgccgccga

SEQ ID NO: 10958 - DNA, 2144 bp, Homo sapiens
  source 1..2144: mol_type = unassigned DNA
cgcgtctggatgcgtttctcggattcggctccacacaagcctcagccctccggaccttgcacctcccccgcggatctcctcacccctccacccccaggcccagatctttccttgtcggaatcgccacgcttcctcactcctttacccccgccccactcggctctcctcttcctggtcctcatccggccaggctgccccgccctggtagttcccgagggtcgtccgaggctctcgtccaccaaccgcccccgtctggaagaatgcgcccgctcgagcgcactctcggcgggtgccaaagcctcccgcctcaacaggtgcccctgcctggccacgcacagctctgtcacctggggctcggacggagacggcgacaggatcgccccctgcagggcggctgcggctccgcacgcccccgcccgggtccccagagcgccaagggcccccgcagccccgccgccgcccccgctgtgccacactgcctttgtttccctgcccgcttagatgtcgcgaggctgacttcatgcaagggtatcgccaagttcgggcgctgacactgcccacctacccgtggtggcggaccctaaggttgggagtgagagacgcgtacagtgcgagacctctcctcaacccagagaactccggggaagctgggtgtccgcgccgaagaagcgggttcaagttgacccggctcagaagggggttcgaagccaggcgcagcgcctagagagccttcccctacccacgcccccacccgatgtcctctgcccccagaaggctggagaggggctgcgcactgccacctacgcgctcggctgcgagtggttcccaccgcccgctcgccgcgcgctgggcccggcagccttccggggcacacgaggctcccgcagcccccagactcccggccccggcagcgcagagccgggagagccgccacgttcccagccgcgcgcgcacgccgggcccaccaaacttgcagcactttctcccagcccccaccctctgtcaccctcccttagtcggtgcgccccagccccgccgcccggcagaggttgccataacaacgggcaggaatgctccaacatatacaaagccggcccggcgcagcgggcactcagccctggccgggccccgcgccctcggccgccgcgcagggtctggacgcgcgccgcggctccctagccggccggccgacgctcggggcgtactcacaatgagcgggatggtgcggtcctcgcggagctgctccgacctcctgcctgccctctgcgcgccccggccgccggaggatgctgcgtgggctcggttgtcctgccataagtagtagaaagtgcccaggatccaggctacggtcaggatggcgatggcattggcgcggatcttcctcatggtgggcagacgggcgccccaggtgggggactgggccggcgtgctctcggggccggggcgggggcgctcgcagccccagctgtttgttttcgctcgcgcctagctgctcagtcctgcagagcagaaaaaggagagaggtgggggggcgggggggtgatagggagagacaggatcgcggagcgatcctcacggtcctaatgcccttcagccccgagcgcgcgcgtcccccgggcgcccattcattcgtgcgcagggccggccccgcgctccagccgccgccggctgacccaccaggccactgcgcactgggagagaagcgcgccgagtgggaagcggcgcgggccttcctcccgcgcccgggaacccggcgagacagacgcccgcggcggaatggcgactggccaaagccagcctcggctcccaccgctaggtgaccgaacgcccggcagctgcccccgcgcggccctggtcggtcctgccgacccacacccacccccggaccgagcggccttgagtcaccgactggagacgcgcgacccccgacctgggcccgcgccgcgagctgcagttccgggctgcgctctggcgcgggattcaaggtgtgttcggcgagtccttgtgtaggggcggctgggcgggggagagtcctgagtttgtactggaatctgcagctgagattagccagaccgggcccgcccagaggagggattggaagctggtgcacttgacattcgaagagcgcgaaggggaaacgacgc

SEQ ID NO: 10959 - DNA, 379 bp, Homo sapiens
  source 1..379: mol_type = unassigned DNA
cggtgcgggctcgcctcctcccagcccagcttccctgacatcgcccctttcctggggacgttgcctgcgggcccgcgcgtccccgcccccgactcccctgcaggttcctccgggggccggggcaggaccgcactcaccgaggacccgggcgctggagccagcagcagcggcacgagcaggagcagccgcatctcagcctgcgggagacgcattgggttagagcggcccggggctcccgcagctgtcctgggcgcgggcgagagtgtgtgggcgcgtctctccctatggcccacaggtgaccaggagacccgcaacaggacagccgggtgcgcctcggtgcaccgcagagaacacagcgtgagggcgccccgccgggcgg

SEQ ID NO: 10960 - DNA, 637 bp, Homo sapiens
  source 1..637: mol_type = unassigned DNA
cgccgccccactttcaacaagccgaagcctttgaaggaggctcggtgccatctcggtgtgatcgcgtcccggcgacgctgggtagggtgcagggagccagctcggccgcggctcagcgggaggggagggggccggtcccgaacccgggcgcccgggccgcgggtgattcactgggaacgccaggttcgcgcgcctagaccggcgggcgacgcccagcgcgccccacgtcccccgcccgggccgttcgcgcagaagcagcccccgcgcacccctgctccccgagacggacccgtcgggaaggagcctggagtcgggcggccggcgggcagcaacctctccctcctcagccaccatggccggtgcgactccctacccgcgcccgcagacggacttcctggaaagcaccgggctgggcttacctgactggcgcccgcaggggccgccgacctcttcacagacccacggaaactgccggccgcaagccgaggctcggttcccagcacccgccggtccgcccgcgtcggcctcccaaagagttgccagacccacccgccagcagctccctcactcgaccgccctgtaggtgcggtgggttcctccttcgcctccgacgcgcgtgcgcactcccgtgccgcgg

SEQ ID NO: 10961 - DNA, 959 bp, Homo sapiens
  source 1..959: mol_type = unassigned DNA
cgggagtggggcgggcaggaacgagggcctgagcccaggaccgcaatccccgtgaggggctcgaggaccccagcccaacgccccgccgggccccgccctcacctcctcctccatggcgagtccgccgaggtcccgccgctccgccactcgcttccagcgccgcgcgggctctgccaccgcgtctacgcccggccaggcggcgactctccgcgttctgtcccgccggctgccgggggcccaagaaacttcgggggggcggggccgggggcggggtgaggcttccgggggccggggcggggccggggagggggcggtggggccgggggcccggcccagggcgggaaatgggtggggaggggcggggcctgggttggagactggacggaggagccgggcggagatgcaactggaggaagagggcgggacggggcggagaaggtttcccgcatcggcggagggagagggactaggagggggctgcggcgggggaggagagggggcttccggcccagagactgaggcgagggtggcgggagcggcgcgcaggcagggctggggtggggcgcacacagtgagcgctgggggcgctggcggtggagcctttgaggtctcccgaaccagtgggctggggttgcgagaccgagccgagctgccctgggcggccagagatgtgggcacacagaggctcctcctctttcctccccgacgccgggcagtgggcggtggcctggtcttctccctggaacctctgggcggggccgggcctggagcttgggtctctgtccggagggtggtgtcacaggaagagctggagctgagagtcgggactccggggtccctttagggggcggcccgcccctggctctcaggggtctccaagcgcagtgttctcctgctctccttgggcatcgctcaatccctcccgtatctgagggtcgaccatccccccgatcccgcgg

SEQ ID NO: 10962 - DNA, 826 bp, Homo sapiens
  source 1..826: mol_type = unassigned DNA
cgcccatccctgcggcgccgtgaaagaaggcgcaggaggagggagccctgacacctcctctcgggctggggccccacagcggcgaaaagacggagggagtgatcgggggtcgcggggatccttccgggacgggcctccgtcggaggagctccggaaagccgccctccacctccgaggccccgcctgcgcgggcgctccactagcggtcggggtggtggcggcggcggcggcggcggcggcggcgcggggcggggcgccgcgacccctgtccctcccctgggccgagcggcaggcgcgctcgcaccgcccccgccccctcgtcgcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggtaggcgcggcggctggcccgggaggtgggccccgagggggcgccgggccgcgcgcgagttcggggcgctgactgcgcgcgacaactcctcgggcagagggggttgagtcagccccgccgccggggaagcagctccgggccgagcccctgagtcagaaccggcccgtggaggcagccggtgccccagcccgcagcttcgtcgcccaaccgaggctcccagggctggcggccgg

SEQ ID NO: 10963 - DNA, 2156 bp, Homo sapiens
  source 1..2156: mol_type = unassigned DNA
cgtccgaggaaccggcccaaccgctccccgctgcagccggcttgtccctttctcggaactaccgagggagaggcgcgtgcggaggtcggcgttcggatctcgcatccgtcactgttgccggcgcatttcctcgaagtcttacctcgaagggctgggtcccacccgcgcgccctgtgcgtgtctccctgtttccccacgccctccttgcctggctgctgcgaggctttgcaggggaaagactggcgcggggttcgcaccctgcccatgtcacaggaaaaccgtgggagcctccccgacgcggcgcatttccggaagccccctctccaggagggttgcgggaaggccgggactctgcatccagacgaacccggtcgcctcccaagaggaaagtcggagacccagctgaggggcaaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccgg

SEQ ID NO: 10964 - DNA, 1441 bp, Homo sapiens
  source 1..1441: mol_type = unassigned DNA
cgtaaggaggaaaacgtggaatcgaatacagtagctgcgggaccgcaccacgtgatcctcctcccgcggtcgctccatagaatttgtgggaaggggggggagggggagtgtcgccgcaatcccgaggacaggtcagcagcccgcgggtccgactccagccggcgttcccggggttaccacaccccctcgccggcggggaaaccatactccttacacgcccgaagtcgccgccccctcgacacggctcgcccggtcgcacgcacacgccacgggccggcgcctcccggcacacgcgcgaaggccgggccccgcctcgctccccaccgactccgcggagcggcgaccaccggcctcaactagccccggaccccgggcgcgctcgggccggtcccctccccggcccagcccccgctaatcgggggatccattccgctgaactcgcccactcgggagggcgcgccttcgcctcactgctctacacccgagggcaacagcggtcgtaccgctcacctgggtcggggggctcctccctcgctctcggccgactgagccgggctggggccttcgaggaagcgcgggccgccgggcggctggaagtgggggaaggagaggagggggagggggtcgggataccgggagccgcctcctttctcctccgccgactgcggctcccgcaggctggccgggcgtcctcgcacactcgcccagtttctcacagcctcgcgtcccgtcagcttctccctcaccccactcccacacactctcactcccacacactcacacccggccgctcctcgttccctcactcgcctgccgcgcgcgcgcgcgaccccgctcacacacagcgcgcgcgacgccggcggagaccgccccgctccctcagaccgaacgccgcccgcccgcttgctgaggagcggcgcgcgccccggccccgccctcctggcgccgcggcgcggcgggcggggggcggcggccggaggagctgggggccgggccagcgcgccgagcactgccgagcggatctgacacctgcgtcgagagccgccctcccagctcctcgcccgcacccgagccatcgctggcctcgggggaagagaggcgatggatcgcgcgcggggagcgaaaagggagcgcgagggcgctccgaggacgcgcctccccacccgcccccaaaccgtcttcactgagaaagggaaacggatggggggggtggggggcgaggtttgctcccaactcgaaaccgcgagattagtcccttccgttgtacgccctccccgccctcacattccctgcttaggccccatcaatctgcgcctggaaccccgacacgagccccctaccccctcgggcgcagggtcctgccggcatcccgacgcctcccgcccagcccttccgccggccgccgcccggagtctccgcttacggtggttcctccctccgg

SEQ ID NO: 10965 - DNA, 734 bp, Homo sapiens
  source 1..734: mol_type = unassigned DNA
cgggccccgcccgccctgtctgcgggccgactccgcgacgccgaccggctcgcgcctccgcccccgagcgccccggcgggcggagttgcgggtgaggggggggctggtttggggggcgggggtcccgatgacggcatcggagcgcgccgcactggggatggaaacctgactgcctggcccgggacggcgcttgcagccaggcaggtgagtgtgggccggagagcgggttaggggcgaggaccgggtgggtggagggaggcgcgcgctccctcctcgcgcaggcctgggcctagtggccctgggagccggcactcctgggagacctgacccggcatgaggagcccggcacccttgctccccagcctcctggaagctcttccttggactggccggcgccgtcttcccgacatctgggggctgaggccggcatcccgggcctgcgtggaggggcgagcgccaaggctgcgagagtcgggtcccgatttgtaatcacttcttccaactttcatggagctccgtcccgcgcccgccgcctccagccccagctgccctgccccggctccgaatagcgcctgcggggttgtcagagcaccttcggagcgggagcgctgtgcggagagcaggggcgcgcggaagccgggactgcaccgggctcggaacgctcacgcggaggggtgcgcgaaggcccacacggtattgcgaggcagagtttaccgctgtgtgcccagggtcgg

SEQ ID NO: 10966 - DNA, 935 bp, Homo sapiens
  source 1..935: mol_type = unassigned DNA
cggcggtgtccagggggagagggtcccagcgccgccgcttcccaagccgacccgtccgcacctggtcccttccccacagggctggagcctggatgaagtcccccacccctgccagaccccagccggggggtcggcgccgcgaggtccccatgcgcgcccccaaagttgccgcgggggaggggctactccccgcccggggctgagaccagccgagccccccgcccctgcccggcccgctcacctcgggcgcacagcgccagccggagcagctccagcagctgcgcccccagctcgcacgcgtccaggcccagcatggcggcgcgcggcccgggcgccgcggagccgccgaggagccgccgcccgccccgccgccgccccgctcggcgctcagccccggcgcgactgcggtgagctcatcccggccgggagcgccccccgcgcccagccgcgcccggcagagagcccccagccgctccggaccccgcgcagccccgcagagacgcgcgtgtcgcccgcacgggccggcacccgggtcgcccccgccggcgtgccaggaccccgcacagaagcgcccggacgcggacgcacgcagccgcggtcacgatccccgccgcccgcccggcccgtgcccggctctggccagcagggctgccccacccccacggcgcggcgggagcccgagggggtctcctgggaaaccctctgcggggcgccgtggcgcaggtgcgcccccatccccagggtctcattatccgcggccacacctggggccggaccgcgcgcccccttcccctcccccgctcctgagggagcttctgtctgggccgagggggactccgggggcctgcccagccttggggtgaggggctggcccaacaccctacaggttcacggtcatcagtagggcgggaccacagtgggcgcgggtcgcacgc

SEQ ID NO: 10967 - DNA, 1054 bp, Homo sapiens
  source 1..1054: mol_type = unassigned DNA
cggggtgggggatattcgggctgagtcagtcaagccgggagtgtgaggagcagcgggggccggcaggaacgtggacgcgagattggggagcagtggggctgcctgtgcggggatgcagctcccaccaagcacacgggtcgagggctgaccacaggcagagcagcgccttctggcagcgctgcgggtgtggatgagggaagccaggccccggacccatacccagacggccgctcctcagcctgtcccctccctcctgtgggctctcaaagtgcggcttggtttctccatctcgaccctgaggcctggaggtggggacgggactgtgggcgccggcaaacgtgagctcccgagcggggcgggaaaggagccccgcgaatgcctcccccagccccggcgctccacgtgcaggcccatgactgggagcgttttcaacctaaatcggcactgcgccgggattattcctcccctggcgccgcccccgccgcctcctccggatccttcccggcttctcccccactcttcgcccccggggcccctccctgctgagcgggggctgccgggatttgggattgcggggctgccccgaccccgcagccgtccgcggtggaagccagcccgggcctggccctgagcgcgcggctggggcggccgctgtccatggtgctggcgcgggtggcgcgccggccggcggggtctgcggaggcccaggcgtccctggcggggaaggcggcgcttccgggtctggggagcgagggtccccgctctaggggcacggaggatatttagactggggcgcccgtgggcctggtgctgccgcctcgggcgccggcatcctgcgatatcccctctccccggctctgggagggaaccgaggcagccccgcgccaggcctccccggacacctggggcaaattcgctcctcagagcctcgtgttccttccccaaacctgaggtagcgacccctccacccctaagggcggccgtgaggtcgaatcatgtgccgaccccagccggcccttgcaaacgttgtgatgtcggcctccggaggccgcgc

SEQ ID NO: 10968 - DNA, 1474 bp, Homo sapiens
  source 1..1474: mol_type = unassigned DNA
cgccagcgccgatgctgctgtctccccgctccctccacttccacacactcccacccgggtctccgcgggctctccgaaccaagccctcagcccagctttcccaaacagcccacacagcgacacgggtattgggcaactgtaaccagctccaaccggaagtacctgcctgtgggtgagacccacctgaccctcggggccggccgccataagggcgagggctgaggacctcccgtgggggacatgggctccccaccagccggaaagctccagcgaccggctgggcgttcctgggccggacccgcgccgccgcccgcgcactggggccttcgaggtgtgatgtcacctgcccgcagaatcggcccccctcgcgccgcccccctcgcgcccccaccccagcctccctctcgccgctcccggggctaatatggcagcggcgccgccgccccacccccgcaaccgcacgacccggctggcagggccgccggcccggacccccgagactcacaccccggccaggcccgcacgccctgcgccccggacccccggcggctccccgcagccctcggggcgccgacccccgcccgctgtcacacgaggcccgggcgcccccgacagctcgggattacgtcagagtgacgtcacacaccggaccccggcgagctgcgggcatgagcaacgcgcgcgcccccgcccccgagtccctcccgccgccgcgctcaccgctgaagaccatggcggccgaggcgcccatgacggcgaaaaacgaagcatactcggggccgctcttggactcggacatgtctgcgggtggggagggggcaagctctgcgggccgaggcggtggcggaggcgggggcgaggacgggccgggcacgaaggtttgcgggcgggcggcggcgaaggcgatccggcccgtcagccgctgcgctctaaataccagcaccgcagaacaaaatggcggccgcggccgcgtcacatgacctgggccccgcccctgcgagccgtaccacttcgcaccgtgggggagacgcgtccccgggacgcccggccggcccgttgacctcccccgggctgtgccgcccgcccagcgacccggccccggcgcccggccccgccctgcctcggcctccgcgggtgtttccgggcgccgccggcctctggatctccgcagcgttggaccggtctcgcgccggggcggggcggtgtggtgtgtgcttcattagcatacggggcggggcctcggacgccccgcctcctctgcggctgcgcgtcgtctgcaggtgttgggttcccggcgacgcttttctttgtacccctggcgtgaagctgcaggccgtggtttcgcggccttgcccccaagacggggcctcacccctccgggcgctggtcttccaggatctccctaccaatcctgggcgagctaagggtcccagcagatgtgcggcgcgcgggcctcctctgccacagcgtccgg

SEQ ID NO: 10969 - DNA, 357 bp, Homo sapiens
  source 1..357: mol_type = unassigned DNA
cgggagaccccgagatccccggccggtgacagcaggcgaccccctgctcctgtcaacctgtgggtccctacggacgtggggaagggaggagggaggccccagctccctgcgggggaggggcgtgaagacgcgcgggggtggggggagatgagccggcgtcgccatgacaacgaggccggtggtccggccttggggacccgggagggagggaggcgccgtggccgcgcgcgcgggcgggggcggggggccaggtctcccaggagtagttggggaacacccggcgattctggcggctgcttcctggtggcgcagggagcccgcgtgtttgcgagtgcgtgtgtgtgcgaagttctccgg

SEQ ID NO: 10970 - DNA, 814 bp, Homo sapiens
  source 1..814: mol_type = unassigned DNA
cgccgtccaagagcctggggccgtggggggcggggctgcctgctatcggccccgccccgccgacaggacccgcctctctccccaggcccggcggggccgaccccgcctctcgctcccagcttgccgtacgacagcggcggcgcggcgggcggagccgggaggcggggaagcagtggccgtgtgagcgtgaggagctgccgccaccgcctgctcctcgtcctcctcgtcctccggggccccagcgtcgtgggccgcgcacggccctggaagagacgtcgcctcgccttcatccgcctctctcaccgcgccgctccctcgtcctgccctgcgggctcaggcggaacccggaacggccgtcctcttcccccgccctccgccgccgcctcctcctcctccttctcggcttcctcctcagccccgggccggagcggggtgtcggcggcggccggttcgggcggcggcgcttggccatgtcgtgtcggggaaggtaatgagccgcagagccccggggtctcggctgagcagcggcggcaccaactattcgcggagctggaatgactggcaacccaggtgggtgaccggcccgggaccccgccccgacctcccgggctccgcctcgggcgggccgaggcctagggccgcggggctgggaggcgcggcctaggccctccacccaccggagccgggcgcggcttcctgggtctcctcctccccggctaggggaggaaggccgcggggaggcgaggcctaagtgcctctcccctccctgcttgttcagcccggggctgaagccgagccccggggctcccggcgg

SEQ ID NO: 10971 - DNA, 847 bp, Homo sapiens
  source 1..847: mol_type = unassigned DNA
cgtggtgagacaccgactccgcagagcagagggggcggcggcagaggggaagggtccccgcactcactcttcttgcaggaggtgcatttgcatccctcgcacttgcaggagtccgcgcaggtgcaggagccacctagagagggcgacgccacaggaagggttaatgtggacgaactcgggtccccacgcctgtcacgaggagatggggtgccaagtctccctgttctccgcgacacaggcatgcccgcccttcacgaggtgaagaatagggaatcaggggcccttcccccaagtgtccttgagcgaaggcgcagggcgtgggtttctttgcaggtacaagggcgcgcagtgcgcaggatgcgagcgggggcgggggctcaccagaagggcaggggcaggtctcagggtccatgtcgaggagagcagcagctggaggcggtgaacgggcttctccaagcaactggacgcgcggcttggctagtggcagcaggtggcgatgcttttatagcctcgggcgggggcgcgcatgccaagcccgctgggcgcccgcccctgcgcaccgcgcccgctctttccgtttgtgcgcttgggctccggcgcacgcactgcatctgtcgcccgcccctgccgtgtgtgtgcactgccggggcccgctcgcccacgcccgcgcgtgcgcccccactcccaccccgcatccgcgtgcacgacccactcgccgccgctgtgcgcgcactgccagcccactccccgcgtgggtcccgcaggggacgtgctcgccgcagcagccgccactgcgtggaagcgcgcacgtaccatctccgaaagtggagaaaaaggcgctttgcgt

SEQ ID NO: 10972 - DNA, 589 bp, Homo sapiens
  source 1..589: mol_type = unassigned DNA
cgtgggtgctccggaggaaacggccgcagccccaaatctcctagtctctctagcagggagttttcccgcggagtctcgcctggcggccggaagccacctcaagccgcccacccggaagccgtcgtcttggcaactgggtatcgtcccacccccttttcttagcaacgcctatcgccttagacgtctgaggtcagccgagcctcgattggttcctctgtctttcactctgggagacgtttgagacccagcgtctctagatctcgtatttgaatttgtggcgcttggtgtccgcgagttgccgaatgaagctgagcgtctcagtggaaccagggatctcaggggtgagcgaccgcgaggggagagcgacgaaaagggcggccggagctggaggggcgcggagttaaacaaaaaagggcggccggagctgcaggggcgccgagttaaacacgtcatttccagatggggggcttcaggcgagctgcttagctcccctgaggcaggccctccgtctgttcgccttttcgtagcctctgagtttttccctcacgtcgttttccggcagtcccagagacgccacgcctgcccccgt

SEQ ID NO: 10973 - DNA, 848 bp, synthetic construct
  misc_feature 1..848: note = Description of Artificial Sequence: Synthetic polynucleotide
  source 1..848: mol_type = other DNA
ayggggtygtattygagtyggyggagtatttttagggagggggygggaggttttttttgtttagtttygagtyggtggtgtagygttygttttyggtygygggygtagattggyggtygttttygggttaygtggtgygygyggygggygygttygaggagtttgyggttgtttttggtttatagygtttygggygaggagagygggyggaygtygggggttgggtyggtgygggyggygaggtaggyggaygaggygtagagatagyggggyggtyggggygyggtagtyggyggygtyggggtygyggtttttgttttgtygtttttttygygtyggattttygygtttagggygtayggtggagagggaygyggyggagtyggtyggtagttatggaatyggtttttttygtyggygtygagttgtagttttygtttttygttaaygtttyggaygtttattttagygtttgttttagygttggygttaatgygtyggggtygttaggygygyggagygtttygtttttygttttggtaatygttattatygygttttattyggtygtgtgygtygtggggttgttgggtaaygtgtttgttatgttyggtatygttyggtgagttygttgygggtyggygtygtagggttggagttyggggtgagggtggggattaygaatttgagattttaagttygttttttggatttttygygttttygtattttttgtaggggtatttggggtttagygagaggygaggttatttatatygaggggaatataggaatgtgtgttatygtgtgtatgtgtgtgtgtggtgygggggggggagtgygtygyg

SEQ ID NO: 10974 - DNA, 1230 bp, synthetic construct
  misc_feature 1..1230: note = Description of Artificial Sequence: Synthetic polynucleotide
  source 1..1230: mol_type = other DNA
aygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygttyggygtyggagttatgatttttygtygatttaggaagttgtagtagaaggaggaggyggyggttatttyggatttygtygttyggattttygattyggaagtygygttygtygtttyggtttygatttygggattttttgtygtagtygttatttttgggtttttagyggaygagttgtaygyggygttggaggattattattttgtygagttgtatygygygttygtygtgttygggggtattttgtttygtygaaaggtgygtttttygttygtttttaggatttgtttagttttttttygattttttatagggtttgttgatttygtagtgtttttttttyggygttygyggagttttttattttttttttyggttygttgggtgtttygatttttygygtttttygttgttgygaaggtygtggttttygtttgtatatygygtttaggttyggtggtttttaatttygygttttatgtaygttttttttttttttttttgattttttttagtatttttttttttttattygttttatttggttttttgttttttatgtttygttttttygtggttaggtgttttgggtttttaggagtttttygttygagggatagagatagttttaggtaagttgaaggttygagagttttyggtgggagaagygggtyggtggttgygtygygtgygtttttattttgaggaagtgygtggggagtygttgatttyggatagtatattttttygaggggatttttygatttttgggttgggggtttgtygtttggttttaygtttgaygtayggggygygagggttattgttttttggatttttgtyggaatyggaygtagtgggaggggtygtagggygttygyggggtaggaaggatgygggtygyg

SEQ ID NO: 10975 - DNA, 1094 bp, synthetic construct
  misc_feature 1..1094: note = Description of Artificial Sequence: Synthetic polynucleotide
  source 1..1094: mol_type = other DNA
gyggygttaaaaatagttggggggagggtgygggggyggyggagtttgtaatttaagtygttttagttttyggggggtagatttygyggtygtyggtyggygttyggtttttttagtattyggtttagggttggagttggttgtagggttggttygyggygatttgggtagggtggyggttgttttttttttttttatttygtttygaggygtagygygyggtagagyggttyggtgttyggygggygggyggttygggygggtttgyggtygggatgaggayggygttttygttgtagagygttggggyggygygggtygggagttygttggyggyggtyggygtggygggyggagygggtttyggagyggaggtgagtgyggatgygtygtttgggygygygyggtgtttggggatttygggttggaaygyggggygggggtgttatygggttgygygggggttttyggttyggttttygtttttgygttttygggggtygtttttyggyggggtyggatttttttagygttygyggygttyggttyggttttttygatttttttttttygggttyggaygtgyggggtagygagygtyggggttyggygggggtygtagttttgttyggagyggagygttggtagygyggggttyggtttygtgggtagtttgggaagygttygggtaaygtattggygagggtygyggagygaggggttyggggagygggattttygggyggggttgyggggagyggggttygggtygttttatttatygyggatyggagtygggggtgttttagtygtgtygtygtttttttygggtygttygttygggygtgttggtttygyggygtttygagygyggtataggtttgygagtyggyggtgttagygtttyggaygggggtgggagttttggagtttattttgggggagattaygtygtattttygtttagtttygygtatttttagaggtttttgtagagtygggaagttggttggaygtttagattygtggggaygyggygtttygygtggyggyggtyggaagggaaggttaatggggttygggggattttygyg

SEQ ID NO: 10976 - DNA, 1979 bp, synthetic construct
  misc_feature 1..1979: note = Description of Artificial Sequence: Synthetic polynucleotide
  source 1..1979: mol_type = other DNA
tygttatygttatygttttttttttagttattttttatattygttygtttattttttttttaatattttttatayggttgttygtatttttgttttttttyggtttaygygygttttttgtaatttygaygtttttaggtttttagttygtttttttttttyggttyggagttygagagtygtttgtttttattttaaaatagygataataatagggaygttgagaataataattaygattagtayggygaaggygtttttttygygggttagaggtyggygttttagtttygtagaattyggygttyggttagygttttttggtagtttttttyggtagttttaggtttttaagatttgtaggttygtttygaagtttttygttygttttttayggtygtttygagttttygaggttygtttyggagttttttgttygttttttayggtygtttygggtttttayggtttttaggttygtttyggagtttttaatyggttttttagagtygtygygggttttyggttatttaggttygttyggagttttygttygttttttayggtygatttaagtttygtygattttttaggtttttttyggagttttttatgggttttttayggttatttygggtttttaaagattttyggttgtttygaattyggattygtaggttygtttygggatttattattggttttttaygatygtttygggtttttaaagattttygtttattyggtttygattttttaggttygttyggaggttygyggygtagtttygtygtyggggaaggtttgtaggtygtaaggtygygygaatgtttygtgttygtttygattatygtttttagattagyggygttttttatygtgtttygagggttgygyggtttygygayggtttagyggyggggygygggygttgtttatgtagttygyggtygygtttttygggtygygyggttygagyggtaaggyggyggyggyggyggygygggttygggttyggtagagttgygagggayggygggaggygagttygtttttygggygygtttayggttygggygagagtygyggttttyggtgyggaygttattgatggggygtttggtygygggttyggyggyggygttttttyggttggggttttyggtttatygygtatygttttagggyggtttttggttttaggatttagyggyggttgyggygggagtyggtygtatgagaygttttygtttattggttygtygtattygttatygttattggttygtttyggtyggtygtaggggttgtgtaygttatagygtygtgagttagtgygttaatggagtgaaggagagaggygggattgatagtttttttggyggttyggaggygggattaggaggaygtttyggtaaygattgggtagggttttgygtaagggygtatgygatattggaagtagygagtaattggattggttgttttygtygtaaaggagggtgggttttgtattttygggtttgaygattggtttttttaagtgtyggaagtaatagggatgtygtttggaaataaaatttggtattgaagygtagggagataaaaygtttatttttagagtygaggyggyggttgtttgtygygtgttygtggttttttgtttgttttyggatatttygggttaygttyggttyggttttyggtygygttgttttaaygggygttayggggtatgaagagttttgggyggttgygaggggagggtatyggggtagyggggyggtygttyggggttttygygyggtgatttttgttttgtygtygaagagaayggttttygggygygtygyggtygyggttttagagtttttgggtttygygttttgagagtttgagtygtttgaggaggttaagygtttaygaatygtattttttgttttgttagttagttttttaataygygaaaaaggtagayg

SEQ ID NO: 10977 - DNA, 1930 bp, synthetic construct
  misc_feature 1..1930: note = Description of Artificial Sequence: Synthetic polynucleotide
  source 1..1930: mol_type = other DNA
tygtttaggtagygygttgtttygggtttyggtagggtggggattggtygygaaggttagagaaggtaatggtaggggaggttagtttttgtygygggtyggttgtagagyggaygtttygttttgttttyggtttttttttygttygtygggttygtygtgtygaataattgttgttyggagttttygtgaygyggagttttaattgttgygattyggaagaagygaaaaggagtttttttygtttygtattttgagygttygggygtgtaaaygtgggtggyggagagyggttgttttttttttttttgtttttttttttttygyggygttttygtgtgtgygggtgtgtgagtgygtgtgtttttttygtttattttygtataygtttyggtattagtgtaggyggygagtyggyggtttttygttygttygtttyggtagttgygttttygtttygtttygtygtygtygtygtygtygtygtygtygtttttgtagtygtagtygggtatggtgagtgagtgaggtttagtygtygygygttttttyggttygtygtyggattttagttttaatyggtttygttttagggagttagtttgyggygggagygygttgyggggtygggyggttgggggattygggyggtygagttgygtttggaggggyggttygtgygttttyggttttaggygygtagggtygygggatttygttttgggagygggttttaygtttttttyggtttygagttttttttttygagggttgygygtatttttttygttygtttgttygyggttttttttttgttttyggagygttagtygttttatttygtgatyggtttttygttttgtttygtaggattygttyggaygggattaygtygtygtygtygtygtygtygttyggagtygygtttygggttttgtttgagtygagtygygygyggggtygtagttatygtyggygggggatggggttgtttaggaggygygtygagttygtagggggagygyggagtyggygygtagtttgagagttygagtagttygygtygggtyggttygtgygtatygygygtygtygtygttattgtygttygygtttygatggygttatygtttyggagtygttgatygtttagygtttttagttyggttygygyggygggtttttygagttyggttygtygggggagyggtttgtygyggaagttttttygygttttttygttyggtttygttatggygttgyggygttttttgttgttgttgttgttttygttggagtttttggatttgttgtttagygtttayggagttygyggtygygtygttaatyggattttgagtgtaggyggygttgtygtygggggtyggagggtygggggygttttggtayggggyggtygygagttgaayggtatygttygggygttyggaatttyggaggygggaagtyggygggggtagttygyggyggttgtggyggyggyggttagygyggtygttatttaygagaygtgttggggttattaygaygtgagyggttagtaygataaggagttygagtgtaataatagygagagyggttatttgtattgttgyggtatttgttattatygtttttgttgtaagaagygttaygagaagttggattagygttagtgtattaattattagagttyggtgtgggtatagaygtttagtattaaggtggtgtygtyggggttygagaataagtaygattyggagaaggataagattaattttatygtttatattatttgyggggtgatygttttygttatygtggtyggygttttygttaaggttttttaygataaggtttatygttttttaygggagatgaatatttataggtgagagygtygygtgtygygygtttyggttttttygyg

SEQ ID NO: 10978 - DNA, 3177 bp, synthetic construct
  misc_feature 1..3177: note = Description of Artificial Sequence: Synthetic polynucleotide
  source 1..3177: mol_type = other DNA
tygygttagtttyggggtttttattttggygggaagggtaggtygattyggtagattgyggtttttygggagggaagaaggtgttagaygygyggagtaattataaatagttttttttttttagaagayggtayggggtttaagatttaggygtygtatatttagaatgagagtagagattttygttaggaaaaaaaggtatttaggggatttgtttattagtatgaaatgtaaatgagttygttyggttttatttatataattttgtgtatggattyggygaaagggtaattagggagaygayggygtagtagttattttgttattttttttattttttttttttatyggtyggggygggaattgagaygattttaattttttgyggtggygggaggtgygygggggttgygtgggtggtgtagttttaggagagtgaataaygtttaggggtgatggttttagtaaagtgaggggtggtgatggaggttattygatttatttygtygttttttygtagtggygtaagygttttaaaattttyggagagggaattgattgatttattaggtttygtygtgtttatttttygtagatgttggggaagtgtttttyggygtttaattttygttgtttttttttttatyggygtttagtatattygyggygtttygttttygggtatttatagttttttggagtggygtyggyggtaggagagagttagagtygattgagttttagaattyggggaggtaggyggggtaagggtyggggtttgygygtgygtgtgtaygygtggaaagtataaatttaygagggttygttgtyggtagggttaaggtgagtgagtgaaggyggtagattygygaagttttagtttygyggatattttttttttaagttatatagggatttaagagaaattgaggtaygaagttggggggtggyggtggtggggattttgaaggtygagtygataaagtttagttttgtgttttygtttttttttatatattygagatttttataggtttttttttaggggttttygttttgtttygtagttttttttggggattygggttttgyggtttagygygatttgtttggggttaygtgtttaagtaygaagtttttgygtggagtttaygttttttaaaaggtttttaggggtaaagggatgaagtttaggagygttaatgtgaggttaggtttagygggttagggttaygaggttagggtygaagttttagaattgattygggagtatgattaataagtttaagagatttgtggaggttaygtttagattatgtttattttagtttttttygagtttygttygtttttttaagattgggtttttttagtttgaagttttatttttaggatatttagtttygtttttttttttttttagtttygtagttaagtttaattttagggtgggagattaattaggtggagatttgggatttygttttgggattttttggtgataatttttattttygtgtygtttgtttttttttttttttaggttygtttagagttgagtttygtttttyggttgttgtttaaattaggggtygtggataaaggatgtttggggtttgyggttttaygttaggatttygygtygaatattttgatttttygggttttttttaagggagttttaaagattttaatggttaataggaaagtgggttyggtttgggtagtagtttgattggttttagttttygggagyggatttaggggtaaggggaggggagaggggyggttttgggttttggggtgggaatyggattttagttgtggttttttttttgygttttygttygtattgttayggyggayggttaatgggygygyggttyggggtyggyggygttyggygattggttgyggggttgtttgggggyggggtygaggtttgaagttgaagtgagggatttagttgtggtgtgygyggggtttttygtygtygttttygttygttygtttygygtttyggtyggaggaggaggttgtggygtyggygatagttayggtagyggtagttatygyggyggttgyggyggyggtattttygtttttattttygttygggattgttttttattgttttttygtttttttyggatagtgagttygyggyggggygggggaaggagtygtttttattttttttaagtttatttttaaagagatttttttttttttttttygtygtttggygyggagtygggaygatgttgattttttagattyggttttagttgygtygygggaagagggggygttttttttyggattttygtttttygtygttgttttttttttygttygttttttyggggyggtttygtygaaggtagygtygaattyggtaatyggagtttgggygygaagygaagaagtyggaataaagtgagggggagtyggtyggttggttygggaagttttaggggygtaggggaagygggattygygtygggyggggtttttttgygtttyggygtttygygggtagtatgtttttgygggtagggggagttgggttgaattggttttttygggggtttagtttgygttttagagtttattagatgtgttttygtyggggttttygggttgygtgaggatattttttttgaggggygtygtttgttttttttyggatygttyggggtttyggttggttagaggatggaygaggaggaggatggagygggygtygaggagtygggatagtttyggagttttatgyggtttaaygatttgtygggggtygggggtyggtyggggtyggggttagtagaaaaggattygggtagygyggatttygaggyggaggggttgtygtattyggygttggtttyggtggtttttttttatttgagttaggatagtygttygyggagttggtgttttygtayggtttgtaatttatatttttyggggtaygayggttaggygyggggttagaagggggaygggtygtatygtygggggtygggggggaagaagatttatygttaggtgagtygaagtgagttyggagggtaggyggatggggggggggttgttagggaggggagggggtattagagtgggagyggagaygygagtaggtttygtyggtaattygggtttattttatttgyg

SEQ ID NO: 10979 - DNA, 2195 bp, synthetic construct
  misc_feature 1..2195: note = Description of Artificial Sequence: Synthetic polynucleotide
  source 1..2195: mol_type = other DNA
tygttagtttyggtygttaagtaaatattttttttaggagttygagaagtyggtgtgygaggggaggaattagtttgaggtttatygttttagtaatttygggtgatttatagagtttagattttyggttgtygtagatygyggtaggtaygtaaataagtagttygggagatattttttttttttttagttttygtttttttattttgttattttttagttygtgattagttgttttttttttttttygygggygtttagggttgagtaaatatttygggtygttygtttygttattagttggtttygatyggygtatygttggygattttttaggtaattyggygttatgagaatyggtatttygagattyggygttttgtttttttttygygtttttagggttttggttaggtttaataattttttttttttttgtgygttttagtttttaygggtttttggygygggttaattaggtttygttgygggtttttaggattgygtattttatttttygygaggttagtagtttygggggaaggyggtyggaaaattttttgtttatygggttggataagtattagtttggattygttttttaatttttgyggtttagttttagtagatttttggggtyggaggggaaagggtggtaatttatagatttatttyggaatagggagtggggggtggggttggtgggaatttgattttttggaaaggayggattyggagttagagttaaygtgtttyggagygtagaggtttagggggtygygttaaatattgtatttyggggaataaaatygtgaaggttaattaggataagtyggagtagggaayggggaygtygggaggggagagygygtttygagttgggtagaatttggaayggttataggaaattygggygyggggtagtygggtygagggggatttttgtttayggtttagagtggtttggattyggtttaygygtgagaggagygtttggtgaygattttaygtaygtttggtgattggtggaggttttagagaaggatygtgygtgtaaaaggygaatttyggtgtgyggtgtgtttaygtgtgtaagttggggaggggagggggygtagaaggygtgataaagayggattttgttttgagtgtgygtttygtttyggttygtttttagygaattgtgtttgaagtgtgttttaygggagggttaggaygaaggtgataaaggttaggtgttttttayggagaygygttaaggtagtttygygygtgttygtaggygygttttttggaagaygyggtggggggtgygtagggttgtatttttatattaattgtttyggygaaggtygagtttagaaagtgagtgygygtgagtgtgygygygttygtatgygggggygtggtagttaatagtaataatttataygtyggtagggttagaaatttttattttttttattagtyggaaagtaygagtyggtttagtttggaggtgagtyggggyggggagggtygggtaggttttgtttttgtgtaaayggagygtaygtatttggagygyggygggygttygattagygttttgaatggaggtgatgtaayggtgatgtaggttttagtttattttygtygaaagtaaggagttttgtttggggataggttygygygagagygagtaatttagygygtttggtttagtttyggttttagggagaggtaggttttgygtttyggttygggtttygttattttagttaggatygggtttggtttagygtttygygtygygttttttttattttygttygtttttygtttggggttggagttggttttaaaygttgygttggagyggggtyggyggygagttttaggtaagggttgttgttttttygtttygtygttyggaagagtygggtygggayggyggggagtgggygagggtagaggyggggggattggatattttgygggttggggaygtygygttaatttygttyggtygttgaaagtttttaaattygagtyggttggggattgggggggtgggggagttyggygttgyggttygggttggagggaggggaaattattttataatyggggtttttaagaggagtttttttatygtttgtttttyggtgggagttygyggttattttttttygtgggtggygttttttttgtyg

SEQ ID NO: 10980 - DNA, 2063 bp, synthetic construct
  misc_feature 1..2063: note = Description of Artificial Sequence: Synthetic polynucleotide
  source 1..2063: mol_type = other DNA
tygaggagtygtggaatggaggattayggyggygtayggagtatyggggaggaatygtggggtgygtaggygtyggagygttygggttyggttyggatygaaggtttgygyggtgaaggtgtggtgtttgtgtttyggggaaagggttgttttttygggggattgtttygtagygaggtttgttttgttygtagttgggygttttttggggagygattgagygtaagggygggtygggaggygygaggygagtaygatgttttagggttttaaggattygtgtgygtgtgygtgtgtaaagtggggyggtgtagggygtgtgtayggtaygggygagaygygygtyggtgygggygtygggygtygtygggygtaattatagtataaagttygggygtygyggggygttggttyggagaatttatyggaygygtagaatyggatyggtatttttttygttagtattttaaygyggagttatagygtttagggatyggagggtaggyggyggyggtaaaggatattaygtaagtttttaygtaattttttygagtagtgtaagtttttaggattggygygygtttyggttattyggagygygtatygttygtatttyggygygtttttygygyggtgtagggaattatagygygggygggtattaaggggaaaggaggaggygtggtttggtygaggagttaatgggtygggaggggygygygggggaggagtttaggtgtagagtgtygattggttagttygtttttyggtatgtagatayggtgggagttaygtgttaggggtygggaygattttttgttggaggttaaygyggggyggggaagggggygygagygtttygtttggttgaagyggggggaggggggtttttgttagttagagtaataagatggtygyggtggtagtttygtattttagygygayggtttygggagtygtagtygtygtygtyggtttygtygtygygtagttttgagygtygttygggtygttttttgatagggtagttttagygttygtygygttttygtygtygttatygtygtagtagtygtgggttygttygagtyggaggyggagggagyggagyggtttygygtttagtygttygtagttgttatygtygtygtygtygtygtttaggattyggatttygtyggagtygtatttygtygggygtgaggaggaggaygygtygyggygttgtyggggtyggatttggatttgtygggaygygtygtygtttattygttygygtygtygtygtagtygtygtygtygttygygtygggatttgagttygtggygtyggygttgagygggttttygtygttygygtattttygaggttttygggyggttgttygtgtygtygtygtygttaggttygygttatyggagtttygyggagtygtygtygtygtyggggayggagtttaggtgagygyggtagttygttygtttttygtygtagtygtaattttgtygggaggttygygggttttttgttyggtygagtygagtyggggygggygttggtttttagygattygygtgyggygttaggtttygggtyggtygggtttgaggggagyggygggaagyggtyggggtyggggygygtgtgtgttagtgtgagayggggttgtgtagaygttyggtgtgtattataattaaaygggagtggaatggagggttgaagatggatgtgtttttttttttttaaaatttatgtagyggtgaaattyggtttttttygggtagtttttygtagattttgtattggtgatggtaggygygaattygtygtgttttggtgtaggagttyggtgtygttgtttgggggaagagaaaaattyggggygtgttgygggtgggyggagaaggatttttgggygttttgyggttttgaaattaggtggattttttaayggtgttgyggattgyggagtaatgygtatgaggaaaaygagtygtataatatttgttttgttattagataaygtaattygagygtttggttgtygtttttgttttaagyg

SEQ ID NO: 10981 - DNA, 816 bp, synthetic construct
  misc_feature 1..816: note = Description of Artificial Sequence: Synthetic polynucleotide
  source 1..816: mol_type = other DNA
gygttyggagtgggaggaggggaggygttgttygaygygtttttttaagttttygygttttttttyggyggyggttgttygggggyggtggttyggygtygtttttttygatygttttttttagggtttttttttygtgtygyggttaggttgttyggtyggyggygygttggaaatatgaagagaygttgtagttgyggtggyggtggyggttattgtagtttagagyggygtatgyggyggtyggggygggaygyggggtygggygyggagaagtyggggygggyggtagagaggtygggaygyggatygggtyggggygtttatagtygttygayggygtttagagagygygygtttygtagtttygygtttagttygtygggtatggggygygyggtagtygtttgaagtttyggtttggttyggtygtattyggtyggaggyggagggtagagygygygtttagttgttygggtattaaatyggagygyggygtgygggaggttttagagtaggattggaaatgttttggtygygtygttttttgtttagatatttgttttyggtttttttgttttayggtgagttttygagggttattygagygtttttagtyggyggaggtagttygggygtygyggagttygyggaggygtygggtttggatygyggtayggtttatattgtttttttggyggggygggttygaggggagtttygygtttgtygttttagttttgggagagggggttttgtttatttttygaggtttgggatygtttttttttagggygttyggagttttttgttgyg

SEQ ID NO: 10982 - DNA, 368 bp, synthetic construct
  misc_feature 1..368: note = Description of Artificial Sequence: Synthetic polynucleotide
  source 1..368: mol_type = other DNA
tygttttttttatataggygygtygggaggtttygttttttggtygygygattygggtatttaygtttygygtagygtygyggtyggtttygygtagtagtattattygtattatttygttgtggtttatttgggaygygatttataggggygttgtttygttttgygggaagaggaggyggyggtygtygtgattggggygttyggttttattygtttatagaaygtttttaatattaggggtttgaaagygaaaatttygggaaggtattttttgatygtagattatattttgtagttgatttatatygtttaggaggtagtgagaaaagagggggtgtgtgtagtttayggaygtagayggtayg

SEQ ID NO: 10983 - DNA, 1411 bp, synthetic construct
  misc_feature 1..1411: note = Description of Artificial Sequence: Synthetic polynucleotide
  source 1..1411: mol_type = other DNA
gygggtttttatttygtygttaggagttttttttataattttgagaatyggggtgygaagaaagaaagggygaaagggtygtttaatttttagagagtagttagygaaagattygaggggttttttttygtaggatttygaataattgtagtatttttttagttygyggggtttattaaggagatttttataaataatagtatttgyggygaaggaattattttygtaaagggtagaagygttagattttattagttaattatttagaygygtatygygattygtaagttygggtaygtttygttygggygtaggtagygggaggggtygggtaygttygtgggggtggtttgggtaygggtttgattygggggygygttygggaggggtttgggtttgagtygggggygygttygggggagtgggttgggtttggggygggggygygttyggaggtgggggagtttggggtgggggygygttygtgggggtggggtggggtgtttggttyggggaygygttyggggaggygtggtttgggtttgggtygggggagagtygggtgygtgttttgggtttgygygggggagygygtttggtgtttagatgtttggtatygagygggtgggggaygtygggttyggagtyggyggtaagtttttttttggtaggtaataagttttttttgtagttttgaaggygttttggttagggttattttayggttygggtttttagagtttttttayggtttygaattygagtagtttttggtttttaattygtttyggaaaggtygtttttttttttaatgtgtggygygtttygatygttttttattygtggaataaaagagtagttttygyggagygggtttagagtttgttyggattgttygatggttttyggttttttgagygtygyggttgtygggttttgtgttygygyggggggygggaaggayggtyggggtttttagtgygygtttygyggagyggygygyggygttygaattggaaagttgtygtyggygtttgtygtttttaygtygttttagttttttttygyggggygttttatttattagttaggagattgggygtagggtygtyggggygggyggggggtttattttgtttttgatttttattgygttgtaatygtagaatygtaaggtttgagatttgtgaaaatttyggtttatggtttyggtttyggttagtttygtygtygttttygttttttaggggtygtagaaagattttygggggyggygtttttaggtttyggtttyggtttyggttygygttygtttggtyggygggttgttttyggtgttgygggttygagttgggttggtygygygttttagggattttaggggtygygygygggaggagygygggggayg

SEQ ID NO: 10984 - DNA, 1487 bp, synthetic construct
  misc_feature 1..1487: note = Description of Artificial Sequence: Synthetic polynucleotide
  source 1..1487: mol_type = other DNA
tygtttttgtatttyggggaygtgattttttttttaggttgattygtttttygttttgtygtttttaggtggaggaggagttgaygtatttttagaagaaattaaaagggatagaggaygagttggataaatatttygaggatttgaaggaygygtaggagaagttggagtttayggagaagaaggttttygaygtaygtgtgtagggatgygggagttygyggyggggttaggtyggagtttyggggtygggaaggyggggagagtygtagggggaggaggaagaggaggaggagaaggyggygttttttagygttttttttaaataagtttygaaaaggggtattttttagtagttgtggttagyggtgtygaygttaggtttttttttagyggtgttgaygtyggyggttyggtygggtgattttatygtttygayggtagtyggttyggggggyggggagaggygggggyggttttygygtaggtaaaggtttggggggtyggggygyggttgtgtagttttygtyggagtygagtttagtygagygttygtygttgttygtgygtttttgygttttygygttatggtyggttttaattttttggaggyggtgaaaygtaagatttaggttttgtagtagtaggyggaygaggyggaagatygygygtagggtttgtagygggagttggayggygagygygagyggygygagaaagtgagygtttyggtttygggtttygtattygtagttttttttttygygygttttttttttttttyggtttttygygttgttygttygygygtagttttygggtygtttttttaygttttyggaygtygatygtygatttatatttttgygttygtagttaggattttttatttttttygtygtttttttttttgggtttgggataggggagggggygtygttttygggtygggyggggtyggttaagygggaaatggggggatggggyggagggggtgagygattttygggtggagaagtggagyggygggagggggygtatygtgtaggtttygatttyggggttggygtyggggtttygggtygaggggaattygygatyggatttgtgggggagaatgaggatgaaaaygtggagtttttattgtttagggtttgatyggtygatagggatttygaygggggatyggggatttggggagggggtygtattttttygtttttttygyggtttttyggtttttgtttgtttttttgatygtttttaggggygyggyggygaygtgtttgttttaggyggygggggggatggggggtggaggaagtttagttttaagtygttygtttttttttagttgatttttgygggaatyggggyggygggattttgtttttttttagaaggtttygggaaygttggygyggggttttgaatttaygatygtttgagygtttgttgtgygttttygtygygagtygtagggttyg

SEQ ID NO: 10985 - DNA, 602 bp, synthetic construct
  misc_feature 1..602: note = Description of Artificial Sequence: Synthetic polynucleotide
  source 1..602: mol_type = other DNA
tygttyggttaagttattttttygttagtaggtgaggttygtgaatagttaagttttttttggtayggyggaatygtagtggaygygtggaggggtttygtagaggagggatttttgtttgggatgyggggagttgtagttttttatttgtatttagtttgttagttgtaygtttgtaggattataattttagtataaagtaggattgtagggyggtgyggatttttggagggagatagygyggtgygtttttgtyggttatgttggttggggtggtgttttaggyggttttagtygttagttatagggyggtyggattataattttagtatataaygggagtggaggtggtgattttgagagagggtttgtgttgtgygygtttygyggggtatgttgggagtagtagtattttagttgttttyggtygttggtygtagggttgygggattataattttygtatgaaatggaagagagggtggtgyggatagtttgaggaaggtayggatattttgagggaggtatggataygttgagggaggtayggataygttgagggaggttayggataygttaagggaggtatagtagyggtgygyg

SEQ ID NO: 10986 - DNA, 628 bp, synthetic construct
  misc_feature 1..628: note = Description of Artificial Sequence: Synthetic polynucleotide
  source 1..628: mol_type = other DNA
tyggtattygtygtattatagyggatgggtgtatgygggyggtgattygagttygygygggttgyggaattttttatttattaaygtyggygtygttatgggtttagggggttgggtgaggtygtgagagtyggygaggaagtyggttttgygggttyggtygatttygggtttyggttttgggttgygagggattttagttttygtygtygtgtaaaatgtatataaggttygyggygtygtttttgygygtygtgaggatatagggttgtygttaaggttttaggaagggttttgtagaygtttgtgggggtgggatygyggttgatataaaagygtgtaagtgggttttattttttttattgttygtttttattyggtttygaaaagtggtttttgtttggygttttatttagtgtagygttggtaattatagtagtygtaatttaayggyggaygaagattggaygtyggaagtttygtttaygtygttaygggaaygtttttttgygtttttygtttatggtttggggtyggttttygttttttgtagtattgttttttgggtaatgtagtttgayggaattygggtggtatttggagygtattttttgttttyggtgaggyg

SEQ ID NO: 10987 - DNA, 215 bp, synthetic construct
  misc_feature 1..215: note = Description of Artificial Sequence: Synthetic polynucleotide
  source 1..215: mol_type = other DNA
ayggagggaygggtygtgtagtgtagtyggyggggttagggttaggtygagggygygaggtggtagtyggttyggggaggyggaggttgagygagyggtggtgtttgtggagttgtyggttgyggtggaattatgaaaaatagtaggtatyggagtyggtttttagtttygattaggggagatgggatatgataggtgygattaataygtagtyg

SEQ ID NO: 10988 - DNA, 2638 bp, synthetic construct; identical to SEQ ID NO: 5981
  misc_feature 1..2638: note = Description of Artificial Sequence: Synthetic polynucleotide
  source 1..2638: mol_type = other DNA

SEQ ID NO: 10989 - DNA, 2172 bp, synthetic construct
  misc_feature 1..2172: note = Description of Artificial Sequence: Synthetic polynucleotide
  source 1..2172: mol_type = other DNA
aygggatgtyggtttyggtygtttttattaattgatttatgatyggtttggttagggygttyggtagygagagygtygtygygtygttgggaggtagygttagygyggggaagaayggyggttggtgatttagtatygygtttatggygaagttyggygttyggtgaggtaggaayggatggtaggttatgtttgttttaggaatgatyggattttttatggagaggtttatttattttaggyggggygttgggttttagtyggggataagttygtagttgttgtgttttgttgtttttttgttgttgtttaatagtagtatataatttaaaaggggggaaaaagtaaaataaaaaagaaagaaaaaagaaaaggaggtagaaattataattaatgtattttaaagggaggaggggaagtgttttttggagaatgggaggtygtttttaaagagggtaaggygaaaaattagtaaatatagtygygygggtgatygtttttgtgttttgygtttttaaaaagtygtttttgaaygtyggttttagaagygagaggagygagtagggtttygattygygttygagttttgtygttgagttygaaatagatattttagttttgygttttaggaatttttttttagtttttaggttttttgttgtaaatgtgaaaggtttttttagaagattttttatttttttttttttttttttttygttttttatttgttttttttttttttttttttgttggtggygtttgtagttgtgttagattyggttttaatagggagygagagagyggaaaaagttttttttttttaaaaaaaaaaaaatttgatttaaatttttttttattagygttattaaaatttgaattgtaaattggttttygttygtygtttttttttttttttttttgtttygagttttyggagggtgtttyggttttaatttaaattttgttgggtttttttttygtgttttttttttttttttgttttaaaaygtgagygaattygttttttaaatttgtgtttaggygygtagggtagggaggatttagagggggaaaaaatggaatagagggaaagagagggaggggagagagagagagagagagagagayggagtyggagagggagggagygagagaaagygagagtttttygttatttttygtygtttttagaatttatygggygtttgttyggyggttttagaaggtygggttgygttgtgggttgyggggagtyggaggttttttgattggttttttgaygttttyggattaattgtgttgttgtataggygtggtttttataggtygagtgttgggggatagagttgagttataaaaagaaggtgtyggaaattgtaaygtygtagygtygtatyggtattattgtttgttttgtgaatatgttaatatgattagagggygggygggagttattggggagygygygygtatagagtygtttttaggtggtttatygagagatygttgtagtttttgagttygttygttygttttggtttagtttaygtttgaaatgttttagttatttagtyggggattgagggaggaggtagggttaaggaggaagggggagggagagagggagggagttagygagtaggygagtygggyggggaaggyggagagygygttygggygtygggtaggggygttygttttttttgtatttygttygttttttygatygtygyggtyggttttttttttagttttttttttttttttygtttygggygagtygggygggtggtygagttttttygygagttgttattyggttattyggttttataaaagtyggyggtagtygagaagygagygtygagattttaggtttgygtgttttttagttttaygtggagttaagtttygttyggtygtygttgaagggttttygagttygggtgtttyggtgttggttttttttgygtttgggttgggggagtataaggatgyggttatattttagtataygtatgtgtgggttttttttttattgygttttattygtagttatgtgygggtatttaaatattttyggtgtatttgtattygaataygygttaatatattgggattgaaatatatatygaaaaataygtatatataaataygtatatagtttgygyg

SEQ ID NO: 10990 - DNA, 2548 bp, synthetic construct
  misc_feature 1..2548: note = Description of Artificial Sequence: Synthetic polynucleotide
  source 1..2548: mol_type = other DNA
tygggtgggtttygaaggygaggatggttagaatatgtttttygtgatattttttgtttttttttagggtygtgyggygagaggygttygagtattgttaatgtgaygygggtttayggtygtatygtggggggtagygyggygtygttyggggtttggttttggttggtgaggttgtagttyggygggtagtttttgtgyggyggygttttggtagyggttttttgggtgtttayggtagygtattgttttgtagggtaagtaggatttttaggttttgtttagttggggttttyggygttgggtttygtatttgtygggttgttyggygggygaygygygggaaaggtggtttttgttgttttttggyggyggtyggtttygggtttttttattttaaggygtygygttygtttygttaggatgttagttyggagggggtggtayggtygggygagttygttttttttgggaygggattttttttyggttygtttttygtgtttttaggtggagaaagttyggtatgygggyggaggggtagggttttygaggggtttgyggggtgtgtttttgttttttttgygttttagttgtygttygattygtagygtttygaatgagtttttgtggattgtgaygttggtagaggggtttyggggggagtaagyggaggaggtgttagtgaatygtattttgttttattttaaggtgagaaggtagtttttaggtttttaaggttgggtatygtatttttattygtgtttttttgattttgygtygtttttttttttttagtttgattygyggattttttataaygatttggttttggtgtagttgtggaygtyggtgagttyggggggatyggygygtttygtgtgtttgttttaggagttttaggagttttttgtyggaatygtttgygttatygygggttggggygtttttttygaaggtattgggygtgggtgagtyggygygtggtgggaagaattgggggttygaggtaatagagtgtagggaggtygggttgttttggaaaaatgttgtttgtttttttaaagggggaggaattaaggggggtggtgggaaggggatttttaaggyggggtttttgttttttaaatttgagttttttattttttttttgtagaygggtttgaggttgaagtagtgagagaggttygtgtttttttgtttagtatygatatttgtygaagagttttggggttygggttgygttttagtattatgttttgygtygggtatttggyggggggygttgattygtgttaggtatgaatttagtttgatgagaaaaggtyggttgagtttttttagggttattayggttttttttttttttaygtttgtttgttattygatttttttgagtttttttgtttttatttttaaaatggatataagtggtaagtttatatttgttaggygtaaggtaggygttatagggggtaggtgaatgtagygtttttttttttggtttygtagggtgattygggaggttttttgatttgttttgagtttggttttygttttagagaggttttgttyggagttattttttggggggayggttgyggggagttagggaagttyggggtttatattygygtggtagtgtttaaggattggttttaggagtagatgagyggtgagygttttttttttaatgtttygtttttagtgttttaayggataatygtgggataagttygtttttattyggtttatgtttatttttagtttttttttgtttygggaaagtttgttttttttyggggaaggagtgagggggttagggttttaaatagagggtgagttgatttttgtttygttygtagtagttttttttagtygygagtttagttgtagggagtttttggtttgggattttttttaggagttgtaggtagaygtygttyggttttgygttttttatgttygtttgtgttyggggttttagggygtttgtgygygtttggygtattagtagtgtttgtagygtyggyggygatgyggttagttttgtttattyggattyggayggggggtagaggggagggggtttggttagtttttgatygtygtttygatttttgttyggttygtagagttgygttygttggygtataygttgttgggtttgttgyggaaygygtaggagttgttygggtttygttygggattgyggygtttggttttygttttggtttttttygttttagygtttagggagttttttttgtatttygttygggagttgyggttttatttaggtatttygygttttttagtttagtttagttttggttyggttttattygygyggtatagttatttttttygtygaggyggtattttaattttgtgtttttttaggatygygggttgtaggtattyggttttygaagyggaggtyggagtygygyggagaagttaayggtaatgaygttttttgtygatttttaggaggggataggttgagggtttggaygaggtyggaagygtttttattgtagtttyg

SEQ ID NO: 10991 - DNA, 919 bp, synthetic construct
  misc_feature 1..919: note = Description of Artificial Sequence: Synthetic polynucleotide
  source 1..919: mol_type = other DNA
aygggagtygttgtagggttaggaygtaaagatttygaggttttttaggtygaggggaygtygttttygttttatttttgygttyggtaggtttttggtttygttagtatttgtygtttagggttggatttaygyggygggygggtgaggggtttttggygygyggttatygttygttttgtgttaggtgyggtgyggtagygggagygygyggagttygaattttgtaygtgtggtttygtygggtyggtygttgygagtttygtttyggtttyggttatygtyggggaggaygaygaygaygtggtgggggaygtgttggtattgttggtygygtttttggtttyggggtygygggygtygygygtggaggtygtttttttttgtygtttgygtygggaygygttggtggagyggygygygttgtaygagtttggygtttattatttggtgagtgtyggygygygggagggygggtgagttyggtygggygggagtyggggtgattattygtgtttttygtagttygaygtygagggtgtttttygtygyggttygggtttgaatttgattagyggttagtatagggygttygtggttggtttttaygttttygtygttaygttgtaygtgggtgaggttyggggygtgggaggatygttygttttgtygtttatttygtygttygttygtttgattaygttttattttttttygtagygttyggggagtygtygaggagggggtygtygygttttygggattatttgygtttgtttatttgtatttagtttyggtgttagygtaaygygtgagtgtatttyggttyggattttatattygtattygttyggtttttataagttggaggtggttaaataggtattggayggggttttygttygtttatattttatyg

SEQ ID NO: 10992 - DNA, 2488 bp, synthetic construct
  misc_feature 1..2488: note = Description of Artificial Sequence: Synthetic polynucleotide
  source 1..2488: mol_type = other DNA
gygtagttyggtaggggyggtyggattygggtaaaygtagtttygggtgggagtagggttatttttgttttygagyggttggaataaaaatgyggattgtattttttttttttttttatttaaagtgtttagttttgaagataaggtggagggaggagagagagggyggaggtgtaaatttaatttaatttttgygygygttttygaggyggtyggttgttttygtttygtygtgtttttttattaaggaaggttttttygttaggggtygttaaygttygyggttttyggttagayggtgtatttgagagggatatttygttttttttygggagggattygggtttgttgaagtgggtttaattttgtaaatygygttttaatttttygygtygygtyggggaatttttttttgatatttaaygtttttygtttttatatttttaaatatagtttattttttttttygtggyggtygyggtaattygagttyggttttygtttygtygttagagaaygtttttttygtygggaygyggtgtygagttygttgtatatygagyggtygtggtataatatygyggygttgygygtataattatygttttttaggattygyggygygtatttygggagtggggtgygtttygygattttgggygtttagggttagatatattttttgggygtttygyggtttttatagtgtagtttttatygttttttttttattttygggtatatttattygtttttygttttagtttattyggtttagggygtagtygttttttygygtttttttttttagtttyggtaaaggaagttttttttgygtttttttttttagaatygtttttagtttttygtttttttaatygtagtttaayggtyggyggtagtagtyggagaaggggggyggyggttygggtttyggaaayggttygatygtygggattygggtyggatttygtatttgggttggaagygaggyggagatgggyggtygggattygygagtgagyggggygggyggyggtgatagttttatagttttagttgttgttgttgttgttgtygtygyggttgttyggggagaggggttggtattatygyggygygttattgttyggttygggggygggggtggttaggaggagggtttaggygagtagyggyggtagyggyggyggygtygyggttyggaggaagggggagggggtatygggtayggggaggygggagagggggygggatygggtayggggygggggygggggggaggggagygtagggagggygtaggtagggggagtaggaggagtagtaggaggaggtggyggaggggygggtgagagggaggagtgggtayggggggaaggggagagaggaaaaggaggtatttagggagaggggagaggagaaaggagggagagaggygyggggggagaagaggaggaaggagggggagttgggttaggtagggggggataagggygygttggaygygtygtygtgygtttyggtggggagygygtttttaagggggaagygtttygaggaagatttttgtayggggttgagttyggaaagaaggygttgggatttgtgtttatttatygttttyggaggttgyggtttttgggttyggtgggggttggggggagagggtattyggygggttgtttgyggttaggttaggagagggagatttggtttaaataaagtgatttaggtatttttaggaattttyggygttyggggttttttygggtagttttygatttttatgygtttttygggtttttagggaygygggtatttgtggggyggggttgtygggtttyggggttyggttttttygggyggtyggagygagatttygggttgggaaagttaggtaygtggtyggttttyggtygtattttygttttatttttayggtagggtttttagtgtttgattaagtttaagttygagtttttyggygygttgtttatyggttgttttttygygttttttttttttttttattygtatygtttygttttttattttttttttgttttttttttattatttagtttatatttttttygttttttttttygttttttgygggtattygagtgttygggaggygtttatttgttygatttaaatatttaygygatttttagygttygtygttygygtgttygttttygtttygtygtyggttattgtgtttygttagtttatatygggtygggttttgayggygygygagttatagttgtaaagtaataggataatttyggggaygtygttttagtttagattygggtaygtattgttygtggagayggtatygtyggggaggggagttaygyggattttagatgyggttttttaggyggatagatttttgttyggggygtaggaggaggtaggattggtatygyggggtgggagttttggattttygagtaatttyggattyggttyg

SEQ ID NO: 10993 - DNA, 513 bp, synthetic construct
  misc_feature 1..513: note = Description of Artificial Sequence: Synthetic polynucleotide
  source 1..513: mol_type = other DNA
aygttgttayggtaaygattgtaygygtatttttggagggtggtttgyggttttataggtttygygttyggggaggagaggaggtggtygattagatygtgggttttygggtttttyggtttttttaggttttaaattttttttattagagattttgtttggagtttttatgttagygtttttttttatyggtttttttttttaygtyggttttagtgtattaygyggttyggygagggattgggaaygggatagggaygygttttaatttatttagyggtggagttggggggyggygyggttaygtgggatggygggtagtttaggggattygggygayggggtttggygggtagggttgttttagtygtttttataaagtyggttttttygatttttttttttttttgtagtttttttttttttttttgggggttgggaggggayggggygggaygttggtagtygggagagtggaaaaggttgtatagagtttygtgataagttyggtyg

SEQ ID NO: 10994 - DNA, 1766 bp, synthetic construct
  misc_feature 1..1766: note = Description of Artificial Sequence: Synthetic polynucleotide
  source 1..1766: mol_type = other DNA
gyggatggtyggtttaggygygtttttttattyggggtygtttgtgttyggtgtgtygtgttygygggttaggggygyggygggaagttttygttygttygttagttagyggggttaaataggttatttttttgyggayggtyggygtyggagtttttttttygttygttyggatttattttygtaagtagygttggggttggagtygggyggttyggattagtttyggtttatttgggyggygttygyggtygggtttaygtyggggaaggtttyggtygtygygagttttygttygagtttygygttttttagttatttatttgttttttaygttttatttattagygygtayggtttyggtaattttattyggagyggggygtygtygtygtttttgtygtagttyggtygggtygttgggygtaggggatttygygtygtygttgtygttgtygtygtygtygtygtygttgtygttgttgtatttttyggygagygttgttgtttttttttttgtttttttttygttttttaaygtygtygttatygttttyggtttttttttygygygtygttttagttaaagttyggtttygtatttygttyggatygtttttaaatygttttagttyggtyggttaygttgttttagttagttttttggtayggygttatygtttttygttygtttgttygtyggtttttaygtaggggaggygggygygtttyggggyggggagygtygggtygggagtygyggayggttggggttyggggygyggggggtttagtygyggtgtttttttygagtttttygygygttagygtttttattttyggtttgggggaygygyggttygygattyggttttgtttgttttyggygtayggtttyggtttyggtttygaagtttagtttyggayggggtagtgaaygtagagttggggtttyggyggttttygatttttygatgttttyggattyggttggtygygttttyggygtygagygygtattttygtygggatatatagaygtatatttattygatatattttygtttttgttygttttyggyggagagttgaaatagatgtgggattygtttaggagttggaaaygagggagggaagygagttagagttttgtgtgtaygtgtgtgtgygtaatatataaattagggggtatygttaataaattaaatatygtgataaatttaggagggttatygattaggtttatttggttggaaaygaygtgaatttgtttttttttygtttttttttttttttttttyggagttggagggagttaaatgtttygyggggagtgygatagtttyggtygggygtttttttygtaatgataygttaataaatgtttttttttatttgtttttataggattygtttyggtttgtaaatattygattgtttttgtygaaagtttygygttygtttttagttatatatatttgttattggagaggtyggygtyggtygygattygtagtttaatygtagggtaaatygagttgtttgtgygygttygagaatttttygagaaattaatttyggtttaagtgaaaatagtagttgttgtttagaaatggttygggagtagtatagaaaggagaaatyggtttttttygaaaggggaggaattggatttaagggggtgttgtttatygtggttttygttgtttttygygttatagaagaggtyggagggggatyggtttgaygygggtgggtaaagagyg

SEQ ID NO: 10995 - DNA, 6511 bp, synthetic construct
  misc_feature 1..6511: note = Description of Artificial Sequence: Synthetic polynucleotide
  source 1..6511: mol_type = other DNA
gygatttygggggttagtagagaggagaggttgygggaggattygttgygaagggygaggggtggygttgggtgggaygggygtttggggtygtgtagggtggtttttgggtgttgttygggttgtttgtygtttagtattggygtaggaagaygggttygygtagygtttggtaatagtggtttgttttaygtttggaggygattaagttttgagttaaaggygtygggtttagtygggaagtgtatggygatttagaatayggagyggagaaggttttaggggataygaggttatygttttagttttygggtttgygtttygagyggttagggtgygtayggatgggtttygggatgttagtggagaggtgataggagtttattattttayggttaagygtgtgaggttttyggygggygggggtttttttyggggtagggtagggggagagttaggtatgtttttaaygggttttttagtagaatygttaggaaagtggtttttaattttaggtatttttgtggtttttaggtagttgggygattaaaaatttatttttgtttgttgtgaaatgggataggtggttgttaggttagagattgtgtttaygaagtttygtttggygggtygggattgaygtggattygggtttttttyggaagtttgggaatttgtgagttttttagtttttygttttattttgtttgtttgaaaaaaggagttgtttgagaggaagagttaaggtttaaaaggttttaaaygaagagtatgyggtttgaygyggagygtaaagaagygagtagtgaattgaatttggtgggattgagattagaggygtttgtatgyggyggtygtttygygttttattaaagtaatttgttatttaygataattatttttgtaattattttggagtggttgtgatttgatgtttgtggtgttttagggtatgtttttattggatatagatattttagggtgttttttgaygttagtgtyggtttagtgggtgttagtgtygygaagggagggtggygggygtgaatgttttttttttttgggtttgtygtaggtttyggtttttttattttgtttgattttggygggtttgttatttattgaggtttttatyggygtttaygttgtttygagaggygggataaaygttyggygygtggygyggagtttgygaaagygttygggggtttttattttttgttygggagttttttttttggggygggaagaggagtygtagatttgttygaattttgttttattygtttggtygttttttttygtttggggtgggggtaggggtggyggatgatttaggtttggggtygggagttttgtttttaaaggtattatttygygtttttttggaagtggygygttgttggggygttttygttgttgtagaggtttggtttgyggttttataggggygtgggtttagggtttttagggagtaagtgagtttaggttttttagggggyggtagaggggaattttygataattttttatttttttttttaggyggttgygaggttttyggggttttagaggggtttttttttgtyggtgtyggttgttttgagygyggttaygtagttygygtttttaygtgggtaaggggyggggaygttggagggaggttgttttggatgttggagttttyggttttyggttttgttgagtagaaaagttgaagttaaggaagggttgaggtttttttataagggygygygygtgtttgggtgtyggtttagaagtygagaatgtgygtattggggaagggtttttygtgtygagaagatagaggatttgttttagttgtttttygtatagagggygyggaggttgygttttagttygaaygtttatttattggaaagagggtagygtyggggtttagggaagttttttgggaatgaatggtttttgttaagyggtttyggattttttgggttttttgggtttayggtayggtgttgygygagtttttagtgtttatyggtttttttygttttttgygtagaygtttttaggyggggaggtatatyggttttttygggtagttttggttagtgttgttgtgggaaaggagagttagggtttgggatgggggatgagtatttttttgtttatttygggttttagygtgtaggaggtaaatttgttagtatagataagatagtttgtttaagttgtattttaggtygggttagagaataaaatygagggttagaaggtttagaatgtyggatagtttagyggtattygttagggagttttaggygttygaaagaggygtygtatttttggygagtttaggatttatttttttggatttgtgttttggagtgtttgygggtttgggtttaatttttgtttttggtaggtgtttttttttttygtygttaatattaggagygttgtttttgyggtaatttattttatttttagaagtttgttttgggatygaagtgttagggttttgtgtgtttttttatgtattgttttttttagtgtaaagttttgtagatatgtttggtygaaaagttttagtggttttaatttttagattttgttttygygttyggtyggaaaattatttgggatttggttgttgtttaaggtygggggaaagttttttttggaggaygtttattattattatttttttttaggtttatttgggtttaaataaatgttaaagtttaaaygaattygagaaggaatagygaggtagtggatgtygttatttygtggatgggagagttatgtttattgtaggtgyggatatygtattgataggtattgattattgtaaaatygtatttagtattaaatagaaatagttttgttttttaatttttatagaatgtttaaatttagtttagggagttagttggggygttttaataaataygttttygagaattagygatgttttttttataatgaaagttaattgttgtataataattgggttaaagaatttygttagtttaaattttaaaaattagtattgtattttgtttttaagtttgggtggtaagtatygaaggggagagggaagtagygtttgtgtggaaggaagtttygttttttgtttaaatatgtgggatttgggtgtttatttttttagtygagagttttttgtaggtttttttttaattttttgtatttttttatttttattttattygtggygttygggttttatttttgttyggygttttttttttagggygagtagaggtttttgagtgatyggttygttagaggtagttgtagagtyggygtttygtagggtagggtagggtygggtygttgggttggtttagtgygygygggttttttttggttttagttagtygygggagatgttatttygggygatagyggygagaygtygttgttygtaatttttgggygggtaggatygtttgttgtttttgyggtttttggggtagattttttaggagttttttttttttttttttygttygggggtygggatygygttgtgtttayggagggaattgggygtttttggygtattggggttttagttgtatgattttagtttagattttaagttttagtggggtgtaggtgggatgggatgtgtttttaggagatgaggagatttyggttgttgagtygttttttaaatgygtagttttttaattttaggtgatattygttttttggaggaaygagtgaaggtygtttaggygaaagaggggtgggttttagtatttggatttttttttttagttttgttaattttaggtgtgtttayggtggaggtgatagaaggaaggygygtygggggatttaggtttygtaggttttyggttgttaaygaggtatygtttattgatttygygtttygttttttatagygtggggttyggygttgygttaggttygggtgyggggyggagttaggttgggattggttgggggtygtttygttyggygtttgggttttygygtyggttttyggggaggagttatgataattttttttttattaaggygttygggtttttyggttatygttaggatatattgttygggygyggtttttttygttygyggagyggttttgatattygyggyggtagtatttaygttygtagagtygtygatgygtgtttagtgattyggatagtaaggttygygygyggygggggyggyggtagaygtttggttatygtgatttygattttggatttatygtttgggggttggggggattttggatttaattggygattgttttgggggaygtyggaygttatgttgtggaaaataatygataatgttaagtaygaagaggattgygaggtgagttggggtttyggggtgtagtttygtttygtygaggatagttygggaggtaggggttattggatygaggtyggggaygagggtataggagttttggtttttyggtgggaygggatttattttttyggatattttttagtttatttttgyggggttttttttttgtatagggtttttttttaaatagttttttttygggaaygaggtttggaaagagaatggtaaattttatttatatagtttatygggygtttttttaagyggtaaatagttttgtttttygttttttyggaaaagtgtttygtttgtaatttttagaygtggtttttaygtaygaagtttttgtttaaaggggttagatgaggttatttgttagygatattttggyggatatttttttaaggtyggtttgttatttgtttygttattttttyggggaagtaygaaaataatygaagtttggtttttaaaagaagtgggggttggggagtggtggtgggggtgttygaggttagatggggtygtaagagttygygagtgttttagtttgtyggataggttgagttagagtttyggagagtgggagggaagaaggaggyggygagygggaagaggaagaagaygtaggtagygttaggygagtttaggggygtygggagygyggagttygggttayggattygygggagtttattgygttttygggttttggagggttgtttttgttygtaggttygggygttttygttaggaggygatagygttatgtttttttaggttttyggygtttygagatttttgggtagatggggaygtattttttagaaattgagtygggtygtttaggggygagggaaygtgygygggtaaggttgtttaatttttagggttttttatgttttttttgygtttygaygtgygagaatattgtttttggtagtgtagggygtttttatttattatttttttyggttgggttyggttagtagggagggtygttttgtgygygygttttttttttattttttagggyggygtagggtggygggttttgtttttygagygtygttygttyggaggtttttgtttygagggygtggaagggagggtttygggggygggggaggtgygtatttttygygtygygtattttattygygtttgtygygttgttatttttagtagtttttgygttatgggygggttttaygagatagttttgtatygggygttyggttttttygtttygggttttggttttttygtttygggtttyggttayggatttttttggtttaagatttagggttyggatttggygtttttaagygtttygggtttgggagtagygtttagattttygtygtygggttttgagaattygtttttttaggttttttattagattttttttttttttygtattttttgtttataaygaaattttyggggygtattgttttygggtatttttygattttgggtaagtttygtygggyggggtgyggttggtttttyggggttttttgygtagttyggygatgtyggttagttygtagtagyggggtttygtattaayggggttttttgtttttttttttttttttaggatygttaygaygggagtagtaatgggaattygygggttttttatttttttttygtygggtagtatttttatagtttygygttattttttttttatattggagtygtygaatattagtygttattttattttttttttttttattagtagttggtttatttttagtyggtygatttttattygtatttgggggaagygtaygtygtygttattaattttttgtattagtyggygtttataggtagttagtagtaggtttggttyggtygttagagttaggagggagyggggttgttttygtattaygggygttyggtyggtttattgttttattttttygggttggaggygggygyggtgagygttygtagggatgtttatygtygtttygatttgttgttgttttaygtataygttttggatgtygygggtttggtygagaatttggggttttaygatatgttttattagatggaygaggtgtaggtgagyggygttgyggtttttgatyggatttgtttattttayg

SEQ ID NO: 10996 - DNA, 6511 bp, synthetic construct; identical to SEQ ID NO: 10995
  misc_feature 1..6511: note = Description of Artificial Sequence: Synthetic polynucleotide
  source 1..6511: mol_type = other DNA

SEQ ID NO: 10997 - DNA, 338 bp, synthetic construct
  misc_feature 1..338: note = Description of Artificial Sequence: Synthetic polynucleotide
  source 1..338: mol_type = other DNA
tygtttttygygtatgygtttaggtyggttygtaggtttttttygttttagtyggtagttagttygttygygttggggttatygygagtyggttygtagyggggttatygygattttyggygtagatatagaggtygtttttagtttygtygtttygtggtttygttttygttgtaygtttttttatttttyggatttygtagggtygyggyggatayggttygatyggggaygtgaaygygtagaattatattttttagygtttygttygygttggaattatatttttyggggggttyggyggtgtattygtyggggtygyggattggaggttttyg

SEQ ID NO: 10998 - DNA, 936 bp, synthetic construct
  misc_feature 1..936: note = Description of Artificial Sequence: Synthetic polynucleotide
  source 1..936: mol_type = other DNA
gygttttgttygtttattgggtttttygtyggtttatttgtatggttygaggggggyggggttgaygtygygttgggaatgttttggtygagatattgaggtagggtagagagygtttgygggygtygggyggagttgttgyggattaggattygagtygattttygatttygatttagattttaattygygttttygtttygtygtygtygttatgtaygaygtagagygyggttggagtttgtttttygygggttgyggttttttgggtttttattaygtyggggygattygttgtttgagygagtaygtttygtatttttttygygaygygygtatgttgttyggygtttyggtyggggygttgtattgygtyggygtttttttyggtatttygttgggtgygtttggggaygttgttygggttttaygtgyggagtgggtgttttttaggtyggggagygggggatttttaggggtygyggggttttggaggagygggtatyggaygyggatayggyggggtgtatttygagggtttttttygaggtagatgttttttgygggggygttgtttttgggttygggaagggggygttggaatttygagyggttygggtygaagtttgggattttygtgygtttttatttttatttttattaggygttygtgtatgaagggagatttttattttyggattgagagtyggagygtttyggagygayggggagtagggagygggattyggggyggagggtagtgttggtttttgyggatttygggttttttgtgttttttygggaggggttggaygggttgagttgtygaggggtygatttgttttgggtyggataaagagtggggttttggtyggttttttayggtgggttttttttttttggggattgagggatttaagatatttygygtttgyg

SEQ ID NO: 10999 - DNA, 2184 bp, synthetic construct
  misc_feature 1..2184: note = Description of Artificial Sequence: Synthetic polynucleotide
  source 1..2184: mol_type = other DNA
gygygtttttttaatttttttgygttttagttttttyggttttagtattttygtgatttgagtatyggygggtttttgtttattgtttagtattygaygtatttgttttygtygygtagtttttttttttyggtttgagtttttttttyggygygtattgtttttgtgatttttttttttttyggttatagatgtagttttyggttagaagttttattttttygaggttttygtttttgttaggtagtttttttgyggygtygtttatttagagttttttttttggaygtttttttagtgtttttttagtagtttyggyggttttttttttatttttagtttttttttyggttttttaggaaggggttagattttagtttagtatttagygttttttggttttttttttttgggygttttttygatagttttttttagggaagttggttygttgygygtttttattttyggtygtygtttggatagaggygygtaattyggagggygtaggtttyggttyggagaagggggtgtygtyggygtttygattttttaggaatggggaaatagaggtayggtggattyggyggyggggttgggtttggggttggaygttgatttaggatttygtttttgttygttttgygtygygtttttttygggtyggttttgatygagtagttttaygygggttyggggttygtttattygataggagyggggggttgtagtttaygagtttaygagttygtagygaygtattyggagtgtaatttygtagagttayggagatattttttyggtgtgggygtttygtygygtttttttttygygggttgyggttattttagggtaggatagagtygagatgttygggtgggagygatgttygygtgggggygatgtaaygggggagatgtttggggggagggtggtaaggtgaaatttggtggagaataatgggggtgggtgggygatttttggggaggtgttyggtgtggggtgtttttggttygttyggggatagtgygygttttttygttygyggygttygttttgttygttttatygaggtttttygggagygtttgggtttayggtttyggggggttttttygagatttgggygttgttttgggggagtaggggttygggttattaaggttygtgyggatygtggggtgttttaygtttaggtygggggattttagagtttygttttttttaagggygtygygtttyggattgtaggtggagayggggatyggtttygyggggtygtygataggygyggggygggatagggtgggaggyggyggggygtagagtttttyggtygtyggygygattygggtatttttttggaggyggygggagygyggtygyggygttttyggggtggggtttaggttggaggtttyggggygtatygttttagttttatttyggtygggttttygygttgtttttgyggagagggaggaaggaaggaaggtagggagggaggggayggtyggtaggygtggggttygyggygttagggtttttttttttygttygttttattttgtaattygtagttygggyggggtttygttgtttttttttygaatatagtygtttttttttttttttttaatttygagygttttttttttygaatgygggagtttatagtgtaygggaagtttttttttttttttatygaggttgttygaygttttttttatttttygatttttygtaattattttttaaatgtttyggyggttagtagggttggggtgggygtaggagaattaggggttttgttygtatgtaggggtttggggtyggtgtggtygaatgaaygygygggtttagaygagtttgtgatgttttygttttttattttttygygatttggttttagaagatagtttgagaggtyggtggtygyggattttggaygygttttttttttgtttgtggtttttttttatttyggtagygttgtgagtttattttttatttataggagttatatttagaatttttttttggggttatagygtgggttttygatatttgtgtgattttagttttgtttttttagggttgygtggtgaagtttttaggatttttygygtgggttgggygggtgaygtggatgagggataaygtggtgaggttttygtygtggyg

SEQ ID NO: 11000 - DNA, 413 bp, synthetic construct
  misc_feature 1..413: note = Description of Artificial Sequence: Synthetic polynucleotide
  source 1..413: mol_type = other DNA
tyggggygtgggagttgygttygtttttttttttyggygtttygtggagatygggaggtttagygttttttttagtttttagygtygtttttttagattttagagaygtyggttagggygyggygtttygggttattgygggtttttttygggygggygaygtggggggygaggtatygygyggyggygtttggygggtattgttgttygyggagggayggtgggggggttttagtagttggygggggtggagggggygggagagggagtttgygtygggttgagtttggaggtgyggggygggttyggggagygtttttggggttttttttgttatagtyggggyggttggaattttttttttttttttttttatttttttattttttttgttyggtttygtygttaggtyg

SEQ ID NO: 11001 - DNA, 403 bp, synthetic construct
  misc_feature 1..403: note = Description of Artificial Sequence: Synthetic polynucleotide
  source 1..403: mol_type = other DNA
tygtttagtttttgygttyggaagaaaatttagygtaggtygggtttyggygygyggaagttttgygaattttaaatgtgtgygttgagtygaggtttttaagyggtaggagagaatttgattttygatattttttttaagataygygtyggtggatygggttttgggattggtttattttygggttggattttggggttygtatatttgaaagygtaaatttgaggaatgayggyggggtgatgggtattttatagagtgggatttaatygtgtttagtaatagatttttttaaatttttttttaaaaagagttttttagagttgtygaaattttygyggggtgaaagttaaatttttggagtygttgtgtagtygggtagaggatayggyggygygagtyg

SEQ ID NO: 11002 - DNA, 675 bp, synthetic construct
  misc_feature 1..675: note = Description of Artificial Sequence: Synthetic polynucleotide
  source 1..675: mol_type = other DNA
tygtttttaaaygtaygattatttttttagttttttagtattaaatttagyggttttattyggttaygtttttaygttaggttatgatttttatatggtttattgygtaagtttatatttagttttaggaagygagttttaygtygttttagttttgtatttatagtygttaagyggtttyggaagtygaatgtyggataggttaaagatagygtygttgtttyggtattgtygttagagggygyggagtygtygtgttggtttgtattttttttgttaygttagtygaayggttayggtaatggaggattttgtygtatgygaygataggatgattgttttttttgaagttttattaaatayggagaggtttttttgtttttgggagaygyggtgatgtgaygtagyggttgtagygaaggttttttgtaaaagatggtygttgyggagttgttaggtgttttttggtaggyggyggtygtattataagatggyggttygttttagggttttataygyggggttgyggaggyggyggtttygagggttttygttttttgttggttttgttttygygtgyggggttgygatttgtttttgtgtgygggtggaagtgygggtygttttggggtygagttgtaatttygygatattttattggagtgygatgagayg

SEQ ID NO: 11003 - DNA, 580 bp, synthetic construct
  misc_feature 1..580: note = Description of Artificial Sequence: Synthetic polynucleotide
  source 1..580: mol_type = other DNA
gyggtggtygaggaygttttttttggygttygggggtatyggatygyggttygtygggatggaggtaggtaggtagygtttygggagggttttagggagyggttyggagttgttyggyggggygtttagggygtagygggtagygtttatygagggygygtaggtatttttygaaattttygttgattaatattttttagtatttagtgaagtygattggtatttyggggagtgattggagttagttggttataagygggygggayggttggagattgtygggatagyggttgtyggtgttaygygggtggtgggyggttyggaaatgagygtttttyggggatagggggttttgyggggyggygatagttggatttttagygygtataaagtttgygggaggatttattgtagyggtygttttttttygtttagygagggygggygtaggggygggggatgtygaagggttaggtttgtttaggtygygttattttygttttagaygtttagttygttttttttataaaggaagaggagatyggagaygggaygtttgttttgttggtygaatttttyg

SEQ ID NO: 11004 - DNA, 858 bp, synthetic construct
  misc_feature 1..858: note = Description of Artificial Sequence: Synthetic polynucleotide
  source 1..858: mol_type = other DNA
tygggtaygttgagtttatygagaattttaaggagttaaygagggygggtgtttttatatttttttagggattagygtygttygatygtaattttggggaagatttyggyggttttggagaggagggataggtttttattatttatttggttagtttygyggaagggttggtggatgaatgaattgttttttygtyggtygagtttygygggatagyggyggatygyggggtgtttatttgtggggatgttygagggttttttygagttygtatttagatagggattttaggggtggaggaygagygttaggagtagtagttgaggttttatygtgtatttttttatattyggttttygagggtygygygggtttaggygtttayggtttygtagygtygygtttttygygagaaygtagagattygggttygttttgagtygtygattgygggygggagtyggygggtaaggygygyggtyggtagtyggagyggygygtaaygtagttgagtgaggtygtyggtggaggtayggagtagtaggygttyggggygttgyggaggttttataggtttttygaggggaggygayggggygggtygygttttggttattggtygtyggttgattygtygtygttgygygttyggtgyggtygttttagttygtttttttgggttttaygtttggattgtttgtttagygyggaygttatttaaggagttgtttgyggttaygtgtggaggtttaygtagygtttttggttggaayggggaagtttgtatttagttttgggagtgggtttgggagagggaggaggagtygtygggagtttggygggagggyggtgttttyg

SEQ ID NO: 11005 - DNA, 5715 bp, synthetic construct
  misc_feature 1..5715: note = Description of Artificial Sequence: Synthetic polynucleotide
  source 1..5715: mol_type = other DNA
tygggattyggtttttygtattygtygtyggtgttgtygaygtttatagygttgatgagattttygaggtttygggttyggttttaggagtttttgtttttyggttgaggaagyggyggyggyggyggttgyggttggggtggtagttygggttttttttttaygtygatggygatgtagttgagattattttggaagtyggtagaggtttttttgygtatgggygatttatygtttttaggataatygattaagttttygggttgattyggggtttayggtyggttttgyggtgttaaagggggygtyggttgtaattgtygtggggaggtgggyggttygtygttttttttagggtygatatttaygtygttttygttgttttttttgagagagatattttttayggaggtygagttgtggygtttggggttgtgggygaaggayggggataygggggtgatygtygtggtggaggagaaggtttyggaattgtggyggyggyggtttttttgygggtttgygyggatgattttggygtygyggtgggggttygggggttggttggtttgtaggaaggtttygattttygatatttgttttatgaggtttagtttttttaygttygaygtygggttggttaygygggtagtttttggtttygggggggtygygataggttgyggyggggtggyggttatattaaaagttatttyggtgtagttattattgttttyggtgttygaggataaygatgaggyggygttygggttttgggyggtggtaayggtygaggyggggggtaggyggtatagttttttyggggtyggyggyggtggyggyggttgtagagaygaygayggggaygyggayggaygygggggtaayggyggatayggggaggaggtttygggggataggaggtygtttaaggagtttayggggtggtygttyggggygttyggtttaggagatttgggggagttgaagtygaggtttatgtagtyggagagyggagatygttgtyggttgtygttgttggtgttyggggtgtttgagtttagygaygaggtygggttgttggyggataagagygaggaggaygaggtygtygaygttagtaggggaggygygggyggygataggygggtttygggttygttaaagtygatgttgatgtattygtyggggtttttgggtttyggtggtagtgggtattygtgtatgttgggtaggttgggtagtttttttagggataggygygtgggttttatygttyggtygygttggtttaagaagtttttygggyggtygtygttaggtygtaygggygaaggtattatagggtgagggggttgygtggggtyggtttygaaggygttggtygtttggttgggttttggygtggtttgaggttttagaygttttttttttaggatgygttttaygggggagtttatgagtaygtattggtygttgttttygttataggtgtagggggttttgtaggagyggggtaaggagttgtagtagtagtygggaaygtttttgagyggtttttygtyggggtgtagggttgyggagaagaagtygggyggggtgttygtggtgatygygtygttgggggataygttgaggtagttttygttgggtagtagtttgttatttgtatgttttatggatagtttggaatygtattatatgygtatgtatttattgttttygggggagttttyggygggygagttggttttgtagtygttttygttygtygggaatgttttgttygtygtagaggtgggtgttggtttygtaggtttygtagaaggtayggyggyggyggyggyggyggyggttttgggttgtaagatttgtttgggggyggataygttggyggggtttatgggtatgtagtygtygtttttgtagttgtygtttttattgttygygagggtygygtygggygttatgggtatgtagtygtygtttgtttttaggttgttgttggagtttttgtgggagtygatttygatgttttygtagttttttgggtaggggtggtaggttattttgggagaggaygyggggtaggaygggtagaggyggttygygttgttygagaaggtggttygtattagggtgtatttatttagygaggtagaggagggttggggtatyggtygttgtygggttggygtggttagggagtaggtttttttgygtagttttyggtttaggttttgggtygygtttttygagattyggyggtaggagyggttatagtggtttaggggtttgtttatggttatgtattygtagaatttatygtygtygtygtygtttygggtygggggygttttygygatggattygggygtgttgtttyggtggttgtagaaggygygtaggtygtttgggttggagtygtattygtttagggatatgaagtyggggtygttgggggagttygaggyggaggygttgtygttggagggtygttggtyggggtygtggtgtagyggatgyggtagaggygggtgygggtygggyggyggygggtaggagttygagtygtggtygttgttggaygatagggagtyggggttggtggyggygggyggygagtgygttaygggtatggatatggagyggttgtgttgtagygygttttttgtyggtagtagygttattttgttttygyggtygtygtagtygtygtttagggtgtgygagyggtttaggggygygygtatyggttyggggtttagggggtttttagttatygatatyggtttggygttygyggtygtygttttygtygtygygtygtygtygttttygttggyggtgygtattyggtaygagttgtatttggtygtyggyggggtggyggttaggttgtyggtgygygagyggygtattaggttygtttggttggggggtaggttgattaggtggtggtggyggygygygtyggggaygttgatggggtgygtggtygaygatttygaygattggtttttattgygyggtyggaattygaagagttttttgagygtttttatggtttttaggatggtttygtggatgttttgygttattatygagtygttygtttgtatttatagttygtyggggtttgtgayggtygagyggtttatttygatgaagaagaagttgttygagtggtygtagyggyggatgtttatgagttgtagygttatygayggttgttygtagttgagttttaygaagtygatggtgygygtagataggtatagayggtatattttygttaggtttttgttttggtttagatttttgggttttaggtttatttgttatattttayggtaggyggtygtggygggagttattagttygtagttgttttyggtttyggyggygtyggtagagtygtttagggygtygggtagggaggygttgtaggaygyggygggygyggyggyggggggygygttttyggyggtygygyggttttygttgattaggtyggtgagygygyggtattagtttttttgtttttgttygttttyggyggttayggygaagtattygtttttggtgtagagggygattaggtatttgtgtttggygtyggygygtttgttgatgtttaggtagtagtygagagygattattygtttyggygygtttgttttgtttygttattttttttygttttygtagtattygagtygyggyggttgyggygtygatttttygttygtygtygtttygtygtygttygygtygggttygygtagtaygaagaagygtttgtggttatgtttttgtttgygtaggtagtygtatttgygtaygttgtggttgttgttgttgttgttgttgttgaggttggggtygttttygttygtyggttygggyggttygtgtygyggygggttygttatygygggygttttaggtygygyggttygggttyggygtttaggggttggggygaggggyggagggggygygggygggggyggtttttttttatttttgygttyggtygttygttygattaygygtttttygggtttaggyggtggggaaggttyggggaggttygygggggttagtatygttyggyggygtygygtttttygygttttggggtttttgaggatgttyggygygggyggtggtygttttttttttyggttgtttgyggtygttgttttttygggttttygggyggygtygggggaygygttygttgggtygggagtyggggttttygagtygyggggtygagtttaaggygygygyggtygtatyggggttgttgtygtygygtygygtttygggaagtyggggtgygttygggygttyggggttygygtygtygtyggggttgttgttgttgttggtgttgttgttgttgttgttaayggygattygggttygtygyggttttygtygtatagtgagtaatatatygygtatygagtgattgaattaagaagagtaaaataatatgtgattyggygttaygtaggtatatatagygyggtygtttygtttygttgtttygtattggygtygygtttttygayggayggygygttyggttaatyggygyggygttygygggggygggtygygygttttygtttygttttttttttttttygggtygygtttttygtygttttttttttttttygygaaggtttyggttyggtygggyggggtggggyggtttyggttttattaattagyggtttgttgtggatgtyggyggaggagatgttatttagggygggaaaaggggygyggaagaggggyggggygggttayggygygtagggtttttttttttygtttyggatttaattaattgggtttgagtttttgtyggggagggggygtygggyggggtygyggttgggyggggygggggatygggatyggyggygggggttgyggttttgtagtggaagtatgggyggygagtygggtygtgttttyggggygyggggtttttattttgggygagggyggtygttttygygttyggggtgggygygttttattttygtttttygtttttygttttygtttttyggtygtattttygttttttygtagtygygaaaygyggggaggttttagggttygyggtygygggttygygagtatygygttttagatygagagyggygygygttttttygtggaggatagaggggygyggagggggygtttgtgttttattygttygygggygttttayggggygttttttgygttatttatttgttagtttgtygggaagttgaaatygygtttgggaggtaataggagaaagagatyggggayggtaggyggagaaagtgyggtttttatagygtyggggagagggyggattygygagttagyggtttttgagtygggagatygygygggygtttttttagttttygtaggagygtygtttttttttygtaggggygttttttttttttatygttgtaggagtattttttttttttttyggaagygtttttttattatatygttttaagagtttttttttttttttataggggygtttttttttttttygaggtaggagygttttttttttttttataggagygttttttttattttaggagygttttgygtttagtagaygggtaggtgggygggygtttattatttgtgtgygyggtgygggyg

SEQ ID NO: 11006 - DNA, 858 bp, synthetic construct; identical to SEQ ID NO: 11004
  misc_feature 1..858: note = Description of Artificial Sequence: Synthetic polynucleotide
  source 1..858: mol_type = other DNA

SEQ ID NO: 11007 - DNA, 247 bp, synthetic construct
  misc_feature 1..247: note = Description of Artificial Sequence: Synthetic polynucleotide
  source 1..247: mol_type = other DNA
tyggaattttyggggaggattaaygtyggygtatygtgyggtyggggyggggygtygtttaaatttaggttttgtgatagygattgtggyggtttggaaagygtgggtttyggttattgggtaygagyggttaygtgatagygggtttttttaggttagygttggtggttgagtgatgtaattaygtggggtttgaagttttygtgggtgtaggttttttygttatgttgaygataggtagtgttyg

SEQ ID NO: 11008 - DNA, 224 bp, synthetic construct
  misc_feature 1..224: note = Description of Artificial Sequence: Synthetic polynucleotide
  source 1..224: mol_type = other DNA
aygttygtttttttttygggtagttttttttatttaggygggatttgggttttygttggatttagggtygttttttygtaggyggggtyggttyggygygtattttgtttyggatgttttggygtayggtttygygtttygtttttattttggygtatttggttttgygtttttttttygtttggygtagygttttttgtygtttttttttttttttggyggyg

SEQ ID NO: 11009 - DNA, 1174 bp, synthetic construct
  misc_feature 1..1174: note = Description of Artificial Sequence: Synthetic polynucleotide
  source 1..1174: mol_type = other DNA
gyggygaattaaagagtagggaattataaaagayggtyggyggygagtaggttggggtgayggggatttygtggataaygggtttgaggaygtttagggttttagttttttttaggygtttttygtyggggtaaygtagagtagttgtygtttttttygygttttagtagatggtggtgttagttyggtttygtgttyggtygtygttgygttygygtttttttttttygtagatggtttaattagggttttygttygttttttygyggttttygtttygygygtttgggygagygttgygaaygtggagttaggtagttaagtgttattgygtatagtaggtagtttggtaattgagagtataatatygagtagatggtgttygtayggygtgatggatattatataygatagtttgagataatttaggaattttttggtgattygaggttttttttgtataaaatgagttttttttttattgtygtgtatttttggggttatttgtttttttttttygattgatattgaattggttttttattatygattttttttttagtyggaggggaggaagaatttaagtgggggagggygygggaaggggaygtggagggaaayggaagggttgggagtggggtaggggggtagtggygattttyggggggggagggtggyggatattagattttagggtygatagttygggagggatygggttttaggattttagttgtataaagtyggttyggggagggggygataaggagygagtttygggtyggttyggtatygttgtttyggtttagagtttttgtaatygtttggtttaygaataatttaaatgaaatttagggttttattgaaaaagttttttggggtttaatttagtttttygattttagtttatatgtttataagtttttaggggatttyggttaggaagttaggagtggggttygtgygttttyggtaggatttagattgtttttyggygtaggyggttttaataaagaagtttaygaggyggtttygggygygggtaggggyggtgyggyggygttygggagattygygaggggttttggaggttttyggttygygygygtygttygggagttygygaggttgyggtgtgttttagygggygtattttttaggtttygttatatyg

SEQ ID NO: 11010 - DNA, 8657 bp, synthetic construct
  misc_feature 1..8657: note = Description of Artificial Sequence: Synthetic polynucleotide
  source 1..8657: mol_type = other DNA
tyggattttttttygggtttttygggygtttygttttttyggggttggtttttttttttttttygggygtygtyggtygygggtygtttattttttttgggttygtagtygtygttyggggatyggtagtgggattygagygggtgygygttygttttgttygygtygttggtygtttttggygyggtgtgtagggtttygtygggggtygyggtygtagagttgtatygtaggagattttggttttgtagygtygygtttaagttttygtagtttgtgtagttgtygtagaagggygaygtgtagtagagggggyggtttagtagyggygaggtagggtagggygagttttttggyggtgtttyggttgaggtyggygyggyggtygygggtagtttyggtggttygtagttygggtttaggttyggttgtttgaggttygaygtggygatttyggttagygattatagtttgggtttgttggyggggggyggygygttyggagaygttyggttgttttggggygttttgyggttatygyggggygyggtttygggyggggggtttagtagyggygtttttaagtyggtaagyggygaygaggttaygggtttgggyggygttaggtttygttygtttttttygtygtygttttygtygttttttaggtygttatatttgtttttgtatttygagttygattygtatagggggttttyggygyggtayggaagttttttttygttygattyggtygagtaygagtgattygtgagygagtttaygtgtaggttgatttttgtgggggygygggtayggtgggtggtaygaggggatagygtaggtatttggagtttttttygttttttgttttgyggtattgggttttttttaygggattttttatttygtttttattyggttaygtgataggyggagtttgattttttygggaagggttygaggaatygttygtttaaatttyggygattttagggtaatgtggtgyggttggggtttyggttyggatttggggtgttyggygggtaaygtttttttygttttagttttgygtttygtttgggaagaaagygtttygagattttgygtyggtygttgttygtttattttygttttttgtygaggttttygtgtttttttgygttttgtygggattttygtttttgtttttggtagygtygttttygttttygtttttattttygtttttgtttttyggggtttaggttattttgtttttttttttgaggygtyggygygygttggygaattaggtggagatttgggtgagggttattttggtgatgatggttagtatgattttttygtttttggtggggtaggggtttttgyggtgttygttgagttaggttttgagagtggtygtggygtttygygtggygtttttgyggtaygyggggtygttgagttggtaygggtaggtygygttgtygtaygggtggtagttgatggygtyggttatgtyggtggtgtgygygtygtagggtgygttttggaattaataagagtttgtgagtggagtatgyggagatttygygggtaattagttagaggatgttattttttygttygtttayggttatygtttttttygtgagtttggttttggggttgygtttttygtygtaaaagagtaggaaaaaygtagtgtgattygggattagttgttgattataaaaagtatyggagttttattttygaatttttgaattattttatttttttaaaatgatttatttttttttaagtgtttyggagtygttygtggtaatgtatataaatttttgtaygtgygygtatataggtttataggtagttttttgatatttaaatttttgtagatgtttggagtgyggttgtttttttttatttttttttttttttttttatatggttaaaaaaatattttagagtttttaatttattatttattgttttaaagttgggtaaatttaatttgtaatttagaagttagttatygtttygaattttttaaataygtygtaattagtattttaatttattttttaaygtttaaattygaggtatttgtagttttygttaaggttttagygattyggtygttgtttagaaatttygtygagggtyggtagtygygataatttygtaatggttttaatygttygtaaygtgtttygtygyggttygggtttggtttagtttagtaatttygagattygygagtygtttttaggtygtyggagtaggagttgygttygggttayggaggatttaggyggtttttagygggttaygygttygtaagtaygatatttgaaagtatggttygttggatagagtaaggtygaaatttgggygtttygggtyggatttyggagtygtagttgaatgttyggtttttgggtttaattyggtgatttttatygttttgagtttygygagtgaatgygaatygttyggtygtyggtttagaggtygtagtgaygyggattttygygttttaygttaatgtaggygagtatatagttygtttygaaygtttttttaggttgyggtgyggaaattagggataaayggygttagatttyggtttyggyggagaygtattttttaggtttttagagaaaattagtyggygagtygaggggaygygyggggggygygygggtttyggtygggtttagggaygttttygtttgtygygttgttttttttattyggggttyggtttagtttgyggggyggttaatygagtyggygatttttgagtygttagtygygttatattttyggyggttttygttygtygaattygagtttygtttygtttgagtttygtttgggtttyggygtttaggagtttygygtttygttygygttyggttattatgtaggaygggaagtyggyggyggyggyggyggygtyggtygagtattgtagygggttttygaagtyggtggtygtttgygtygtgaaggtygtygagttygggtaggggttgaaygtygagttygaygtygagygygttagtttttygttgygyggagtygttaaagtygaygygtygtaggtygggtaygagtagagygttagygagtygggygtttggtataggtagttttgygggtaggatatggtgggygyggggygyggggttygygttaygtygagtagygggtagggygygyggygttttttatttaygttyggtyggggygyggygyggyggygggtattyggayggtyggyggaggtaggtyggttygggtattagtttgggyggttygygggtyggggyggyggyggggtggyggtggyggyggtagtagygyggagtyggtgggygtagtygygygttaggtyggyggtyggggtttgggggagtttggagtygggagtgaggagttgaggaaggagygttygagttttygagggatattggaaygygtagttgtttattaygygtttatttgtatattygggggttygttttttttttgtttygttygttgtagttttygggtygyggttgggggaggggtagagagaygggagggaggygggggagggyggaggygayggaggygggyggygggagggatyggtaggtttttgtggygtagtygtttttttagtagtttyggttttagttygyggttygyggatttgtagtttagttyggtygygttgygtgtttyggygygtattttttttatttttatttattyggagttaygttttttgttyggtttyggtyggtttttatygttttyggttatygttttygtttttgttyggttttygttttttttagttattatttygtttttatttttttttttatttttatggattaggtagaggtygttygyggttaggttaggtygggtttaattaggggatttatagtttgtttygttgtgtatttygaggaggttyggtttttgtgtttaattyggaagtygtagggaagtggggaggttaggatggtggygttygyggttygggttttttttygggtagtgygygyggtttttatttttayggtttyggatttgttttgttttttggttygaggtttttygygtggtttygygtttggtygtttatttttygyggtttatttygtttagtatggatttggattyggggygttttggttgygaattgttaggagggttttgaggtgagttttttgtttttaaattygtagygtaattttyggggttttgaaygttaygattttttattgttgggaatgaygttagggttttagttaagaagaygtygttttttaaagagttttattttattttgtttttttaagttgattttttttttagatttgtgttgttaaaatattggggggatgattgttatttgataaatygtttttggtaggatttgaagttttttagttaygtygagaaygggtaggagtttaggttggygtygtyggtgtagtgggtattataggtagtttaggtgaygygyggttggagtaggggggyggttgttttgyggggtttagaagygaggyggttggygagggtttttaggattttagttttttagaattttttttttattaygtttttttaatttttttttattyggggatggtygaagagggygtttggttgtttatttygaagggttatttatggggggygtttagggggatggaagagtgttaggtttgtgttggtttattgggagtatttatttagtaggtgtttttattttyggaagtygtttygggtgggtgyggtggagaagagagagygtagtggtttggggygggttttagtttaggtttgtagtygatttttgtatttttgttggttttgtagtttgyggagtagttttagtgattttaggaygtagggtatgttgyggtttttttgtggtgyggttgtagyggygyggagggagyggagttygggttgttagtttggtttagggygtaagagaaatatttayggtattaggttgtttttttttaggtgtaagggaattagttgtaaattgtagtgttgtgtttgaggatggttttttttgagtyggtaggttttyggtaggygyggtttaggtaygttatttttttygttaggagttttygagtygagttattygttttttattagttattttatttattttttygtttatattgtttttttattattttttttataaattatatttttattttgtatatattttttttaggttattttaatataygtataygtatatatatttaygattatttttttttttatttatagatatttygtttttataggttgggttttttgtaaygatttagyggggggttttaattttgttgygattttatatgggatattttaatttagtttaggatagatatttttaattaattattatagagttgaaaaatagagagagagagaaagtagtygggttgggtaagtygtygatagtttgygatatttttgygttttttgggagggaatttttttaagaagaggggtaaatgagaggtttataygttggatggtaaatataaatattgttagattagatggtaatttttagggtttttttaygattagattagtttaaatgaaaaaaaaatygggtgtaatttttattattagggagtattggtttggagtatttttatttttaaagagyggttttygttgtggttttattagtatttggggtttatttttttttttttttttttgatttattttttttttttygtyggatttttgttaggggtagaagagaaaatagttagttattatataaatatttttagtttggagttggagtgtttgttttggatatagtygattttgatattaattaaatatataattagataygtgtagtggyggggagggtttttttatttagggtgtatttttagaaaygtygtttgtttttttttttttttagtttagtgttgggagtttgaagatggttttttttygttttgtgtgtattttttttttagtaattatatttttttattgaaatttatatgttttatatygttgttgtttgttattaataaaaatygtttattttgtattattaaatagtygatttttattatatgtygtttttattggtagtgattgtagtaaattaaaatgtttaygtagggatattaaaaatttaatattygttattgttattgaaatatataaattaygttttgttttaaagttttttgatattaaagaaaaaaattatattttttttttttaagttaaagttggtttggttttttttttaaaaaaaaaaaaaattaattatgagaaaatatgttgttagygtggagttttggygyggyggtttyggygaggttgtttgagagggtggygggtttagtttagatttygtttyggggttaygagggttgtaaggtygyggttttygaagaggagggtttgggatgttttgtttaagggygaggyggggtgtttaggtttgtggggtygttggggagagttyggtatttggtttttgaggttttttagttgtygttygagtaggagggagggaatgagtaggtaygtagggaaaatttagtaattgttttgtaaaygygatttttggttataataatttaggygatgggggtagttttaggtttttggtgggttttgtttttttttttaggtgtgttttaggaggtggggaaaaaattaatattgtttttatttttttttattgtttttgtaatagttaaagaatttagaaygagtttaygtggataygtaagttttagygagyggggattttttgygaggtygagygygaggaatagtyggtttyggaggttygggttyggggttttttyggggaygyggtygattgagaaggtyggggygttygtygggygyggygtygtttttygtgtygyggggayggaaggaggygaygtaggttaggagtygtgygygygggyggygagggggygttgtggttygtgtttgtyggttygagtttyggtaayggtgggygygatttattttttttttyggyggtttaattyggggaagaagaaaaaayggtatygaggtattttaataaaatttaagygatttttgatttttttttattgtggttttttatgagttttyggtgtttggyggggaaatagttatygttygggggtgtggtaaatttttttggtaattaagatgaaatagaygtttttatgtgggttttttttaatgaagtaatattggaaatgtaagtagttttagtgtattaaattatatygttatygtattygyggttatyggttttttygttttagggtttttygygtttgtygagggagagagygaggtaggaatagggggtyggggatatgagaagtttggttaagaaattttttttttttttgaaaataaaagygttgttataaatggaataaaatttaagttaatatggaatttatattttttttaaaygtygtttttaggtttagtattttgtgagtaggttggattggattttaygtttaatyggtatttttaggtttttaaagaygttttygaggtttaaatgtttttttggaaaataygtgtagaggagtattygtggaagattgaaaggttttygtagttttagttttggtaggatgtgtaaggtttttygaggtttttaaatgggttttygaggtttgggagattttygagtagttaygygggygttattttagggaygyggggyggyggttattgtgggtygggagggttttygtaygggttgttttgagygtttggattygggattttgygygygtttttttttttttttttygttttttttttttttatttataatttatattttagggatttygtatttagttaattagtttttgtttatttaattgttttgtttttagtttyggatttttgggaggtttttttatggttaatttgtttttttyggtattttttagygttttgtaaaatttgttttttttttatagatgtttygttttygaygtgttttttgaagtttttttttygtttagggtgtttataattttgaattttttagtatttygtygatttygtttttattttttttttttttttaatttygygttggtttygttttttttttttttttttttttttttaygygtttygttttttttttttaggtygtattttttttygttygggtygggagtttttygtggttaggygttygygyggtttaagatygaggttygttaygttgggtygttygtgggyggtttttattyggtatatygtggaaayggygygtttygttagttgyggttttagtttgggagggagygtagygyggggagtttgtagygtttggagagtgaggaaaagggatattttttggaaatggatagagtygagttttttaaagggatygtagttgaaagagattttttttaaaattagtaaygatttggtagttttagttttttaataggagatggttygaagatgaaatgtttgaaatttygtygtygttttatttttgtatataygygtayggtaggtttagattygtatagagaygtagataygygygygttygygtttttyggagaggtyggygygtttyg

SEQ ID NO: 11011 - DNA, 1059 bp, synthetic construct
  misc_feature 1..1059: note = Description of Artificial Sequence: Synthetic polynucleotide
  source 1..1059: mol_type = other DNA
tyggtttgttatygttttttagggaaygagatattgttgagttggaagatttygygggttataggtatagtttttttgttgttggyggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygttggggtttygggyggtayggggygygggtgggtyggttggtgagygttatygtgtttgttttyggtttgttttgggttttttattaygtagttaattttttgtaggyggtygtagygttggttttatyggaaggggttttggygaagttgggyggagtyggttaggyggygygagygggaattayggttttggttttttttagttttagygttaattyggtgttttaygtttttatygttggagatttgttgtttygggtaggttttygtttttttaygyggtttttygaaggttttggggaggttygagggggyggtygttttagggaagggattatggagtttygaattattttttagttgaaagtggtggggtagggtygyggtaatggagattyggggggtgggatggagaaggayggttyg

SEQ ID NO: 11012 - DNA, 1663 bp, synthetic construct
  misc_feature 1..1663: note = Description of Artificial Sequence: Synthetic polynucleotide
  source 1..1663: mol_type = other DNA
tygtttttyggttttygtttttygtttttygggtggtgaaygtttgaagagggaggygtggtttygygtattttgttttyggtygygttatyggtatttatttggttgttgtygtgtttttygttygttttyggggttygagatttygygggatttygygtyggttttgygggaggaggyggyggttttagtagttgttttaggtaggyggtgttyggtagagaggagtttttttggtggtataagtgygtttyggggttttgaygtygtgtatttttatttygggygyggttttttttygggggaggttggggtgaggaggatagggaggatgaggyggaggaagaggaaggagttgagtygggggagygttygttaggaggygtttttttygttgttttygaggtygtygygggtttttttayggyggggagtaaatgttygyggattyggyggygtagygtggatttttgttyggttttgtyggygtygtygggttttaggggtttyggygaygagtagtataggttgggttgygaggaggagaagattyggtttagtatttgttttygttttttgaagtygttttatttgttgtttgtattattttttttggtyggtgtattttttgtgtttatygggggtggyggggagggygayggggtgttygtagtgyggygttttggatttttagygygttygttttygtygtttttgtttttgtttatttttagttgtaggtttttttagagtygggtttggaaggaggaggaygtygtyggyggttttggttygttygtygyggtagttyggggttttattttttattttttgttttttttttttttttttttttttttttttttttttgtttttttttttttttyggttgtattttttttygggtttttgyggygttggyggtggyggyggyggyggyggygggygtagtagtagaaatygggagtgtttagygattttaggttagttygggggaaagaagyggtygtygtygtygaggttttttggtttygggatttyggygttgtttttttttttygtatttgttggggtgggttggagtygtaatygaatttyggtygyggygtttgtaaagtttttttttygaagtttygyggttttagtttattggygttttttaggtygygttttggtttttttttttttttgatygagttygggaagttgtaygtatyggggygtgygygtttagttgygttagggatygtattyggygttttttgggtagtatttgttagyggygggggyggttgtttttaaattgggygygtaygyggtttatataataaggygygtttggttggagatttyggggattagtagtttttttggggygtttygggattattttttagtttttaggtgggagggtyggtaggagtygggtggagttaggtagggttygaagttagtttgttttttaggattyggttatagttgtttaggtagttygttgtgygttggtygttggtygygttggygatygtttgggtyggatgaagygagttggagtggaaattatgtgttttygatgggtttygtgggggygtygatygtttatattgagygatgaattygayggagttttaaagttgaagaygtttgttttygtttygttgyg

SEQ ID NO: 11013 - DNA, 2065 bp, synthetic construct
  misc_feature 1..2065: note = Description of Artificial Sequence: Synthetic polynucleotide
  source 1..2065: mol_type = other DNA
gyggatygyggygtttttagggaatatatttatttagtaatygagattagagttggagygttgygtttttaattttggggygggyggggggyggygggaatttttgtttyggttttttttgtatygygggggtagttgttatttgtaaggygagygyggygygggggatggaagtaggygtttattggatagaatataaaggtagaaatttatttygaaggtyggggttyggyggggygttgggggtgggygtttttygyggttttyggygtttttygtttygagaygtttyggtttagyggtattggygygatygaggtttagtttyggggataygttyggttggtygyggggaaggtattaggtgagygyggtygygtttttyggaatttygttttygygygtttygyggygaygyggygtttattygtttygggagttaggaatttagggttttattatggygttggtygtygtygtygtygttgyggttgtyggggtgagttaggyggyggtgttgggttttttgtaggagtayggygggaaggtgygtaatttygagttgttgagtygttttaagtygttgttygatgtyggygattygyggggtygygtygttygtagggatygttttaagtagttygttaataaygtggyggtggtgaaggagttygayggygttaagttygtggtgttgaggaagaagtttyggttttyggagttygagttygtatttttyggtttttygggggtagyggtttagtygtygaaatttatttygayggttttgtygyggagygtttttgtttygggagtttygtttttggttygggtgtygyggttagtggagtygttaggggatttgggtttgttaatagagttataggatatttygggggggtyggttttygagttygtttagtygttyggggagyggttygtygatttatygtttttagtttttgagttagtttaggttatygagagatttttygtagaygyggttttatygtttagggttttttttgaggyggtatygttttgttttgattygttagaygyggagttygggttyggggtagygaaagggtygtygtagtagaagttttgtatgttgtyggtgygttgygtttyggttttygttaygtttygttttygggyggaggagttyggtttgygtyggtagttgtyggaggagtygagttygyggagtttttttttgttgttgaggyggttttyggtggaagagttyggtttgggtttyggtttgggttygggtygtttttygtatttgaggygtttgtygygygtyggttygygtttgttgagttttgaygtygaggagttgttygtygygtygtygtygttygyggtgtttttggagtygttygagtaygagtggttygtgyggattgtygggggtygttggatttattagttgtaygggttgttgttgygygatygyggtttggyggttaagygygattttatgtttggttttayggttttgtattgggtygttaagagyggygayggygagatggygttgtagttggtggaggtygygyggygtagtggygtattagtygaygtgaaygtaygtttttayggyggttataygtygttgtatttggttgtattgtayggttaygaggaygttgtygtgttgttggtggtgygtttgggtgtttaggtgtaygtgygtgattatagygggygtygygtttattagtatttgyggttyggtttttygtaygygttgygtygtttttttggygatttaggtttgygaggtattayggagttagatgygatyggtggtggaagtggtagttttgttgttaggygtttygtataggtggtygttattatttttagttttattattagtgtatttttgggygttttggttgaygattttatgttttaggatttggttygaggtttgaagaagtygagtttttttagtaagtttttgagygtttygtttatggttttaygtaaaaagataaagattygyggtggtttgttagtttttttagaaatttttygtygatttatttyg

SEQ ID NO: 11014 - DNA, 3487 bp, synthetic construct
  misc_feature 1..3487: note = Description of Artificial Sequence: Synthetic polynucleotide
  source 1..3487: mol_type = other DNA
tygagagaaggtgagttyggygggygtagygggttgggtgggtgtggttygyggtttygggaatagatttaaggtttygttatygtyggttagtagttygatagttygttygtttggygagygtaggttttttttttagaaattgygaggattygagygtattgtttgtgtattataaggttaagtygggaagtggagtyggaggaggaggggygaggaggygaagggtggggagaggggygtttygttttttygttatgtgttagtttttggaagttatttttyggtttttaatttttyggggtaatgggaaggaagagtaaggaggaaggggtygtttyggggtaaaattttgttggggttaggatgtgtaattatttatttattygtttattattgttttttttatttttyggaaatgyggggtagygttaggygttaggaggtattygggaggggggagggggygaygagtttaatggggattttttttayggatygtttttttttttttgaggtygtttataattttaagttttttygttyggaatgttagttttttatttggagtgggtgyggggaggagggtygygttttttttttaagattygygttygtttttttattttttttttgttagtattttttgtttatttttggtgttgtaaaaygttaygtaatttattygattygtattttaaaattagygatttagaagtagggtttagggygagggttttttagygttggagtttyggggggyggggtgtttagtgtaaatttygtttttttygygagtgtygtttttaggttgttatttgtaaagaaaygtttttttgaygtagggagaaatggtaaattttaagtaygttattaatatggygttaaaagatttttttaagtataagttygtttttttttttttttaaggttgyggggggygtygttygggtttggggygygtagggggyggggtgtgagtagaaagtgtgagtgaaagagtggaggggyggggtatgtgtgtgagtgtgtgaagtgtgagtagatttgatgggatttgtaygggygtagtygtygttygggttyggttttggggatagggygggttaggggygttttagagtttatggggagttygggtttagggtgttagtaggygtggtggtggggttgygagggagggtattttttttttayggggttygtaaygttatttggatttttygtyggagttaaataattgggyggggggttgggggggyggygaygggggtgtygggagyggagattygagtgaataagaaaaaagtggttattttttttttttygttttttttgttygtttttattttatttttattttaatatattttttttttttaaagagattataaggaagttttggtttaaaaagaaatagaaatatatatagggggttggtgaatggtgtygatygyggttatygtagttggaggttattttttggggggggtgagtagygtttatggagttattttgygtttatttttagyggtatyggtttaggttttgygggtygatygttttyggyggggggygtggggtttgggaygtygygggttyggtygtttttttygtygygatttyggatggatgygygtttttygttttttygygtyggttttaggagttttyggtttygggagtatttttttygygtyggtttttgtagyggygygtagtygagggtagygttygttaggggggtatygyggagtaaggtaagatttagttttyggyggatgggttttgygtatttttaygaygttatttggygtttttgtaatagatttgttagygtttttygttttttygtttttttttgttygttygtttttttttttttttgttggttgtttgttttaggaagttagygyggagaggggggggatgtatagtataggggagagagattgygtatgttggttagtygtgttttaaagagtatagtgyggggaggttgagaggggygtatgtaataataatttttggaagggtgagtttggygattttttttattaatgattgyggtaaagygttttygggtyggygagggggygygggygggygggggygygttagggttgtaattttttygygggtttyggtygggygtaggggttgyggygggagatgggtayggtggggaggtygagyggttygggygggggtttygagaatttggagttatttgtttttttgttttttygagttttattttgttgataygtagtaygttygggygtygaatygggttgagtyggtgtatatgatttygygttgggtttaygtgtagtyggttyggttttagatatttttygggggttatygttttygttttgtygttttttttttyggttyggtgtaygygggygttgtaygygggggtagtatgttyggtttttggggttggaggttttgtataaattagatagtttttttggaggggygggggatattttttttaggtgagtgtggagggtgyggagtttyggygttaggggtgaggattggggtygggggtagtttttattttyggggtygygyggtagtttagttggggagaggygttgggagagtggaaatgtatyggyggyggtyggagyggygggtgygygttygyggggygayggtagggggygtggtttttgtttatttttttttaattttgtyggttygygtttygttttagggayggattygtagtttttagttttttgtttagggttttgtattatgggtggtattaggaagatgtyggtttgtggyggatttygtttgggaygtatatatttgatttttaaatgagtgatattgtagttttygtttttatttagygttgttgtagtttttttgtyggattttyggtttygtttygttttyggtagtggtattttttyggttttatttttttttttttttttttttttttttttttatttattygtttgygtttgyggagyggygttygttygtttttttttygtttgggtgtagatttgtggttttttatggttttttttygtttatttttgggttttgagatatttttttttttyggttaagggaygagaggggttaatttggygattygtagttgttttgttagaggatggggttgtttgygagatagttaggaaggttttattttagtttttagaggtttagttttgttttttattatatatagttattattttattygtttttggggttyggttgtttttttyggtgttttttaaatttttttttygatttgggtgttaagtttatttatttttyggygtygttttyggtygaatagttttttgtttttttttygtttgggtyggagtttttygtagtttttttyggttttttttttyggtttyggyggtyggaattaygtyggygygtttttagtttgyggtttygyggattgtttttaggggygggttggaggygygyg

SEQ ID NO: 11015 - DNA, 847 bp, synthetic construct
  misc_feature 1..847: note = Description of Artificial Sequence: Synthetic polynucleotide
  source 1..847: mol_type = other DNA
tygaggggaaaggayggatttggygtttggggttttttyggtgggatttaggtgggtggttygygtggggtggggtaggggtatttataggygtttagygttgygggggatgtttygaggaatygygyggaggtttagttygtggtagtttaygttggtagyggagtaggtatatttggtggggtaggygayggttggaggtttatttaggaygttygttagygttaaggttagygttaggygggygygtayggyggygtygatttttgtttattygggggttatggtgtgtagggtttygtttttggaggaggttgtttttgyggggtaagaygygtggagttygaggaggygygyggggagygygggyggtttggggagygggyggyggagttagygyggaggaggggygagttyggtgtttaggygtayggggygygggyggagyggggygtttygggyggyggyggyggtagtaatagtagttttatyggyggggtyggygttgtttygttgygtatygttgggagtgtttaggtgyggagygttttttggtttygttggttygygggtygggttggggatttggggygagygtaatggggygtggygttyggggaggttyggtttggggttgggttggggagygyggyggttgyggttggggtayggggyggtygggtgagttggtyggygttygttttttttatttagtgagtayggtagatatyggagaygyggggtttattttttyggttttttttygattaagaaaygttaatttygttttttattggttgygtygygygttatgtygattaagttgggaattttgttggagygatyg

SEQ ID NO: 11016 - DNA, 909 bp, synthetic construct
  misc_feature 1..909: note = Description of Artificial Sequence: Synthetic polynucleotide
  source 1..909: mol_type = other DNA
tygtttagtatagayggggtattttyggtgyggtttgttatygttttgtttggygttggygtttttagagaaggttatgtygattttttttttatttygttttagatttttttttttgagttgttttttttatagtttttttaggygttattgagagtttttygttttygatgggtttggggygtttggattttttyggggttattttgtygtttttttttagtttttttttttattttttgtygtygttttttygtttttttaggattttgygtatttaggttggttttatgttttggggtattttagtagtgttttygggttttyggttattyggtgayggagggagggagaggttggygagggggyggygttttaggttttagygygattygttttttagtttttttygtyggttatagtygygygggayggggtagggatttygagaatatyggggatttgygggtyggtggtttygggtaggttatttttgaygygggtgygaggtttttygygggygtgtayggttgggtyggagtygygtygggggtygggataygtttggggttagygttggygtygtygttygggtggggtgggtygggttygggtttagttttttttttaygggyggttygygtttygttttttagtgatttttatattttttgygtttygagttggaatttyggtaggttttgtttygggtygygygygttttttggggattagggttgtggtttttgtttygygtygtgtttttagatatygtygggygttygttttttatttttttttttttttttttatttygyggttgaygagggtygtttttaagtggttatgtttttyggtatggaygattttttagtgtttttgagggtttagggtttygttttygtttyg

SEQ ID NO: 11017 - DNA, 2150 bp, synthetic construct
  misc_feature 1..2150: note = Description of Artificial Sequence: Synthetic polynucleotide
  source 1..2150: mol_type = other DNA
aygtygygtttygtygttygygggttygtygggagattgygggttygtttygygggtggggygtttyggtttttttygttttttggaggttataggttayggygayggyggtgatygggagagtaggttgygaggygygttttatygggttatagataaattatttyggtagyggtygygtyggaattttttttaagttattaaattygtttaygygygggagagtgttggggatgttttatgygttygygattttagaagttaggagtgtgttatttttttatatatttattttyggttttgtaygtttttttttayggttygagtttttgtaaatgtttggttagatygaggtygtygagatgttygttttagttttttttttygtgggtatttagggtagttygtgagygtygttygtygtygtttttagyggygtygggttttygaatattygtygggtgagygaagtatagyggggttayggagygtttygaygyggggayggggagggtagtgttttttttataaattagttttttgggtgaagtttttggggtttggagattggagtgtagggtgtgtgtgtgtgtgtgtgtgtgtgtgtgttgtattttgattttatggaggatttgtgggagaggaggtgtaaggttttttttttagaagtttggygtttttaggttttagttaygygggaygtttttygataattygatttttygttaggagagattygatttaggtttgygtygygaggtttttagttygtttttttttgygattttaaatttgggttttgatttttygtyggtygyggtggttygggttattyggyggyggttgatagttgagygtaaaggygtygyggttaaggttttygyggagtagttygggatgygtaygtygagggttaaggaggaggtygttyggtttggagttgggatygtaggttgggggtygggatattygggtttygtygggtygggggtagggtygygggtttgatagttgttgyggttygygyggaygygygttttttgtagttygttttttttatgtttgatttattattttttgttttttttttttttgttgttttaaaatatttttygaygttagtaaaatataatgygtttyggtygtygtaaatagtygggagggagagtatatattyggygyggygyggtygtyggttyggtttttatttttttttygtttttagaaaatgttataaaagygggtagggygyggggagggyggttgygygttyggyggtyggggtttttttttygygtygtttttttaygttttttygttygtttygygygttygtttttttygtaaatttgtttygttatttygtttagyggyggggttyggggttyggggttygggatttatttygtyggagaattttgygttttttttygttttttttttttygygttttttyggttygtagttttttttyggtagtyggygaggtgggtagttygtgggttatygaaagttygyggaggggaygygtattatatggtagttygtttttagtttttygagtgygttgggaagggggaggggaaggggygaggggaggtyggggggaaagygagagyggggyggyggygggagtgggtaggyggggtggygagggyggyggtygtttaygttagygttgtgygatygtagttygggygtgtayggtygttgttgtygttgttgttgttgttgttgttgttgaggyggyggyggttyggygttgtttgtttygygtygygyggtttgygtttttttyggaaygtttatatttttaatygttatattgttgatattyggygttgaygttattygttttttatttataataattttaygggagtygggtagygtattttttyggtygttggggygyggtaygttyggygattagygtaagtygtttygygaatggygtttygggggttggggyggggggygggggaygggggygggygygygygtttygttggttygygggagggggygygttttatgtygtygtagtagtagattttttygttttgtgyggtygygyggttyggagagtttttttttttyggttyggttgatygtttygttyggtttggttttttyggttaygaaagayg

SEQ ID NO: 11018 - DNA, 506 bp, synthetic construct
  misc_feature 1..506: note = Description of Artificial Sequence: Synthetic polynucleotide
  source 1..506: mol_type = other DNA
gygttygttgttttygagtttygggtttgagtgttggttggyggagatttatagtgggtgtttygttttyggaygatgtttttgggtttttagatttagagtttygggaygaaattgttttaggaagattyggaaggattygtyggtygyggtaagggataggyggtttttgagataggaggagttaggaaatgyggggtttggtggggtgaggagtayggggttttttttttattttygyggggattttgttatyggtttagtgtggaggttttatygtttygttyggattygtggggtttygatagtgtggtttttgygaggattttttttatttttttygttttggggttgttgygggagggygttygggtagtattaggttttgagtgtttagggttyggtaggggtttttygttgtygtttttttgatttygtygtttgyggtttagggttgttggttttttygttggtttgggaggttttagtatggaygtygtgaggyg

SEQ ID NO: 11019 - DNA, 1503 bp, synthetic construct
  misc_feature 1..1503: note = Description of Artificial Sequence: Synthetic polynucleotide
  source 1..1503: mol_type = other DNA
tygagtgggaygaatttttygttagttttgggtttttttatttgtyggttygyggtyggygtyggtataggyggagggygtttttttttttttgyggttttaagttaagtggaagatttttttttaagttttttttttygaagtttygygggtttttygygttttagttttagttatagtttgtggaggyggtatttygaggttgggygttygtgyggygttttggttttagtatttttygtttygaggttyggtttygggggygyggtygttygggttttygtgtgttttagggggtttygggtygygagtygttgtygaatggtttttgataaaaaaatttttgattattaaggttagtttttttttgaaagtttygttygtttygatataggaagtagaagggagygagagttttagagygyggyggtagyggyggtttggtttttttagagggttagagttagggatatgygggygttygggatttygygtttygygyggttyggygtttgagygttttygtttttygtttyggagttgtyggyggtatgattygataygtyggggygttygygygyggggattttayggggtaagttygggyggtygtttttttttttttygygatttttayggttygygttttggtygttttattttattttttgttttagagagtttttygggygygtgatttyggggttgtygggttgataygggatttttatygtggtygaggttagaatttggttttgyggggtagggggyggttttggtgatttygttggattygatgttggttaaatttttaaggttaggtattttattgggaatttagtgtatattttaggttgttggtggayggattaygagggagtgygtygttatttgttagygtyggggttgttygygtggaygyggttttttttttggygtttgtttygtttgaattttgtaaataaaattygyggttttagtttygttagtttgttgtattygttgttttgygagtygtagygygygttttygggtattagagtttygttgggygtggggtyggagattyggattttygtaattttgggtgttygyggtttaatagttgatyggtttttttggatygagggtttattgggtttttttttygtygtttttttgttttggtygtagayggtgattttyggatyggttttggtygagtttagtgtttgggtagggtttagggygtaygggttgygygygggttgtggatgtatgaygtygaatggtttgggaattgatttggagaggagttttyggtggttaagttttygtttygtttttttgtygtttttagttttatttygygagttygggtattgttyggggttgggttttgggagaaagttttttygttttgtttagtttagagggygttttgagaagttttaggtgttgtagagaygttyggtyggaggyggattttyggggaaagtttatttttgggtatttaggagygyg

SEQ ID NO: 11020 - DNA, 907 bp, synthetic construct
  misc_feature 1..907: note = Description of Artificial Sequence: Synthetic polynucleotide
  source 1..907: mol_type = other DNA
tyggatyggtatagggggayggttagaygggatgtyggaagttaagggaygtagaggtyggygggtggyggygatggagaggatagattyggtttttagaggaggtygtgagygyggggtttgygtyggtyggaggagggattyggggggttgtaatatggttgttygggygtygttttttttttgttaagttagggttttggggagttgttgtygtttttygttygggttggggygaggaaaggaggggayggygttgyggtttyggaatttgtattgygattttggtagagtaaaygttgtatttgtagtttygaattgaattttttgtttttttttttttttttttttggttaygttttttttttttttttttattattttattttaattggttttaaaygagggtgaaagttgagtttgaggatgtygttgttatagaaattgtatagtaattaagggttggggaggyggggggggggggyggtaggttttttttttttatttttagtaygygtatatttttttttatttttttagttygtygygttttttyggagatttatatygttatttttygtygtagaaygggagggataggaatayggayggagggatygggaygaggggagggttttaygtagtatagttgtttttttgyggagygtttaggagattygggtatttttggaagygttgyggattgagttgttygyggttgttttygtttygagggtygggatagtattttaggagaagagggaygaagagggaygatagataaatagttggggagaggygggggggggyggttygtggggttygttgggttttatttagttttgttyggagttgttygaaatagtatttaggtttttgygggttaggatgaaaggtaygtgggtyg

SEQ ID NO: 11021 - DNA, 1925 bp, synthetic construct
  misc_feature 1..1925: note = Description of Artificial Sequence: Synthetic polynucleotide
  source 1..1925: mol_type = other DNA
tygtyggttttaagtaggaaggygttttyggtatattagttttttttagygtttttagygggttyggygtttggagggttaaggygggygygtttygygggtgggyggggggggggggaygggatyggtgtygggagtttygttgttttggygttttttgggtttaggtttagtygttttttgggtttttttygyggggtygttttygttttttttttgtygagaygggygtggggtayggggtygtygttyggyggggagtttattyggyggygtagaygtttygyggtttyggggagggatttggtttgggtttyggtttygygtttttttggggaggagtygagaggttgtagttggyggyggyggtttygggygggagggggttttaggaagyggttaggtyggagttttttattyggtygtagttgttggtttggttagaatygagygygttttttyggttttygtygtttttttttgtaaatygygggtaggaggagttttttttttagygggttyggagtttagaggygtygyggggygyggtygaggggaggaggaaggagagygggagygtagtyggttygggtttagtygtgattygtggggyggyggtttygttaatttgtgggygttgaygyggggggyggtttygyggygttygatatttgttygttygggaygyggggygtygagaggttyggttaggygggagttgygttyggggyggtygttgtatttgttygggatttygtyggtygtttttygygtttatttttttygtttttygttttttttttttttttagtttyggtttttygggygyggygtgagagtagagttyggttyggaggagtygtttttttttygttygttygttyggygtttggagaggagygygttgaggatygggaygtttgyggtygtygttatygtttaggttygtygygtttyggtygggatggatttataygttygatgagtttygygtyggyggttgygagygtygagtttttttttgttgyggttttagtygtttttygygygttyggtttygyggattaggatttttgggtttttyggttgagggygyggtygtttyggagaggtygagyggggaygggttygagatggygyggggatttagygtttyggyggygggygttttgtaygyggttygggttyggggatagtttyggagttggtagtygttyggtatygatggattttgattygygaggyggygtygygttygtgtttagttgtagttagaggggygygygggtagaaygygttttaggttygggtyggttygygyggttatgaagatgatgttggtgygtyggtttygygtgtttattttgatggtgtttttggtggtttgygygttgtatatygttttggatttgttgtttaggttggagygaygyggygygyggttttygggggagttyggttgttygtgygygtagttygtygtygaggtggtygygttyggttgggtttaggttyggggtygtttyggggagttttyggtygtttttttygtygtyggygaygygggttggtttaataagtataygtttygtattttgtaggattttagtttygattttttttttaatttttygttttattygttggagaaattgtygttygyggtygagtyggtygagygygttttgygggggygggatttyggygttttaagattttaygatttygygtatyggtygttgttgygagatttyggttygygtyggttygagtygtttttyggtttyggyggagaygttttttttttggttaggttgttygagtattygttttatygggtggyggtttygtygtttayggaggaggaygttttgtttaatgtgaatagygatattaggtttagttttaaagyggyggagaattyg

SEQ ID NO: 11022 - DNA, 1287 bp, synthetic construct
  misc_feature 1..1287: note = Description of Artificial Sequence: Synthetic polynucleotide
  source 1..1287: mol_type = other DNA
tygtggttyggaagtggattttgttygaygygggggtggtygttggagggtygaggatgtttatataggtttttggagggtgtgttttyggagtttgtttygttttttggatttatgggggattagtaaygtygttatatttttttttgtttttgttagtygttttttygttttttttttttggttgaggttggtaaaggtaggtaggtatgggggggyggggttttaggagggaggaggggttggtgggyggggtttayggatatttygtttygtttttagtggggtttygtattttttatatttygyggtttttttaggttagggttttttattatygygtttagaggtygggttagtygggygtgtattttaggggygtttygtttttygyggtttgggattttttagttaggatagtataaaatttttttatygtttattttttgtaaaaaatygtggttttyggyggattttggagataggaggtgtaaagggygtttataygyggttygggttygyggtygagagttggggggatttggagyggggtygggtygtaagaagattttgattttgtttyggygttggggygygtgttaagggttygyggggtattagttgtattttygaatttttgtgtttggtyggggagtttttaaggttttatttygttttggagggggttgyggaagttyggaggtgattygggttttgggaggggygtttttaaygtgggggaagggagataggggttttygaagatagygygagattyggagggggttttttygatttaagaygtggtaaattgaggtyggygaggagygaggttgagttyggggattaggyggttttttattgttttttyggttygtygtttttttgygtttgttygtaygggtagggtyggyggtygagtttagygggttyggggttaggtttgggtttygggggyggygttttttttttygygtygtttttatgttygtttttygygtygttttygttygagttgtttttttttaagtagtygttatygygtattttgtgttggggtygygggatgyggggttggygyggggttaygtttygtygtagtttttgttttattygtaggtaggagatygyggttattattagygttattagtagtatygttagtttagtttgggygtaaggagagggatgttagggattygyggtygtttygtttygtatttttttygtttatatttttygttgagataggtttttttttttttygggagtttttygggttaygyg

SEQ ID NO: 11023 - DNA, 2906 bp, synthetic construct; identical to SEQ ID NO: 6069
  misc_feature 1..2906: note = Description of Artificial Sequence: Synthetic polynucleotide
  source 1..2906: mol_type = other DNA

SEQ ID NO: 11024 - DNA, 2146 bp, synthetic construct
  misc_feature 1..2146: note = Description of Artificial Sequence: Synthetic polynucleotide
  source 1..2146: mol_type = other DNA
tygygtgttaggaaaagttgtgaggttggaaatttyggagtaaggttygattttggttagatttgtaggttgyggaatygggggygygygggygtagygtagtatagttyggttatggagtaygyggtggttttttgygttttttatttagggattgagttyggggttgtyggggagagygagagygagggygtygygttttyggygtagatattttgtagtttyggygygtttttgtgttttagtttyggggaagagttttygtygtagtttttygttttagyggyggaaggygyggttattttttygttttttagyggtggttygygggtggtggagyggtagtgggaggtyggtagygygggygtygygttttyggaggagttygygttttttgaggagygygygtgttyggaagagttygyggygtygtttttygaatygygygtttggtttgaggatttygygtttttygaggagttyggggagttygygttygtattttyggggttyggggyggtgtayggggagtyggatttggtgttggaggtgtyggggygtyggttgygygygtataaggyggtgttggyggygygtagygattattttygygygygygygtygygggaygtgttgygggtgtagggagtgagtttgayggygttgyggttgtttttygtygaygtttatagygggygtatggygggygtgyggttygataaygtggtygaggtggtggtyggygygygtygtttgtagttgttyggygtygygtagygygttatygaygtygtggggtygtagttgagtttggttaattgttaygaggttttgagygyggttaagyggtagyggttgaaygagttgygygaygtygtttattgttttatgagygattattatttggaggtgttgygygagttygtygtgttyggtygtttgtygggygtagagygggatttgttgttgygtygtygtttgygygtyggtygygtttattttttggtygyggygttygggtyggygggggagygygygggtagtyggttttagagtttttygggggaygyggaygygygyggggaygyggtygtttattgtttttaygyggyggtyggagagtggygygagttgaygyggttgttygagggygygtyggygyggggttgyggtttgtgygttttttataattattttttygtggygggyggygtggygttygygggtttygayggtygygygygttygttygattaggttttttgttataattyggttayggatagttggagygtygtgaggtttttgygttaggygygttygtagttgyggttgttggttttggayggttatttttaygtygtgggyggygagtgtttgtttagygtggagygttaygattygygygtygatygttgggttttygtggygtygttgtttyggggygttttygtygtggygtatgaggttattatttgttayggygagatttaygtgttygggggtttttttttttatygtttgtttaagtatgattygyggygygaygagtggtaggagtgttygtgtagtagtagtygygagygttyggtygatatggtggttttygayggttttatttatygtttygatttgagyggtagtygyggygaggygtaggyggyggggtygagyggggttagygtgtttygatattattgtttggttaagtagtggagttygtgygtygygtttttgygttttttyggyggttttaygggtttgtagttttttygttgygtygttttggayggygttatttattgygtgagtygygygggtatttggygtttttagtttgttygggaaggygaggtyggyggygaygtaggttagggyggyggtttygaggygttgggygtttttttggaygttyggggtgtgtttatttygttygtttttagtttgtttgagaagtygtttygaggggagtagggygtttygtaggtyggyggggtyggygggygtttttttyggtaggggtttgyggggtttaggtttttttgggttygyggaggaggaygtggtggggagtyggggtygttggttaygttggtggtttggatatttygaaggagtttygaggaygtttttagggtygttttyg

SEQ ID NO: 11025 - DNA, 865 bp, synthetic construct
  misc_feature 1..865: note = Description of Artificial Sequence: Synthetic polynucleotide
  source 1..865: mol_type = other DNA
gygttttgygttttttttttaygttatttgttagggagtygttaaatagtaagatygygygttttgyggttttagagtgyggatttyggtygygtgyggttttgatygygtygttttatttttggyggggttaygtayggaygttatggttggygtygyggagtygggygatgygygyggattttttyggggttttgattgtttttgagttttttttgyggggggygtgygyggttygtttttygyggygttaygyggttttttttyggtyggggattggtgygttgggyggggyggggyggggygggataaaggygyggggtttggttgygyggggtttgygggtagttttaattttgggttygtagtttgygttgggtgygtaggaaggttagtgtgggggtygttygatatttttttttygyggaggtgggagtygagttatattttggagtggggattggtygyggagygggttgtttagggtyggtygaggtyggggygagttttgygyggygttggagattttgtattttygggygygygtagggttttyggtygtggtygtagagttaggaggggyggtttyggagttyggygyggggagggtttaggygtagtyggggttggtagggygygatattygtttttttttatttttgaaagggttttttaygtygagaagaggggygggtatggtyggttyggygaaatyggtttgtatagattttgggaagttatygtttgyggagggtgggattttatagtttgtttatttgtttaggttgagatttygtgttttagttttggatgttttaygggtttttygtttygggtagyggygtaygggaggagaagattttyg

SEQ ID NO: 11026 - DNA, 865 bp, synthetic construct; identical to SEQ ID NO: 11025
  misc_feature 1..865: note = Description of Artificial Sequence: Synthetic polynucleotide
  source 1..865: mol_type = other DNA

SEQ ID NO: 11027 - DNA, 1463 bp, synthetic construct
  misc_feature 1..1463: note = Description of Artificial Sequence: Synthetic polynucleotide
  source 1..1463: mol_type = other DNA
tyggggggtygygggaygtttaggaagygaagyggggaaggtttygggygygtygtaggattygygttggagatgggtttgaagttttgttttgaaaaagtyggttyggagtgggttgttttyggtgtttttygagtttttatgttgttatttaagtagtagaggaagaatygggtttggttygggaagggtgggtttagggttaggggtgtaaatttttyggtaaaagtyggtaaattaaaagtygtatatattttaggtttyggtttaggtttyggyggggtagggttttygaagtttyggggygygtagaygtyggggttttygggggttaagggaayggygggattygatttttttgttttyggtttttygggttttygtttttygattagtygttgagtygggggttggggtygtygttttygttygyggttygttgttttttttyggygygygttattyggtygtyggttttttttttygyggggggtttygtttygygtttygttttttygggttgtagtyggtagtttaygtttagggagggtggagggaggaggagaggygyggagaggagggaggggagaggggagggaggaaggygagagaaagggagttgtttttatttyggattttttagagtttgtttggagygygtatttagyggttttygggttttagygttttagtygyggttygygttttttygtttygttttttttttttttttttttttttttttttttttttaggtattttygttttttttttttagyggttgtagtttttagttttaatttttygygtttatttttgggaygygygttttygttttattttttgttttttttttttttttttttttttttttttttttggttttygttttttttttttaggtygttttttyggggttygattgtttyggtgtttygttttyggttygygttttgtttygttttttttttgtattttttgagtygttygtygtygtygtygtagattygtygygggagttttagtttaattygagttygatagttattgtttyggttttagttttagttttatagttygyggygttygttygagggagtttyggygttyggggaaggttttagtgggttagygygttttygtttagtttygygttttagttttgttyggttyggygaggaaggatygggaagatgaataayggyggtaaagtygagaaggagaatatttygagygaggttaatttttaggaggaggaggtattgggyggttyggtgtggtggygggggygaygygggatttagtgygggyggtyggyggggygygggttyggggygyggyggtggaagaaggtttaggtatggttygtgtttyggaygtagttttatagtgtggttyggggagggtggatttygggagygtgtgtttttgtgtttaygygygtttgygggttttaaattgyg

SEQ ID NO: 11028 - DNA, 1437 bp, synthetic construct
  misc_feature 1..1437: note = Description of Artificial Sequence: Synthetic polynucleotide
  source 1..1437: mol_type = other DNA
tygtaggaatygaggagtyggtyggtttaggtttttaaggttayggggagggggttagggyggaaaaggtagtggagtgagggtgtygttttygggtygtgttaatttygtttygtttygtgtygtygaggyggggttttggttaygtaggaggtgygtttyggaggagggyggygagyggttayggggtggggagtaaggggygygygggyggtaggtatggaayggaygyggygtatttygtttatygygggaygttyggayggyggtyggygygygyggttygtttygagttygagagggyggggagataatgtttgttyggyggggtagtttaggtygtaygttttygttygyggataygggtygtttttattygggygagagggtagyggygggaaggygtygggagygatggttatttyggtttygygaggygyggtaggtttygttygttttttttygygttygtttggygtgygttttattyggtaagtttyggggttatagatttatttttttttttagggygtygtyggagttygygtyggagtyggtgtyggtgttgtygtygtgttygtygttyggttttaggttgtttatggtgygggggagggggyggygggaaggaaygygagggygagygyggygtyggtttygygggaagtgggaaggggygyggggagyggtgygttygygggtgyggagygggtggygggggatttayggggtagtgagaggggtagttttygygtygggttagggttatattaagtttggygggtgyggaaggtggggagggggtgyggygggggaggtagtgggagtyggaggggtygtygttttygtttttttattgygatyggygagtgygttgyggyggyggyggyggyggtagyggyggyggggggygggygtygggggagggggygggygtyggyggyggggggyggggtyggaatyggttttagttggggttyggttagttttttttttygttygtygygyggttttygggggaaygygtagttaatttttatygtttatygtgggttygtttyggtttyggtygyggggygtyggttttyggtygggttttttttttttttttygtttgggttagygttttttttttttttttttttttygygtttttttttayggygagtttttaaattttgatgaattygttyggygaatttttttaaaggggtygygygttgygygttttagttygygggaggtggagtttygtgtttygtatttagygtttyggtttttgggyggttttgttygggyggtttygygtttagggtattygtagygaggttttygggtygtygattttttttgtattttgatttagggttttggggttttygaygtatttattttgtttttaaatttagtygygtagattttagtttygggggatyg

SEQ ID NO: 11029 - DNA, 717 bp, synthetic construct
  misc_feature 1..717: note = Description of Artificial Sequence: Synthetic polynucleotide
  source 1..717: mol_type = other DNA
gyggtaggggygggattyggaggyggggygtttgtttaygtygtttagtagyggagggaggygyggttttagtttygygtttaggagtygtataggygttyggggtygtagtaggagtttttttagggygtttagygttgtatttaygagtygygygtygttttygtttagtgygtttaggagygtyggtagtagygtgtttaygtgtygtatttgttgggattyggggttagttttttgtagatttygtygygatygggttaagtttttttttattttttttttttttttatatttttttgygatttagygygaggtggtttaggtttagtaggtttaattagygtatagtgggttyggggtttttttgttaggtgaggagtygttttaggatgattttttttygtaggagtygtgyggtgggtyggttttgtaatagttaggygaggtatatggggttagtaygttygyggttttygtgtaggtygttgygatttagggattaagtttagggttattttttattatttattygggaagtaggtttatttttgtgaagaaggttatagtygtgagaygttgygggtygttygygttgygaagtygagggagtaagtttgygaagaggtttygtaggtggtggtyggtatgtgttattatagtattggggtgggtggaaatgggagttttygtttygtttggyggttttttttttyg

SEQ ID NO: 11030 - DNA, 1713 bp, synthetic construct
  misc_feature 1..1713: note = Description of Artificial Sequence: Synthetic polynucleotide
  source 1..1713: mol_type = other DNA
gygttgtagattygggttttttttttagtttaygygtaagtygggttyggtttatatttattatattttttyggttttygtttagygtygttttttttttygggtttttttagtatygatttagtatttattagygtygtttttaggtttttggtttagtttattttygggtaygtgtgagtgtgtgtttgtgttagtttgttagttttatyggggatygggttygtttatygagagagaagygttaatttttgttttagtattatttttagtttttggttttgtttggagatttagtggtttatttygtgtaggyggtagtaygtttttagtattaatttgaagttygttaygaattyggtgatgttttygtattggtygttggygaattttttttttatttgtagtagatatatgttttgttygggttgttgygggaaggygygatygtttyggttttygttgygyggttttttygttattttttttttygyggtggtaaygttttttaagggttgtagaaagggggyggtgaggtttyggtgttttttttgtaggaattygtttaggatgyggtagttttgttgtagttygtaggttagtttttgttttttgtagtaatygttttygattattatygtttttattttttttttttgatygttygygttttttagygaggaggtatttttttygtgggtyggttttgaggtttgggtygtygttgttatttttttttygtygttttttttttyggtygtyggtggyggtygttttttttttttagtyggttttatygttttyggygtttygggtatatttatgtttyggtaggtttaggttgggyggtgtggaatagtygttygaggtgttgggggaygygtgagygygagtygtttttttayggttyggtygyggygygtagttttygttatatygggtttggttttttttagtygtyggttyggttyggtgygygygggggttttgagtttatygtyggyggggyggggttatatggygygygaggaggggggagagaagaggagagtttaggtgttttttttttttttttttttyggyggyggygygygtayggttttygtyggttttattttttygtatttygttygtttgttttttatyggttaggttttgtygggtygtygyggtttyggygttttattttttttygggttagyggggggttgggagggggygaggaggaagggggtttttttttttttttttyggagggggtygtagyggyggtttyggtttttttttttttttatattttttttygtttttttttatttgygggggataygggtagaaggaggyggtgtayggayggggttyggygataattgttagttagaagtttygttgggyggtgaggggggagaaaggggaggggtagggagagaagggggagggtatttagtttttyggttgggaagagttgtggagagaagtaaagaaagaggttttgtygttattttyggtgygtatgygtagtagaataattttttttttttttttygttattatygtgtttygtttygttaygtaaaaggaagagtttyggtttagttataggtttagaagtttgttagggttgygyggattaatgatgtaattaatygtaggttaatygaatatgttgatggagggggaagtaaggygtttgygtagtttaattygttatyg

SEQ ID NO: 11031 - DNA, 699 bp, synthetic construct
  misc_feature 1..699: note = Description of Artificial Sequence: Synthetic polynucleotide
  source 1..699: mol_type = other DNA
gygygttyggaaagtyggtttgggttttgttaattattttgaaggtaaagtatttgtatttttttygtygaggttggttggyggygtygygttggaggggaggaggttygggaggaggaggagaaagagtagygggaggattygggttgggaggggagygtagggttggggaggtygatgagyggttttyggtttttyggagaagtagtygagayggtaaggaggaggygaggttttgtyggggygaggygttgtttttaygygtttyggtygtyggttgygggygyggttgggyggggagtygaggyggtygttttygtattygttygttygttygttggygtttttttttygtttygttygtatttataggtatatattttaygtttttagtagttgtygttyggttttaygtatttatttgtatttttttaaygagttatttgatggttgttagyggygtgggtttygtttyggygggygggggtyggggyggggagaaygyggygygggatgtttygagygttygttggggagagaagyggyggyggyggyggygttgygggygygttagatggggygggaggaggggagattyggtatttatyggtttagagttgtttgaygyggtttgggyggatttygtygttygggtgtttaggtaygattttagggatttagggtaaagyggttygygyg

SEQ ID NO: 11032 - DNA, 1191 bp, synthetic construct
  misc_feature 1..1191: note = Description of Artificial Sequence: Synthetic polynucleotide
  source 1..1191: mol_type = other DNA
tygatttttattaagyggatggttaagygttattyggaagtgtttattggtgggggygggaaggtatygtagtttaaggtattygygggtagggagygggttagggygtgygygaggtygggggtagttgggaayggaggaggaggggttygttygaggtttygttttttatyggttgyggtttyggttatagttagggtttagagggtttygagtttygggagyggaggtyggagtygggtttttgtagaggttgtttttttttgttttygttyggaygtggttttygttgttygaggtgtagttgtagtagggttyggyggtatatggtttttagttttttaagtygggtttttagggttttggggttgttyggttygttttttyggtygttgtttttagtttttyggttygtgttggtttttttagggattyggygtgttttygygggygtttygttgtygttttygtyggggagtygtaaagtttgayggaagaggttgyggttttygygttttagtygtyggttttygagtygtagtygggygtttttttgaygtagtygygygttttgtyggttttattygtttygygtayggatggtttttaagtggttygtygttaggtyggtaaatygtttttttagttgttgtygggygtygttygygyggtttygttagtttaygtygtygtygtygtygttggggttgtttttattatgagttyggtyggagyggtttggttttyggtygttygtagtatygttttygtygtagtaattttygygtttagtggygttattaygtatgygttatatyggttttattttaatygygtygttagtttygtgggttgaggggtygygyggttaggygygggtaagttyggggttggtagggyggtyggggtgaygayggaggaggagaggaggtygygggyggyggttgttggtttagagttaaaggaggtygggaatttgtttagattgaggygtgttttgttttttgtggtggagttgttttttgggtttgttttttttaggttgygttgatatatagttttttyggggagtgttttgttgtttagtttttyggttgygygggaaaaagygtgtatttttagttgagttgtgttagggygttttygtgtaggtttgggtattgtaggaattagtygttttygttygtttyg

SEQ ID NO: 11033 - DNA, 536 bp, synthetic construct
  misc_feature 1..536: note = Description of Artificial Sequence: Synthetic polynucleotide
  source 1..536: mol_type = other DNA
tygttttttaygtgttygygggggggggyggggtyggtggattgggygtgagttaattggttggggggyggggtattaygggttggtttygtttaggygttygygyggatttygggtggaatgaygggagggagtttyggtagtttttattttttagygatggygtygttgtgtygygtttagtttttagtttgtyggtyggtatttatygttattyggagttygtttagayggtgagatttggggygggttygaggtagyggygggaygttatttgygatygggattatgaggagttgttagattygtggggtyggtaaygagagtagtygyggtatttgttgagaggaaagagggagyggttyggygyggttggggygyggtagaggtttgttygattttyggttatgttattgttttgygtgygyggtgagtgygyggattgaggyggggaggyggggtgtyggygtagaggttttygtatttttttagtggaygttyggtgatygttttatttaaattttatatttygttyg

SEQ ID NO: 11034 - DNA, 728 bp, synthetic construct
  misc_feature 1..728: note = Description of Artificial Sequence: Synthetic polynucleotide
  source 1..728: mol_type = other DNA
tygggygttttattygtygtttatygttttatttttttattttttttattygggttttttaagtttttgatttaggygttagatttttttattatatttttttattttaggygattygttttggtttygggtgtttttagtttgygygggtygtttttagttttyggtggatattygtttttagttygtygttttttgttyggttttgygttttttggaatttttgggtttttagttttygtygtttttagaattgygtttgygtaataatggttatagtggtgagggggttttttygtygagatttggggatggggyggggygtagggaagggaatygtygyggtagtgtttgttygggggttgggttggttttatygggyggggtyggtttatttgtttttttttaygtagtgtaattgattttgttttttgggttagagatggttttgggtttygggygggagtatygggttttgtagttgtatttgtattggggggttgtaggtygttygggttyggagtatattgtggaaggttatygtttttttgtygaggtgagygyggagttggtygagaaggggtaaaggagyggggyggagyggggttagagaygtggtttttttttattttygtgttttttttagatttaygtggtttattttagtatygtttttgttagagttgaygaggttttggggygttygggaggtttggtygtgttggtyg

SEQ ID NO: 11035 - DNA, 1431 bp, synthetic construct
  misc_feature 1..1431: note = Description of Artificial Sequence: Synthetic polynucleotide
  source 1..1431: mol_type = other DNA
tyggtyggtttttttttttttattttttgatttyggtygttttayggatygtagggattgttttatygtttttttttaygtaattattagagaatttttttaaaaatatagattygatgaggagtggttttttygttttttttttgtgtygagaagggatttyggtygttaataataaagaygtttttygttttttttttttygtyggttygggttygtttttttygygttgyggttttyggtttagygtttttttttygagtygggttgyggygtttttaaatttygaggtygtaygtatttgtatttgagyggttygggtygaagygtygggtagaaggggtygagagagaatygtagtygaygygttgttttttataaggygagattygygtttygggygtygttygatttttttygtttgtagattggttygatagaggagyggggattagggttatagttttyggygtyggggygaagaaggayggyggygttttaggggtttygtttaygttttygagtttygtttygygtyggttttgtttttttataagagttygygttttgttgattaayggtttyggtgyggggygttggagyggtygtygttgttygtyggttgttttygggttttaygtttygygyggtygtggtygtagtygtygtygttatygtttttttttttggtattgtagaygttatttagatttagttaggttttttttttttttaattttgttttttttgtttttttttagtttgttaagygygaggttygtttyggtagygggaggaagattggaggggaayggaggggaygagtataatttttattgagttaggagttggttattgattggaggaaggtgttaaagttgatttyggttttagtttattagygggyggggggagagayggagtttagttttgttttatttttattaattagaggtygttyggtagggtgggaggygttttgagtttaaggagaggttgagttygtttagtaggaggyggggattgyggaaaagaagaattaataggaataaaggtttttygtttttttgatttgatggattatatattygggttaatgggggaatttttatttygaagaaagtgggatttgtttttygggtttgagaaagaggttgygyggagtyggaggggtygaggttgygtygygtggagtggtttggtttaatagtagggagggtagagygatgttttttgattttttagaagagttaygtgggttgatttagagtyggggyggaaaggttgygtttgtttttttygggttattgatagaagygttaatttttgggagtagttygttggttttttttttttttatttttttgtttgttttyggygaggggtggttttgatttyggygatgagtttttagaaaggtaaygtggttyg

SEQ ID NO: 11036 - DNA, 588 bp, synthetic construct
  misc_feature 1..588: note = Description of Artificial Sequence: Synthetic polynucleotide
  source 1..588: mol_type = other DNA
tygtagaataggygyggagttaggtttttggatttgttttgttggaaggagggtygyggagaygtaggygtttygggtygttygygttgtttttgtttgtttygtgygggagtyggggtttttggttttttggttttttggtttttgyggttygggygaatttagagygtattygtaygtyggtttyggtyggtttttagygttygggttttaygggtygygtttttaygyggygttttttagagattttttttttttygggtgggyggygtagyggggtttyggygtygygaggatttttygygttagaataaaggaatgtggggagggggtagggaggagtttaggttattgagtagttttagtataattgtygttyggaggygtttttyggtttygattygaggttttygttygttattattagattygtttttagtttyggattttygtagattttatyggttygtaggagggagyggygtattgggggtygtayggattygttattggagatygygatyggaaggtggygttaygyggtttttataggtttgggatttttattygagttygtaaagtaggtyg

SEQ ID NO: 11037 - DNA, 1203 bp, synthetic construct
  misc_feature 1..1203: note = Description of Artificial Sequence: Synthetic polynucleotide
  source 1..1203: mol_type = other DNA
aygtttaattttygagtttgtayggtgtagtatygtttattttgggtttagggtaatttgggtgtaaaygtttttgygggyggatygyggggtgggtttygggtatataggaggattagtagtagtyggtyggtaggyggagygttgttagaggtttgggttttataataatttttataggattaaaataaayggygagaygggttgygygtataatagtatattygggyggttagtygagtygggggtttyggttygyggttgygttaagttttagaattatttagtttygtgtttgtygttyggggttyggtttygtttyggtyggygtttatttggyggtgtygttttyggaagattayggygaaggtttygtgttttaygagattttttttgttgtattygaagttatttattatttttatggtygygttttyggggtatatagyggaygggygggyggygtagtgyggygtaggtattagtatygyggtttygygggttyggagygygttagygtgyggygggtttggggtagtygtagtttygggttygggyggatttttatgtygagagatyggagyggaaattggggaagttgtygygyggagttagggttagygaggttyggttyggtttttgtygtttatggttyggtttgtygtyggtygttggttgtttggygaagyggtttyggygttgtygggttaggggtgtygttatygttattgtgygygtttagagtygtataygygttttgaggtagtgaggggttyggtattttttatttttagttygtygggttttttyggtttttttygttyggggygttgttgygayggygayggtygtygttttagaattygtatygtygyggtttygygttttttygtttygyggyggygtttaaygttttygygygygttattygttttygygygattggttgtttttygygaygttygygygttttgaaggtygtagygttagtyggtttttttygtyggggaaaggagtgyggttagggtttggygttygtagttgggtagattttyggtygtttttgaggyggggaygaagggygygattygttgyggttatagygggttaygggttgygggtttygttttgggtttggggagtagattygagtygattaygtttygggttttaggtygttgggaggyggattttagagaagyg

SEQ ID NO: 11038 - DNA, 5370 bp, synthetic construct; identical to SEQ ID NO: 6119
  misc_feature 1..5370: note = Description of Artificial Sequence: Synthetic polynucleotide
  source 1..5370: mol_type = other DNA

SEQ ID NO: 11039 - DNA, 1691 bp, synthetic construct
  misc_feature 1..1691: note = Description of Artificial Sequence: Synthetic polynucleotide
  source 1..1691: mol_type = other DNA
gygtgggggagyggggygggtttggtagggaygttggtttttygatygtgggataggggttgggttgggaygygggtttttattaggagtygygggggaggggtagggtyggagtttttattttygtaggggaggggttggttygggaygyggttttttyggggygtaggggyggggtygggtggtaygtygggtttttttttayggtygtgagggaggggtyggyggygggggyggatttttggyggtttttttggttggggttygygygttygyggtagtttttygtggaggttattgttygtgttagtttttttygttgtttygttttttttygttgtygtygtygtygtygtygtgttygttttagygtttttatttygygtttgggagygaggagtygttagygttttygtttygtygtygtygtagygtttttaggtygttattygttatygaaattttttagygttygygtttttttygggattyggyggyggyggggygggggyggttygggggyggygygyggttgtttyggggygtygggtttttttyggtygtygtayggtygggattyggaggttgtyggttggagggaggttyggagygyggtygggygygyggygtygttataagttgygttgttygygaygaggtgagtgygtagggttyggygggtygggygyggggttygtaaatttttgyggggaggygggtttygygttgattttttagggttyggtyggyggttyggggygttygaaygttttattygtttttggaatttttgtaggtgtaggtygttaattgttttygyggygttyggattggggtgyggygygtttttaggagtttgaataatatttygaggtggtygtttttygaagtgtyggygygttttgyggggagagayggaggtyggyggggggtttttttgttttggggagggggaagtggtyggtaagtttagggaagygttyggtttttttttyggtgtttttttgtttgtygatttaggggtttgttgggtaaatttgygttatygygggtttyggggatyggggtggagggyggtggygggattttttygttgttggggagaagagttttatttatattygggaygygggtyggttttttyggattygggtggaagygtagtttygyggagtggggtaagyggygggygaggtggygygggtttygtgtttgtttagtttttgaygygtagaaattgttaaggaagtygggagttttagtttttygtttattttttyggtttgagygtayggttgggttgggggtatttttggttygtygagggtttgtagagygtygttyggggagagygtagatttgttgttgtttttgggttttgayggggygggtggggtgggtttygtagattttgggtttyggttttgttatttagggggattttttttaaygatgggatyggtgttyggagtggagtatggggagtgygttttygggagtyggygttggtyggatatgtgataattgtgggtygttggaggttygtttgygttgggatagggtttggattttaygtgygtygtttgtgtttygttagatyggggtyggggttygttttttgtaaggtttygtgtttttttagttagttgygttggaygttttataaaggtagggattgaygtttattttyg

SEQ ID NO: 11040 - DNA, 1223 bp, synthetic construct
  misc_feature 1..1223: note = Description of Artificial Sequence: Synthetic polynucleotide
  source 1..1223: mol_type = other DNA
gygttgttayggagatttyggtygtyggagatttygtygtagygaggttattgggtttttyggtygyggggygggagyggygtygatayggggtgttaggaggatttatygggyggaggagggggtttgtttattttttygtatttttttgggtttttttttygggyggtgaygtgaygtgttgayggygggttygtgtyggggagttgggtygttttttgttagtttygagttyggtttttttttttttttttygttygttttattagtyggagttyggtttagtgttttagagaaaggtyggtttgtagtattygttatygtygtyggtygttygtaygttygttyggtgagtttygggtgtygtygyggtygyggggtttagtgygygtatagyggtttggtttyggtttggtyggyggttygtaaggygttttttygygttaggtygggyggygtggygygyggygtygagtaggtttygaggaggtygtagttaggttyggggaggagttyggttgtttygagyggyggyggaggygygtttygtaagygggygggggttgggggagggtygttyggttgtgtyggaggyggtygaggggtttygggtyggtttygyggtygatttggggtatygygtyggggtgaggtttggygaggaggygaaggttgtaggygtgaggtgaaggtygtaggtyggtygggtygattttygttatgtaaatatyggtgagggggggggagggaygggggataagatggyggyggttyggygtttgttgtaggggaygatagagggggttgtygggagggggagtygttattttggaggyggtgtttggagagaaaatttygttatagttygtgagggggggtgggagagygggyggyggyggtagyggygtyggtgaygggtttyggaggttyggygyggyggygtgtgygygyggaggggygtgttygtttttygtggyggttattgtttttgtygttatgatgagygttygggttttaggygttyggyggtagygttatttttttgttttgtttttygtagtttygtgattggttgtagttttygttgygttttagttgagttgtygtaggyggttatygtygtygttyggaygtygggatygttttatttttagygtttttggttttgygttttttttygygtttgtagttattygagggtagtyggggtaggtggtatttyg

SEQ ID NO: 11041 - DNA, 1103 bp, synthetic construct
  misc_feature 1..1103: note = Description of Artificial Sequence: Synthetic polynucleotide
  source 1..1103: mol_type = other DNA
aygttaygygtygttttgttatyggtgttttttgagtgaygttaaaaygttttggatggtggtattgggattatggatggggtttatttagtttttttyggtttgttattaaggggaggggtygtyggtgggtttttyggygtygttgtaagttatygggtttygaagtyggaggtygaaayggygtgggtttygaagyggggtygttttttagggagtgygtaggttagygaggatttyggtgaggygagaygttatttttatttggttgtttttgttgtttttatttttttagttttagtygtttgtagtgattygtgattttygtaggtttttaaggatygttgygygagggagggggttygaggygttttyggttygtttttttttyggttttyggattygagtyggttttygggaaagagtttgttatygygttttygtagttatttttttygygtgttyggttttttttagtggygggggtaygtgggygygyggggtgygtggtaagtygtttttttttttaygttygttyggtygtttttygygygygygtttygtatatagttttygtgtagtgggtagagttyggtttygygygygtttygtttygtttttggttagtygygttygttttygygtttttgttttttttttttttttttttttygttttttaggygygtattttttttttygygtttttttygygttttatatttatygttyggyggagggggtttagttygtagtygtygtygttatygtygygtttyggtttyggtgtaggtagyggtygtygtygtygagatagttgygygggygagtatttttaygtagtaagttygtttttttttygtttgtgygygygtgtgtgtttttygttygtyggygttttgggtttygggggagyggttgtttttttgtttygtygtygtygtygttyggggttggtttttgyggtttyggttgtttggttttttagggttgggtattgyggtttyggyggtttygttgaggtygggggttaggggtygtttygggttgyggggtgygggaygagggattgygagtgygaggttttttttggtgygtgtttyg

SEQ ID NO: 11042 - DNA, 616 bp, synthetic construct
  misc_feature 1..616: note = Description of Artificial Sequence: Synthetic polynucleotide
  source 1..616: mol_type = other DNA
ayggtagttttygattgaattaattygatagtatttgtggaagtygttggttttgtgtyggggttagatygygtaattaggagygggggttttttaygtggyggaggtttttyggtttgggggttaygggttyggaggaatttgtttggaagttttttattayggtagagttttttggagttygtttygtgttygataaggggagttttagatttgatttttttagtagtttygyggggyggggtygagaaggggygggygggyggaggaygttggygggagaatgtgyggaatgtgttaggygtttttatttattttaggaggggtagaggaaggggtyggtygaggggaggggygaggggygaggtttygggyggtyggagaaaatttgtttgtttttttgygggyggagtttagttygygttttttygtttttttgygygtttttygttgtgtatygygtttygygtttygygtttgttttttyggttyggttyggttyggtygggtgtygtttattygagggagttygygttttgygattgttygattttttattygttttaygagtygggtatyggtgttaggtagggttgtygagtygttattggatgyg

SEQ ID NO: 11043 - DNA, 206 bp, synthetic construct
  misc_feature 1..206: note = Description of Artificial Sequence: Synthetic polynucleotide
  source 1..206: mol_type = other DNA
gyggygggyggttggggaagtagttttgtggtttttyggygggtgaggtygagatagagattaatttttaggyggygttttggygttgagttygygttgaataagattttttygtagttttgygtttygygtygggtgaaggggygtgtttttgtaggygttyggggttyggtttggagttggyggtyggtaygtygtttttggyg

SEQ ID NO: 11044 - DNA, 1141 bp, synthetic construct
  misc_feature 1..1141: note = Description of Artificial Sequence: Synthetic polynucleotide
  source 1..1141: mol_type = other DNA
tygtagtttgggagygygyggtttyggggatggggagggggtygggaggaggygtgyggttttgggggygygtattgygggagygygyggtggygaggatagggygggtyggggttygyggggygaaggygygyggtgttygggggagggygggtyggggygygygggtyggggygggggygygygggtyggggygggggygygyggggtyggtyggygygygggggyggygggygyggygttgttaatygtagataaaggtygttttagtgaattatgtggtgtygggggaggaagtgyggtttgtttttttttttttagtttyggggttgtaggttgagygygatgygyggagattttygygggggyggyggyggtygtgagtttygatgaggttygagygttttyggtygygyggtagygttttyggttygatggagatttygtygtgggatttagttygtaaygattygttgtygtttaygttgatttyggtygtgtttttttaygtgaagtttggttttatygtygtttatatygtgttttaygygttgtttttygtgtttatttaygtgtagttttggttggtgttgygttatygttataagyggtttagttattagagygtttttttttttttttgttttttttgggtttttttgyggatygtttttttttttttttattttaaagatttygtggyggttaattygtttagttttttygttttttggttgttttattgtttttttgtgtgtttgtagttttttatttttaygttgatgaatttgtattttaygtaggtgagttttagagaggtttttggaggygtttatttggyggggtggttttygyggggygttygaggtaggggygatggtagtygygggggygggttyggttttagggttgagagtgtagggagaaggygtyggttttggggtygttygaattttgttttgtttgygggtatttgttataggaaattttttgttatttttaaaaggggtaaggagaaggtaggggagggttggaggtygtygtttattygttgtttttggtttygtatygtgyggtggattyggggygttttttygtgygtagygygaagtagtagygtttgtataygttagttagtayg

SEQ ID NO: 11045 - DNA, 1819 bp, synthetic construct
  misc_feature 1..1819: note = Description of Artificial Sequence: Synthetic polynucleotide
  source 1..1819: mol_type = other DNA
gygtygttygtttttggtttttttgatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagygygggygyggygttttagttagygygtagggttygggtttygtygggggygttttttygtygttgtttttygygygattygttgtttattagttattatgtyggatttygyggttaaygygtagttggatgggattatttyggatttygaaggtgggtgttgggttggttgttgyggtygyggaygtgttggagaggattttgygggtgggtttggygygggaygggggtgygttgaggggagaygggagtgygttgaggggagaygggatttttaatttaggygttttttygttgagagygtygygygttttyggtttygtgttygygtygtttaygtgggggattttgttaggggtattygygtagattttgygygtttttataggattttgtgttygttttgygtattgtygtttgggtttttttttttttattgttgtttgtgtttgttaagygatagygattttttygagggttygygaggttgtttyggaattttttaggaygtatagttttattttgggaaatttatyggttttttttttttggtttttttyggyggttttygggtttygtttggattyggtaaygggatagggaggtygttttttattttygattgagtggatagtygygttttgttygggtggatagttttttttttttttaygttagtttyggggtygttaagttgtgtagttygtgggtygggagtatygaayggatatagtttaggtygtggtagggtttagagtgggatgttttatggtttttatttaggtttggggatatttttattygttttttagaatygggtygtgggggatagaaggggtttgygtgygggtagggagagtattttggtttttttttgttttyggggtttataaagtgtgttgggatttgyggggttgttttgtttaagtttgggtttggygttygygtttttgagtttgtgagtgygtgygtttttttgygtttttttgattgtyggtgttggggttttgygttttgygttygyg

SEQ ID NO: 11046 - DNA, 1813 bp, synthetic construct
  misc_feature 1..1813: note = Description of Artificial Sequence: Synthetic polynucleotide
  source 1..1813: mol_type = other DNA
gygtttagtttygagagtttattatagtttaygtttgggygygtagtattttttygatattgtttttgttgtgttagatagtggtagtgttgagtttaggaataygygyggagttygyggygattttygyggtygtttagttttygyggyggatttyggygygtaggagttattgggtygtaagggygtyggggagygggaggggygttgggggyggtaaggggttttagattttaggttaygaattgtttttttttttttygggtaagagtttygttttttttaattgatagaaatttattggggtaggggggygagtggggagagaggtygtttagggttygttattggttgygtttttttyggttttggtttgggaagyggttttgggtttttygggygagtagtttgggygtyggygttttttgygaggaagatygyggggtgayggtyggtattygttyggttgggtygygttgtygtttygatttatttttttttygygttygygtttttttttttttttttattaggagttygggattyggagagggygygggaggtaggtataygggttygattttattttagygtttatyggggaygygggygggyggygaygggaygyggygggggygyggggygggygyggttatggagtagtagyggyggyggyggyggyggyggyggtaatattagygatygygggyggaygagygggygggtagggtygtygggtttagyggatygaattgtatagtttagtaaaagygttttygtttttygygygtygttttttgygagtttaaatttattaatattttttaaygttttaatttattttttgaagaaaagtaaaaaaaaaaaaaaaaaaaaaaaaaaaagtaaaaaaagaaaaagtattgatyggagagayggggatatatatatatatatatatatatatatatatataaaattttttttggtttttgttaaaattagtagggttygtygygygtttgtgtgttagtgtgtgygagtgtgtgtgygtgygggygtgtgtgtgtgaatgtgattattttaggatttttygggtttyggagaygttatttttttttttgatatttttttttataaatyggtggygyggyggaggyggtagagtygggygggaagygyggggtyggtyggggygttygtygttygtygtygttttygygygttygggggtttyggygtttttygagttagggyggttagttygyggttygtygtttgatagatgtttatygttatggagttgtygtagtagtatttttgggggttygggygagygaygggagtygggatttgagygagygtyggggttagyggagtyggagtygtygggatatgggtgagtaygygyggygattttggttygggagttygggygtttagttttttttygygtygygggttttygtattttyggaatygggggygaygtgtgtgttttgtatgtaaaagtttaygtygttttgttgggtttttgattttgtattyggygggaagggggagatygggtygagggggygggatgtyggttygggygaggttgtaggagatgggygygatttyggygggtyggygggtgggyggygatgttggtttaattggagtggttygttggtggyggygatggtggaagttttgggttggagggttgggagtttattgagtttygtttaatttgatttatttttttttygtttttygttttttgtattttttttyggttttgtagtyggttggyggggttggygggtttggygttggtggagtggattyg

SEQ ID NO: 11047 - DNA, 1872 bp, synthetic construct
  misc_feature 1..1872: note = Description of Artificial Sequence: Synthetic polynucleotide
  source 1..1872: mol_type = other DNA
gygttttgttagttaagtygggtagttagggatttayggagtaaagatttaagygggtatggtttygataaagagtgaggttygttttttttttgttgtttygttagttattaaagatgagtgaggyggaaataygayggtggggagygyggggaatggaaaagttagaaggtttygtaataattyggtgttatttgaatgtttgtaaaaygtgtyggtaaaggtagttatgtttttatttygattttggtttagttgttygggataygygttaygyggyggtygttaatatttaggggatagataatagttatattgtattgatagtaygtagataatatyggygaggtgtatatttatatatttaaygataggtttygttattgygaggyggttgttaatttggagggaatagggaaagttagtygggttttagtttttttttttygaagtaygtttatttaaaygtygtagtttgygtttaggttgttttygttttattttaaagattatgttaaygtaggaattgtgggtgygygygggyggttyggyggggagtttttttttttgggtttygtyggttttattttgggagygggagggggaggagggagggttggaggaggggaggggaattttaaattaaaataatttttagttatgaggaygttyggtggtatyggatatttatattagtaatagttatattatattygttttygttagatggyggygggtttaatttttygggatttygtaaatttaggttgtgygttygagygygygtyggagtgtgggtaygygggygggttggggattgygggagyggygyggygyggygygagttyggggygagaaygggggygtggggttggggggygtygggtttatyggtttyggaygaggaggttttygttttyggggagyggtatygggtagtttyggtttagggtgayggtttygyggaagttggggtttagtygggttattattagtttttgtatggtttggggaatggyggagttttggaagtttaggaagtggygggygtaygatatgtttaygatggttygggtttyggtgggtattagtygtagtatggtttgygttttygttygttttttgygtygaygttggtyggggtyggttttygttygggtygttyggttyggttgtgttttgttyggttagggygggygggttygtttttttttyggtyggygttttttttttggtttttttttttttygygtygttygttttygtttttttygttttttyggygtyggygtagttttygtgaattygggygtattatttygggtgtttyggtttggggatygttgtygtttyggtygttgtttttttaatttttttgttttggtttgaatttgttyggygtagattggttaaggatttttttygtttttttttttttttttggygygggagaggtatyggatatttttatttttttygagttttaaaagtyggatttgatttttttygggtaagggtggygggggggayggygggtaaggggggaygggggattygygygtttygyggtygtttgyggtttygagtyggyggtagtttygggygttttyggagttgygyggyggtyggygtaggygtttttttttttygtgygaagygtttatttttttgtaaggtggtaygaattaatttygagygyggttygggyggyggggtaygatyggggatttygggtagggyggggagtttttgtygtygttgtygtaygygtattygtatygatygyggggyggggaaatgtttagtgtttttygttttttaggttggtggttttttgttttyggaattttttgygygtgttttttgtttayg

SEQ ID NO: 11048 - DNA, 652 bp, synthetic construct
  misc_feature 1..652: note = Description of Artificial Sequence: Synthetic polynucleotide
  source 1..652: mol_type = other DNA
tygtagatygtgtatttttgtagggggtttyggatgygatggagttgygygagttgaygttttgggttgggyggtttttaggttygygtygtygggyggggtttyggyggyggygygygygtgygyggttgggggygyggttttgygggttgygygagttggaggtgygygtgagygagttgggtttgggttaygygttygaygagayggtgttgtttygttattgygtaggygtttgygaggttgtygygygygtttaygatttygggttgygaygattgygttagyggyggygtttgyggygggagygggtgygygygtagttttgttgtygttygayggtttaygaggaygaggtgttttttttggaygygtatagtygttattatayggtgtaygagttgtyggygygygagtgygtttgygtgtgattttattttattyggtyggygyggyggttatttttttygtttygayggtattattggtyggtttygygaaagattgygygtgygtagagtaygtyggygyggtttygggattttygygataattgtattgagataaagtgtggtaattygagttggttggtgatttattttyggygaggggttygygtgtgggttaygtygtygtttttatygggaaagyg

SEQ ID NO: 11049 - DNA, 722 bp, synthetic construct
  misc_feature 1..722: note = Description of Artificial Sequence: Synthetic polynucleotide
  source 1..722: mol_type = other DNA
gygtttatttayggygygtgtagggttttaggtttagggagygagyggggygttatgggggtyggagtttgggtttaggtygttttttttttaattttttttgggtttttttatttygyggtttttttyggagygtggtttatygggygtgaagagygygatggttttgaggtagttatattyggtygagtygatttgtaggyggtttagtttgtttatttgtttttggaaggygygtatttggtttatgaaagttayggygygttyggyggttataggygyggygtggaggtyggyggyggttagtagyggygtygtgtgtaggggtagygtygtttgygtygygtttagtaygaagagttygttttagtttaggygtagtagygttatttggtyggttatyggtagttyggggaagaagggygygtggygygtttattttayggtgttgaagagtagtygygtygttagttygtataygttgtygatgtttagtatygygttygtygygtygttttttgygtygaagygttyggtygtygtagggtagggtttagygygtagtagttgygygattagttyggatatyggttgtttygggaagaggttttygtygttygttattgtygttagygtygagttyggggggttgttygaggaggyggttayggtattaggtagygagtgygggatgyggtygygttgtatygttgygggaggyg

SEQ ID NO: 11050 - DNA, 858 bp, synthetic construct
  misc_feature 1..858: note = Description of Artificial Sequence: Synthetic polynucleotide
  source 1..858: mol_type = other DNA
aygattaygttatygtagattagggttataygatagatttygtttttatttatygttttgagttygattaaatagtatttayggtatatattagggttttygttttttatatatatatattataatgaygtygtaaataatagtattaattattatygttygtagttttygygtatagaggttttaggttttyggttttaygtggatygatttygttyggtagygyggggttattttatygygagtttttttygtagttyggttygggttatttygattygttaggtttaatttaataattataatatyggaaaaggaagtaaaggtygaagtttattygyggttttgaggtttgtgggaaaygtagtttaataaygaaagagttttgaagtttaagyggagttygttggtygtaggggtygtattaygttttagattttggagttttygggtgygtagatttttgttattagtagaggttgtygttgygygttttttaggygyggaagaggyggttggtggtttttgayggtaaggtgaagtygaggtagtaatygggaatttaggttgggaggatagaatggggaataggaagttggggygagggtggttttgggggaggtggggggtygyggaattttaggtggtttttgttttatttttggaaagaatyggaagttygggtyggggagggtgaagggagtygyggattyggttgtttagtygaggaggaaattyggattttaggttgagggaggtygaagaaggaattggagggtygggttgggaaggtttgaagygggtatagtttttaggttggggagggtygaggggagaattyggagtttgagtygggyg

SEQ ID NO: 11051 - DNA, 598 bp, synthetic construct
  misc_feature 1..598: note = Description of Artificial Sequence: Synthetic polynucleotide
  source 1..598: mol_type = other DNA
tygaggtttyggygggttttygtatyggttttagtttttttttygtatttgtttggtyggygggttttatttttttttttgttaggggtagattttgggattatttagttygttttygtaggttttgagygtttgaygtttgygtattgagygygggygggygggtatttttagaaattttyggggygttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgttaaggtaggagtgttygggatgtyggagyggataygygyggagaaagygtygttggggttattygtgtggtygtgttttyg

SEQ ID NO: 11052 - DNA, 1281 bp, synthetic construct
  misc_feature 1..1281: note = Description of Artificial Sequence: Synthetic polynucleotide
  source 1..1281: mol_type = other DNA
tygaaagtttaaagtttygggtttatyggttagttttttatttygttgttgggtyggataggtgtaggggaggyggattygtttygtagtygatttatttagttttagggtttggtygtatttgagtagygyggttttyggttgttgttggygttgtaggtttygygtttggtttgttagtttgygtagtyggtattyggtygggaagtatttttttagtaggtygtttagtattaygtttaygygtygtatttgyggtygygygggttttggttttaygtagygtttgtagattgtgagttygtagggtagygttatyggtttatgtagtagtygtyggtagygygggtagtygagtaggtygyggggygygyggggtttyggggtyggttttttttygtygggygtttygggttygtygttygggtttttygyggatagyggtyggtygygtaggtttayggygygtattaggtygttygttagtttttttagttttttyggtygtagygtttygagtygygyggygtygyggaaygygtttagggtttyggggaggyggtyggygygggttagygygttttttagttttaggtataggtygyggttyggttgygttagttyggttagtatggagygaaagagttyggttgttatttygtagtygttygygyggaaggtttygtygtttttttttaagygttgggygatyggtttygygyggtygtagttaggatattggggyggyggyggyggygggatyggttyggggtttattatygyggggttgygaygaygygggttyggagygaaggygyggagtagggaggatgygttgttgttgggaattggtyggygggagygyggttttagttttygttagtagttaygygygtttgggggyggygygttgygagyggttgagatygygggygggggygggygtttggtttgggtagygtttttagygyggtgtgggyggygagtttygtagggttgtaatygtttyggggtgggggtygggataggtatygygggygtaatttgagtttttgtttaygygtagyggttttttagtttygtyggtttaggtaatttaggtygttgyggtaaygtagtgatygygttttaggttygygttttttgygatgttttttttattygtttgagggtttttgygygattgygygygygttttttgtttgtygttttttygtagaggtgtyggggttttgggagtaggtggttttggtygygggttgttggygygtyggtatygyg

SEQ ID NO: 11053 - DNA, 1788 bp, synthetic construct
  misc_feature 1..1788: note = Description of Artificial Sequence: Synthetic polynucleotide
  source 1..1788: mol_type = other DNA
tyggttaggttygtyggtygttttagtttagtattagggygttygygyggttgttaaatattttygggagttttgttygtaaagggattaygaggtagttgttggygygttttgygygtattygtttagaggtttttyggtttgtttttygygggtttgtttygaaattgaygtgaaatygatttggtgtaatgygaatgagttttygttygttttygtttttattttagtygtygtygtygttygtygttataataatyggtttttattttttttattttaygttttgtttttygggtttttygggttataggttatagygygggaaggygtttygttttyggygtttygtattyggtygtygygtattttygttygttyggygttttygagttaygtagaggygttttttttygtyggagaygggaaagtttyggygtttttagattgggtttygtttttagttttyggaggggttggggttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaagattttygagtttaaagagattttyggaaygtaagtggggatyggggaggygagggtggaggtggtygyggtaggggttgtaygggtagttttagttgtygtygtygttattatygyggtagaaatttagtttgttatygygtttttattgtttygttttyggygttgyggagttttttygagygygttygaygygtgggtttgygattttygggtgggygtygttttygggagggggagggggtagygtygggttgttagggagtagtttaygygggygygygattttttattttttttgttatygtygtttttttygttgttttttttttaygygtgattgtgggttgagtatggtggggatggttgtttatyggttgtgtgygtttattygtygtgtgtatgggygtatygygttggygagaygtggttaygagaagattagtttttagtygtttttatttttgtttttatattatgtatttttatggaattggtatttgtaygtaygaggtgtaggtaagattttgggtggttaygygaggatggaagggaagggtttygtagtgtttagggttataygtgggtagagttttatyggagggtttgtgtattttaygygggttyggtygtaygygtyggggagygygtttttaagggagggtttgtgygygtygttgygygggyggtgtttttttygggttgtatyg

SEQ ID NO: 11054 - DNA, 626 bp, synthetic construct
  misc_feature 1..626: note = Description of Artificial Sequence: Synthetic polynucleotide
  source 1..626: mol_type = other DNA
tygttyggtttttygygtagtygtgggatttygaggagggygtttattaggtygygtgtgattatgtaaggtaaatagggggtttatgaagttattgaggattaatggggagttyggagtagagtttggggyggggtttggttttggyggygggygyggattggtaygttgyggatttttttgttgttttataaggyggtgygaggygagttatttttagagggttatataagggggttgaggyggtygttyggyggtygggtagygygagygtaagggatagggagggtygtggygatattygygttagttttygggayggttgggttygggttggtygtygattttygattttttattagatgtttggtagagttyggygygttyggagttygygttttttagagggaaggggtygygygtygtygyggyggttttgaggttgayggtygggaggtgaaaggtyggagtgyggggttaggaygttttttggagggggygyggygtagggggtygyggggaagtygtygagggygyggagygggaaggaaggatagtggttatttygttttygtttgggtayggggtagggattygygygaggyggtgtyggggaggtttttayg

SEQ ID NO: 11055 - DNA, 1037 bp, synthetic construct
  misc_feature 1..1037: note = Description of Artificial Sequence: Synthetic polynucleotide
  source 1..1037: mol_type = other DNA
aygaagttttygygaattgaattgagagtagataaaagtaygygtttttttttatygttaygtyggttttatttaaattygygagttattygtatttttttttaggagttatagttaggttagaagagtgyggagggayggggttygggaagagtagggaatttttagagttygtagttaaygyggaggtgggygagygggygtgygygtatttatttgtyggygygagggagtgtygggggggaagggagtggtttttaaaagggggaggggagaaggtagggggyggggagaagtyggttttttaggattyggttgyggyggygagggaggaggaagaagyggaggaggyggttttygygttygtagggtygtgttatttgttygttygttygttygttygttygttygttgygtygygttgtygatygttagtatgttgtygagagtgggttgtttygygttgtygttgtygtygtygtygttgttgtygttgttgttgttgttattgggygygagtggyggyggyggyggggygygygyggaggtgttgtttygttgttygttttgtatattygagygtttggtygtttgygggttttygtyggttgygtygttygtygyggtggtygtagtggtyggaggygttygtatgttatgygyggagttygttygggagtygggttgyggttgttgttyggtgtgygttyggttggagggygaggygtgyggygtttatatttygygttgyggttaggggttgygttgttatttttattygggtttygagttgtttttgtaggygttggttatgggygagggtatttgtgagaagygtygggaygtygagtatggygttagttyggagtaggttgtaggtaaygyggtttggaataagtagttgggagaaatttggagggtagyggagaagttygaygggyggttggattttayggayggttttaggggyggtagagtygagattttggattaaattaagggggattgttgttagygggaygyggaagttaggttyg

SEQ ID NO: 11056 - DNA, 977 bp, synthetic construct
  misc_feature 1..977: note = Description of Artificial Sequence: Synthetic polynucleotide
  source 1..977: mol_type = other DNA
tyggatttgayggagtaatgtaygtgggtttttgattygtaatatatttagttaaagtyggtttttattgttaagygygttagtagtttatatttattgyggtygyggtttgatgtggtgatgtttatygygyggtttttataatgtagggatttttttgagtggtggtygttttygttttagttttyggttattygtagttttatatygggttattggtttattatygagatagttagygagtttaggyggtttttgtagygttgggagaggaatgtgygygaaattaattagagygaaattagtyggaggagtyggtygaggtgtaggtgtaggygtagtttygtttagaattttttygttatatttaagggagttggaagttygggagggtgttgttttttttttttaggaatagagggttttgaagtgttttttttttagtatatagtygttttyggggatttggatygtayggyggtattataaatttggaggaggtatggaggtaagygttttggyggygtttttattggtaggtggaggtttttttttttttgtgttgtttttagtttygggtatttatttttttatagataggattatattttttagygttyggtttttttgtgtttttaaggtaggagggttagttagyggtygggagggaggagtggtagtagagtygattgtttgyggtyggtttgygaggygtgtaaggttygaggtgtttagtaggtgttatygtagttttagggttgaggtttggggaygataggttttggaggygyggtaggtgtagagygtttyggtagttttagggggtgtgttggaggggaatygtyggtttgtttggatttttygagtattatygaggattttygtygggatttttttataattttaaatyggtttataatttygttagagatgatagggttagggaattagaaatyggyggattagygttagggtyg

SEQ ID NO: 11057 - DNA, 6206 bp, synthetic construct
  misc_feature 1..6206: note = Description of Artificial Sequence: Synthetic polynucleotide
  source 1..6206: mol_type = other DNA
tygtttttttgyggtaggygaggyggggtgtaggtgtgagtggggtgggaggaaggggaaaggatyggggtygtygtagtttttttggttagtttygttgggttttgttagtttygtttgagatygaggygtayggattagyggtygttagtattttataggtggaggatattttttgygttttaaggttaatgttatttygatgggtttygtgtygttttgattttttttgatttaattttttggttatgatttttttattttttgggtttygtttttgttagttttygtygaygtygtttttttygtygttygttygggtttttttattygtttttttttttttttggttygayggttttattgaggtaaaaataaatagttttgagggtattttaaggagygtgtagtggtttygayggtattttyggggggataaaagaggtggttagttaygtygtyggttttyggtygaataatgggygygtagtagattgttagggggtatttgaaattygaggggagggaaatatttgagygyggttttttttygygaggaygtaygaygtagtttygyggatygttttttgttygtttttttttatgtattttttttttgtgtggaattatttaaaygggagatttttggtagttttatgttaatgygtygaataaaggtaayggttygygggygggaggttyggaaggtgtttggggtygggtygggyggggtggyggttaggygggttgygygtgtttttygygtgtttttgggattgatataataattttttatttttgtaaatataaagttttttatyggttygggtygggygtattyggygtagggaggygttggttttttygggyggygggtattgtagyggtaaygtayggtttttgtyggttgtggttygggggattgagggtygggagtgggggtttttgtgaagttagaagagaagtttgtagtagagtggtgatgaggggygttgatattttatttttaaygtygaygtttttaaaygygatattttttgyggggtgagaatgygggttygttyggtttttttygtgaggttagggttttttgtttttttagatattttaaggagttaattttttygtagaagtttttygtttttgtttttatttttaagtttygygttttttataaattttttgttgttttgattttgatttttagtygtggtgagggttagagtgaatttyggygygtttttygayggtattttygtatattaggataggagaaattggagggtttggggtttygggtttygtagtygtyggaggaagaatttatygyggggttygtaagggaaagtgaagaggttygggatttttttaaagygttggttaggatttygaaggaaggggaggagttatttgaagtyggggaaggttttttgggtgttttgttttggatttttatgtttattgattttygygaagtttttttggaggggggtaaattygygttgttttttttaatttaattttaygyggtttatttttygaatygygtgygttaaggtyggygtygggggygtattgtgatggygttttgttttttttaggygaagataaatatttygattygatgtttttatgtatgygggtgtataggttttgagaaaattaygtagaaggyggttgygatttayggttygggttgggttatatttgtttggaggtygttggtgtgtgygtgygygygtgygtagtttaattttttttagtttygggtggtgaaattagtttttaatattagtattttttaagtttttatttattttgattgtattygtttgaaagtagattttatttaygttagtaagattggaagttataaataaagaaaaagaaayggatttattgaattttagtattttagtagygtttaatagatttttttggttaaatttagagttttgtttgaatttatttaygtaggagttgttttgttttttttgttggtagaggtgtyggttttttatttttayggtttatttataattatgggtgttgttatttttaaaggatttataaggtgattaattttttgttatttgttgaatggaaggagtgttatatatgtaagatygaatggggtaggtygagttttygttttatgttattttataatttagatgggattygtgattagaaaataaaattggttaaagttgtttyggaattttttttttatttttaattttattagtattattaattagagtttaaaagagtaaggaaataatattagttatttttagatagaaatatgtttataaattttagataaatttattttaagatttttaatttttggggagattagtatttattatagtatttttaaaattagggtgagattttttaaaatatattttattatatgtatttttttttttttagtgtgtgagttaaaatattataaatataaaattattaaatattttttttttgattaattaatttgattaattttttaattaattaagtttaataattgtttttattataatttatgatttatgtggattttatttttatatgtttaatttttaygttagggtatttttagagggaaaatttaaaataattaaatatttttagtggaattaagygtaagtaaaatttagtaaaatttgtttggtatataaagttttgtagaaaaatgttttttttttttttaataaagtgatattttttttatagtatatgatattttatgtggtttggttatttgttttttagtgttggaygattagggttattaygtattygtggggttttttgttttgtttttygaagattttgttttttgtgttttttyggggttgggttggatagaggatggaggtaggyggtttagtttgggtttaaayggaayggtagtggaggtgggggtgggggtgggggyggggggaattttygttgttgtttttttttggtggtataggggaggyggtttgttttttyggaggttttagtttgttttagagtatagattgtttttttttttttygtttagtaygygttttttttgygtttagattggtygygatyggagtttaatagtaggaggttaattttttttataaaggtgaagggggtayggtttygtgggggttgygtttagataggtagtttttttatttygtagygttttgattggagtttttgatttagtatttgatgttaatyggtaaataaaatgttygttyggaatgaaaatgtatgaggtygygyggggaggagaaagttaattttattggggygtaygaggtygatygygygtttygggtttyggttaattygattyggattaatygagttttggattaygyggaagtttygggyggtttgggtygggtttygttaaagatgttatttttaagtttttaagaatttaaaagtttagaaatttaygtttttttgggaatttagtttagttygttygygttttaatttygygttttygggagattgagaaggtygtgttaatttttttttaaattygaaagaaattttttttagtttygtgggygygyggaggttgygagtataaatatygttttyggttattgttagaaggtygggttttttgtttatatttggaatttyggggaatttttttgtttggttttttgggtttagyggtttattygtttaaggttygggyggaggtygttyggattttgttgttttttyggatttttgtttattttttaaatattaygyggagttattgygttttygtaaygatttttttygtatygtttyggygygttttygtttttatttaattagygygtataatttttttttyggtttyggttygyggattgaatttttttgatatatttggggttattttttttttttgttgttattttgttagygattygygggtaattttygygygggaggggggygtgtattgtygygttgatggaygggtttatttggyggtttygygtttttyggaggagagatataaagtttaggtaygtgygtttttttatagagaagtagtagatygtgaagggaggyggggtygggygtgtgtttggatygggyggggyggyggygtygggyggggygattaggggygygygygggggtttygygtttttaggtatatttgtygtatttatygggygattttygagtttyggtttttttttggtygttttatygtttttttattttgttaggttgaggagttgyggaygygttgattggttttaggggaagygggaggygagaataatggtttttttttttygttaaaagggagyggttgtygggttyggggatagggaygygygtgtagggygtagagttgggtygagtygtygtyggygttaygygagtttygtagtygtygygttygggtaatgggtygggggtattgagggtygtyggggtygagygyggaggggggatygagttagtgtygtgttttygggtygygttaatatgtttygyggttttttggtgaagygtagtaagaagtttaygttygttttttatygggttygyggyggygaggayggygatygygtattgttgttttygtttagttgygggggygttygygtygagttttyggygtygagttyggttttygggtygttgtygtygtygtygttygyggagygygtttatgtagygttygtygtygygtttgtttgygygtttgggtygtagttattttygtagggttygygggtygygtatttyggtaatttygaggttgygtatttygygtygttttatagttttaygyggttygtgagtygygagtaygagaagtataagtatttygaaygtagttttaatttgggttygtyggtttyggtygagtttttttttaygttygtygygttgttyggagggggyggyggyggyggygygagyggagttggyggaggyggtatttgyggyggygattygttgtttttygygttygtygagtttaagatgggtayggygttttyggttggygtygaggyggttygyggttygggtttyggttttttattgttttttgtygtygttttgyggttttygggaaagyggttttygttttttatygtygyggagtygttygttaaggtagttaaggtttygggygttaagaagtttaaggttattygtaagttgtatttygaggaygaggtgattaygtygttygtgttggggtttaagattaaggagggttyggtggaggygtygyggggtygygyggggggygyggygyggtygttgggygagtttatttgttagttgtgtaaggaggagtaygtygattygttygygttggygtagtataaatgttygygtatygtgygtgtggagtatygttgtttygagtgygttaaggtttttagttgttyggttaatttggtttygtatygtygttggtataaatygyggttygygttygtygtygttygygygtyggagttagaagtagtagttagggttgaggygygggaggtattyggyggyggtagygatygggataygtygagtttyggyggygtgttygagtygggtttygaggaygggttttaygagtgttattattgygttaagaagtttygtygttaggtttatttaygtaagtatttgttggygtattattaggygttgtaggttaagggygygtygttagygttttyggtygaggatttattggttttgtatttygggttygaygagaaggygttttaggaggyggtyggygayggygagggggtyggygtgttgggtttgagtgygttygtygagtgttatttgtgtttagtgtgyggagagtygttygttagtaagggygtttaggagygttatttgygtttgttgtaygtygtttaggtgtttttttgtaagtattgttyggttattttttatagttygttyggttttaygyggtatattaataagtgttatttattygaaaatagataggtgatttttttgtaggtgttygtgygttyggtttgttagagygygttttttatttyggttttygaattgtgttttygtttggagatttataaagagagtgygttttgtatttttygaattygagttygygttgggggagtttygttttygtttttatygggtgaaagtgtygttttygtttttttyggtgtggygtgayg

SEQ ID NO: 11058 - DNA, 574 bp, synthetic construct
  misc_feature 1..574: note = Description of Artificial Sequence: Synthetic polynucleotide
  source 1..574: mol_type = other DNA
gygtttttttttttgttygygttttyggttttttygttggtttttgttygagtttttagtttttttgtattataggtttttggggtttygtttyggattyggttattttttaggttyggagtagtygtygtggaggtygttttttygygtttaggggaagggaaggyggtttyggggttygttgyggggtggagggattygygttttttagtttttygggttygggtygyggggatygtgygygygtttttttttygggtaaggtygggyggygggygygtygyggtttttggggttttygtttttttgttygttatygtttgygggagtttttggtttggaggggttyggggygygttggygattgygggttyggygataggggyggttggtggygggaggatagtgggaggaaggtttygttttaygygtttttttttyggatgtgattygtyggggtttttygtagtyggggygagyggtttggaagttyggaggaggggtayggaattgttygatggggatgygatygygggygttagaygaattgtttttatattygttggygttggyg

SEQ ID NO: 11059 - DNA, 3438 bp, synthetic construct
  misc_feature 1..3438: note = Description of Artificial Sequence: Synthetic polynucleotide
  source 1..3438: mol_type = other DNA
tygttggtggagttygtttttttgaagtyggagttggygagtttttygtatttgattttgtaggygtttttttygygggttagtygggatattttttgtttaagttgttttatttgttgaatgagttgygtttttttattttttaggtggtgtttttgttggaygygtttatatttgtaagattgggygtagtttyggttttttagggttygtygtttttgttttaggyggattatttygtttttggtgaagtttygtaggtggyggtttagttygygtayggatatggataygagttggtygtyggagaagyggttttttaygttgtygttgtygttygtygtygtygtygaggtygtygygtgyggttygggttyggggtggttagtgggtagttgttgygtygggttagyggygttggayggyggyggygaygtttggtgatgatggtgatggtgygggtgagygtgygggtttagttygtygtgggttaygtyggygttygggtaygtgtggtgygggtgagggtggtggtgatggtggtggtggtgagygtygygaaagttgtygaagttttgtagyggttgtggtattgggtgygagtygatgagygtttttatygygttttygggygttaggttgagygtttyggggtttatttgttggtagttgttygttatttagtatagattttygaggtgtgttttttgttyggtygggttgaagttgggygaygagggtayggagttatayggagtgttgagyggtgtggaggatatygagtyggttggttgtaggygtgtgtagggtttgttyggaygtttygygygttttagtggttttttttttaygtygaatttgagtaggtygaagtygttgatatattttatggttagygggttggtgggtagttttggttttatgtttagtttygyggttatygttgaagygaggygtagtygtygttgtygttygggaaattttgyggtyggtyggagygygtygagttaagygygggggggaagagyggagaagagttggggaggyggggagygagggygtagygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtygygatygttyggtttayggtyggaaggtttggayggygtttygtatttagttaggttttttttatttggtttaatttaagttagtttagaaygtatattatgtgtgtattagagtttaggataggtttttttygagygatgtataggttttygggtttygttttygtatttagtygygagtttygagtygygagtttygttttggtygtttygttgaaatttygtgttttagygttygggggtgttygtyggttgttttttgggtyggaaggttttgggyggaggaaggtyggtagttaaaagtggaagygttatagtgaagyggtttagggttatygggtgagaaattttttyggagggtagayggggagatygaagtatatygtattaggtatttagattgggtttgggagtygygtattttttttatttagatttaggatggttagaattaaygggttttttttgagatttyggtttaggygtygaaatyggatagatygygaattygttggattyggagattygattygtttttygygttatttttttttttttagttttgggygygygtagygaaaggtaggagaggygygtattgggtgagtgagtttyggtygttgtttgygttggattagttygattgatttygygygtaggggtygygtgagttatatyggtgtagaygygtttagattatttttaaatgttagaaggtaaaatatttgtttttaattaatttgaaaattttttatttttttgygttttyggagaggttggggtayggygtggtattgggtygtttatttttaataaaatgagtgtattttaattaaaatttaatttaattttgtggggtggtaaattaaatgttggaagagygygtttataatttttttygagaagygtgtttttygtagaaatgagtyggtygtttggagagagagtttgggyggtgtygttgygtagtttttgttagtagttgggggttggggattygtattttgtaaatgttttygttttgtttgaaygtagtgagagtatattygtttttagattattygggatygggtgtttyggatttgtgtagattatgtatggtttyggttttaggyggttagggygggataagtayg

SEQ ID NO: 11060 - DNA, 4088 bp, synthetic construct
  misc_feature 1..4088: note = Description of Artificial Sequence: Synthetic polynucleotide
  source 1..4088: mol_type = other DNA
aygtttygagtatygattttatagttayggttatygtttttyggttttygtgatatyggygygtttgttgtttygagtaggggaggttttgtatttttatygtatttttttygttygaagataygaaatttygttygggygtygtaaataattygaattyggttttttgatatttatttyggygggygygygtygttgggagggyggggtgggtggttggaggtaaggaggygtatagtaggggtaagygtygtygtygtatattttgtaygtygtttagggttatattatttatygaaaattgggaggtaggtttgggaggyggggttgagygtttatygttttgggygygttygygtttttygttatygyggttttygygttttyggtttaygttygygyggtttyggtatyggtttgtatttttagggtgygyggyggtttatttgggtgygttttyggtgggtygatttttygygtttttttttyggtttataggggtygttgttatgggtyggttttttgaagaggttggggygttatyggggtyggttagaagttttgtttttyggyggggatatttagtygygtyggtatygyggagygggttgygttaggtggttggtyggygyggygtttttttgttttttggtttygggttgyggygyggyggttggagygagtttttgtttyggygyggggyggyggygggyggtyggtaggygttgttttgygtgtgagtgtattttatttatatgtaagtyggggagygtyggggtttttygyggaagtgygagtygttyggygtaggtaagagtygtygggttygggataaggtaggggygttygggygtygttgttttgtttyggggygttttygggtattttttaattttttttttttttttttttttattggygtgtttaagagttaaattaaggagygtttgagggtaaatagatttttgttattygygtttttgtatttttttttttgagttgatattttttggtgttttttggtttttygttgttgttgggtgttttttggtttgtttttgtttttttttygtttgtttattttttttggygttaatttttaggtagttagtttagtagttygaagttygggtagtygygtttygyggtttyggggtagygyggygggaatygtagttaagtttttygatayggggygtaygggggtygggtagttygaggtygggggtaagtagggagttygggttaggygygagtygagtttttygaggtggtygggttattatgttgaagatggttatgaagtttaaagttygggyggyggagagygagaagaagayggtygyggyggttgtygaggtggttgtygaagttgyggyggyggttgyggygttggtygagtygagagagtygttygygtygyggaagagyggggatttygagaagttygygaagaattttaagaattyggygygggaggygtttttygaaaagtttttaatagataaggagygtaagaagttygagaagaagttgttggagtagaggygaaaggaggagaagaagaaggagaaggagaggaagaagatggagaagatgttgaagaagaagaagaagaaggtgttagaagtttaggaggaggttygatgtttygaggtygtygtygtygyggtygtygtygaygaygatgagggygtygaggagggygtygtygggggygtygaggagggygtygtygtygggggtaygagtagggtttgggttgattgggatayggattygagygaygaggaygaygtttattaygyggygtygygygttgggggtatygtgtggyggttygggtygtttaaggttggygygttgagygtttatttgtttttygtggtgtttttggttttttyggtgygtagtttttygtgggtgtttaattttttgttgtagaagygtayggagtagggtygyggttgyggtttygtgttyggggygatttgttgttttygagtgtttttgggttgygttttttttttttatttgggyggtygygttaagygtagaggtygygggygtttyggggttagaggygttttyggttygggttatggygttyggygtygggggygygaggagyggtttatttagttagattttttatttygttatygttattagatattattatygttgtgtagtgtgggtttttattygtgttygtgtgtgtgtgtggatatattttttttttyggttgttttgttttttggttygtgttygtttygttttttttatatttttgttttttggttttttgtgtttttygttttttygaaaatttttttaagttygggygygygtttttttttttttygtttattttagtttttyggyggygttygygggagggggaggaggtttygggggygtygggygaygyggttyggggggtggagygttggygtygtgygaggggtygttattggygyggagaygtttttttttttttttyggtttagtygggttgttgttygagttyggggggtggggggygttttttyggttygtttygttttyggtygggygygggyggagggatttttttttygggttttyggggggtygttttttttygtyggttttygtttttttagtygtygtygtygtygyggtygtttttyggtttttttttttttttttttttttttatttttttygtygtygtygttttttttttttttygttttttttygttygtygyggygtttttggttyggggyggyggygggggttyggtygaggtaataagagyggyggyggyggtagyggyggtagtagttttygtagtttttgttttggttygtttyggttyggyggyggttattagttttttyggtttyggttygaggggyggggagttgygygygtttttyggttygatygatattttttttttttygttygttygygygtttygyggttygyggttygtagttygtttygygygttttttgtygaggagtygagttygygttyggttygttygttyggygttgtttyggttttttyggtttgygtgaggtygttygygttygtygtygtygtagttyggtygygtttygtygtygtygtygtygttatgggttgtttygggaatagtaagatygaggattagygtaaygaggagaaggygtagygtgaggttaataaaaagatygagaagtagttgtagaaggataagtaggtttatygggttaygtatygtttgttgttgttgggtaagggygggyggggggygtyggtttyggttygggggttttygaagggygtttygtaggtygygygygtygagttygtttttygtttygggygygygttttygagtttttygttygttygygggttttgtttgtggggggygaggtyggaagggggatttaggggygyggattyggtygggygggggtttaaaaayggggyggggggtygtggygaygygggygygggtttttttttttyggtttgttygtttagtgttttttttttgttttygttttygtttttttttttttttttttttttttttttttttygygaggtttataygaygttaggggtttgggtgygtgttggggagggggagggggagtttatggggtttyggagattgygataaaaagagggtttyggggataggaaatygggtggygggtagagggagggggattygttttygtggggtgtgagatttgttgggagagggaaagaggggaagaaaggggygaggagaggagggggtgaygttggggggygtygtggtggyggagggggtttygttaaagggaggttttggyggggagaagtggtygaggagagtgggggggttggtgatattagtttttyggaaaggatyggagyggtaaaggtggtgtagtgggggggagggggygtaagggagtygtggygtyggagtygggaggggggyggygaggggaggagggagggyggttgtygttgggygygatttggtgygtttygggtaggatygattgattgtgtgtgygyggagtagaygtgtttygggttaggtygggtyg

SEQ ID NO: 11061 - DNA, 522 bp, synthetic construct
  misc_feature 1..522: note = Description of Artificial Sequence: Synthetic polynucleotide
  source 1..522: mol_type = other DNA
tyggttttatttygtttaaagtyggatttygtttagtttygtgaaagygaaggagtattagygttttttgatttygtatagttttttyggtagagayggttygttttttttaagaatyggaagtyggatagygttaggaygttttattttttttatttgggatttagagaggtagyggttaaggatagggttttygtygaggttatygggtagygtttaggtttyggtttttgggaggggagtagygggggaggggtayggggaggggygagggyggggygygtttgggtttyggygttgggttttttttttgttygtttygggggatatttataggatttttgtagatttttgtygaggtaggatggaggtttgtagggatgtatygygggttygygattygggyggtyggaatatagttttttttggtyggagatyggttyggtygtgagtygtgtttgtgttaggttttttaygttgtgttttagggttttagtgttyggygygtygggggttgtatyg

SEQ ID NO: 11062 - DNA, 2260 bp, synthetic construct
  misc_feature 1..2260: note = Description of Artificial Sequence: Synthetic polynucleotide
  source 1..2260: mol_type = other DNA
aygttttyggaaagttttttttaatgggaagygatttygtygttgagttaagygttygaattttttttttygyggtagggatatyggttygggttaggtttgyggaggaygttttygggygygtatatatagttygaggaygygttttgtattttaagaygtagggtyggattttatttygaaatttggtttttatagttttaggtygaattgtgtttggtttttagttttygagttygagttttaygtygtaaagagatggggttttattgtgtttagttggttttttagtayggaygtgtatttttttttggtttgttttttgttaaaaatyggtagtgygtttygtttttttgtttagtygtagtttgtygttttttagataaaaagyggygatygyggttyggttattygagtttygtygygttgygtttttgttgggyggtttatagatggtgtttagtayggggtygygtygagggygggggygggaggtygygaagagggtygggygggaggggaggagayggyggagtagttaattygygygyggtttattagttgatygtttttgtttatattaggtgtaygtyggttgyggggagtataaagyggggygtatygygggygtyggtaaygagtyggtgaaygaggygaggttygtgygttygyggttgtaagygttygtttggyggggagaggggtygayggygttagttygggyggyggtatttttaggygtttggggygttttttttyggatttggtygttygttgtttygttttttgtattttattttttygatttttttttttagttttgtttttttttgttttggtttttgagagtygattgagtttagtttygtgtagtagyggttgtttgtgtygtygtttagttttyggttttggtgttttttygggggtgttttaaggagttagtgygygttgygggttgggaaggaggygtygtttagttagttttttttttttttttygttttttttttttttttgttgttgttgtygtygtygtygtygtgggtgtygggttygygygtattttaatatttttattagttgggtttyggggtaagtttttggtyggtygygtygyggtaggaggtgtgggaggtagygaggggaagtygaggtaaatttggtggygtgggagattttayggggtttggggaattttagggtaagatygygggtttgagggggaygagggggygyggtttayggagttggggaaaatgaygaagtygggaaaygagaatatagtgtttygttttttttygttttttttgttaaaaaaaaaaaaaaaaaggtgtgggagagygatagttgggaaggtaggttagatagaaataggtaaaaaaaggtagtgatyggagtygagtttgttggattttaggggtygattaggggagggaggtgttyggggayggggagggaggagggttgtygggatgtgaatyggggaaggtagttggggttggagagtagygyggaaagggggtttagggagttggaaagagggttaagaggagggtaaggaaggtggygggygayggggagaggaaagaaaaagggtgttttggyggtggttttggtaagagaaaggggtaaggggtataattgataaggtattgaaagtattgaagttagagttttgggaaggatttatygaattttyggyggtttaygyggggatagattttagttygtgagttttgagttttaygyggggatagattttagttygtgagttttgagttttaygyggggatagattttagttygtgagttttgagttttaygyggggatagattttagttygtgagttttgagttttaygyggggatagattttagttygtgagttttgagttttaygyggggatagattttagttygtgagttttgagtttagaaggagtggtagttttaggaygtttgttaggtggtttggaatgtgagggaagttttagtttygttaggaatagagttggygttgagttttyggttyggttygggttagaagygaggaaagtttgtyggygagtgttttttgtgttgygtggagaggggtgtgggyggtygtygattyggygttttttygtygttygtttagggagtttttgtttggtaagttggggttyggggaaaagtttagtagygagagggtygygtgtttygggayggttttaggggagttygygyggaaaygyggattaggygtttyggttyggatgtyg

SEQ ID NO: 11063 - DNA, 1502 bp, synthetic construct
  misc_feature 1..1502: note = Description of Artificial Sequence: Synthetic polynucleotide
  source 1..1502: mol_type = other DNA
tygygggayggagatagggagttgggaggaaaygtaaygygttttttaggtaatagatttygagtttyggttyggaaaygtttygaggtagaagtaagggtttttaagggtttygttttttagttttgggtttttattattattttttttttagattyggtgagtttaggttgatggatygtgtagtttagtttgagttagtttagtagtttttaatygggygggtagggaagaaggttttttattgtygggaagaggttagygygttttaagtttttygtaaatttygtttttttygtttggtayggtttttttgtatygttgtgtttygtttttaggtttttgttygttaagaatgtttgtttygggggygygttygttggttaggaatttgtyggtagttttygggaatttttgaggatgyggaggtgggttygagagttgyggtttygatgtyggggtgggagttaggtaggtygygygtygtygtagttttgtygtagygygtgttttggttttttyggatygaaaaggtygaagtygtttttygygatygatttygygtaattggttygggtttgtatttagatggttgtgggttttatagggatggtygggygggttygttyggtygttattttagggtygttagttttygygygyggtygtttttygttaggaagggtggygggttyggaaggttagagatgttttagtgtttttygygtygttaygtatttagttgttygygggttttatatggttgyggtyggagggttygtattaggatygtygtygtttggggaagygtttttttgtgggtagggygyggygggtagtgyggaagttygaaagttatyggagttyggggtaggggyggygygatgtagaggyggygttygggggtttttagttgtttgyggttyggttatttagtygygattagagggggygggggaygtaggaatttyggygttygggyggtgtgtagtygtagatttattttaagtttttaygtagttgygagagtttaaaaattgttaygtgtaygtygttgttgagtgggaggaggtgtttgttatygygtttaaaaggggygtttyggtgtttttygttatgtaagtaaatggtatggttttyggtygtttttgaataaaygagtgtttygaattttttattaggagggattaggygtataattattttygatatttttygggtatgygagaattyggttttttttagtggggtttattaatgttgttygggaggtaaagaaagtgatyggttaayggttttagygtgggttttttttttttttygtttttttttttaataaaggaygtayggagaataagttttttagtttttatagatgaggagtttaggagtygggygaatattaagtatttattgtgtgtttgtttttttattttggggaggttgggggttygggagtgaagggggtagygagatygygggttgttttaygtttatygtyg

SEQ ID NO: 11064 - DNA, 510 bp, synthetic construct
  misc_feature 1..510: note = Description of Artificial Sequence: Synthetic polynucleotide
  source 1..510: mol_type = other DNA
gyggtyggttttggaagaggtgggggygaggggtygggggtttataygttttgygatttttttttatgagaatgggygggggtagtttygggaagggtggyggatggagtygttttttttttaggattataggggygttttttagtgaaggygtygtaggaaaygttagtttgtgtygtagtgtaygtagaggygttatgagttygagttttttaygtttagggataaattgggagtygtgattgttaggtygygyggaggttgttttggtygtttttgyggttaggtgaaggygtagaggtagggaggtygggygagygtaggygggyggagagtagattaygyggaagaggtygagagagaaagyggggtattyggtygggggggttatttataagggaygttgggtaygaaggaggttggggygaagatgagtttaggggttgggttgagagygttgygtagtygggttgagaagagaagttgaygagtgattttygataagggayg

SEQ ID NO: 11065 - DNA, 940 bp, synthetic construct
  misc_feature 1..940: note = Description of Artificial Sequence: Synthetic polynucleotide
  source 1..940: mol_type = other DNA
tyggggygtaggtaggaggtattggaagyggaagygagtggggagttygggtagagggagtygtttatttgatyggtttygtttttttyggggtttgttgtagttgagggtttyggattagygattttagaagtyggttyggggtygggtagtttaatagtttttygyggattttttttygttggygygtagtagyggygygtggattygygygygggttygggayggygygagttygggtagygygagtttttgygyggtagggagtggygtatgygygggygttttgygagttygttggggygagtygagtygyggyggygtygggagtygggyggyggagttgtgaagaagtaagyggyggtaygggagtagyggygayggataggtggygagttttygttygygtygttaggggttgttgggttattygyggagtttygyggtttagaygtggygggggtggyggyggtatttyggayggtttgtgagggatgygtygtttattgtttygygtygtttgatygttttygtttygattygyggtgygttatagtygggttygyggtygttttygtygygttgtygttyggtygtygygttygyggggtygygttyggtayggttatgtggatttttayggaggaggagaaatayggygtaggtaggtgaggtttaggtttggtygtggygggggttttgggggaygygtttagttttyggtttygtttggattygtattttygtgttttygttattgttygtaggttgygyggtttyggygtggggygagygyggggtgggggtaggtgygggtgygggtgygggtgygggggtgggygygggtttttgtgtagagagggyggtagggggygttggyggtgyggttttggtaggtgyggttygygggaggggtgggtaaggttygggtagttgttyg

SEQ ID NO: 11066 - DNA, 2718 bp, synthetic construct
  misc_feature 1..2718: note = Description of Artificial Sequence: Synthetic polynucleotide
  source 1..2718: mol_type = other DNA
tygtygttagttatgatttatgttttagtagygttgggaagtgggtygagggaattgaggtyggggtgggtgyggaggtggttttgayggggagygtygatttaggatttggttyggattttgagttyggtaggatttgtgygtaygtaggtagygtygygtttttttttaggttgygagaggttgttttgttattaggttatggatttygagtygttygtgttgygygygygygtgtgygygttttygtttgygtttatgtttgygtygggggaggygaaggaggttttagttttagaaagagtagtttttggaatttattatttaggtyggtygtygttyggtttygtttygtaggttgtaggyggttttggagggggygttttygtygagygygygtttygygtygtygtttyggattttttttyggygtygygygggtaggttygattaggyggtygygggtttyggttttyggttagttttttagggttygyggttygtttygtttygygygttygtttygttgygtaattygatttaagttggaagtygatygtaggyggtygtattygygtttagygtagggyggyggyggyggyggyggygtagtttyggygagygaggyggyggtygtayggttaagygtggatygyggggggygttygygttygggagtagtyggaggattygyggyggygtyggygtttygttygggaaagtaaagttggagayggagggagygygygggygygggggttyggaggagyggyggtyggygtttyggygygtygagttttagtyggtyggatgggaggyggagygttygggtygtygtygtttgtygtttgygtttyggttgggtttygggatygyggggtygtttaggtaygttygttygggygtygygtygtygtgggttygaygtyggggygtttttygtgagtygggtygagggyggggtygygygaggatttygggatttgttttttttttttygtagtygygtygtygttygtttygggygttttttgttttgtatttataygttyggtagttgyggggagttyggtagttaygtttttyggygygtygttygyggagttattayggtygagggtyggttgttgggygtygyggttttyggygggygygttygagtagtaggyggygatgygggygtygatttyggttggggggygttygagttgtygyggttgygtttyggttttaggagggayggygtagttygygggaggattatggygttttyggygttggyggyggygttggyggtggyggtagyggygggttttaatgygagyggygygggygagaggggtagyggyggggttgttaatgtttygggggttttttgggggtygtygygyggttagtattyggygggygyggtggtagggttggttgtygtggtgggtttttttatygtttttatygtggtgggtaaygtgttggtggtgatygtygtgttgattagtygggygttgygygygttatagaatttttttttggtgtygttggtttyggtygatattttggtggttaygttggttatgtttttttygttggttaaygagtttatggtttattggtatttygggtaggtgtggtgyggygtgtatttggygttygatgtgttgttttgtatttygtygatygtgtatttgtgtgttattagtttggatygttattggtyggtgaygtaggtygtygagtataatttgaagygtatattaygtygygttaaggttattatygtggtygtgtggtttatttyggtygttatttttttttygtygttggtttygttttatygttagttygayggygtygtttattygtagtgyggttttaaygaygagatttggtatattttgtttttttgtatyggtttttttttygygttttgttttattatgggtttggtttaygygygtatttatygagtggttaagttgygtaygygtaygtttagygagaagygygttttygtgggtttygayggtgygttttygattatygaaaaygggttgggygyggyggtaggygtaggygagaaygggtattgygygttttygttygtygaygtggagtyggaygagagtagygtagyggtygagaggyggyggygtyggggygygttgyggtggggygggyggyggygagygggygyggaggggggygygggyggtgyggaygggtagggggyggggtygggggyggttgagtygggggygttgatygtttttaggttttyggggttyggtggtygtttgtygygygttagttygygtttygtygagttttttttgtygygtyggygtygggygygtagtagygtgtgtygtygtaaggtggtttaggygygygagaagygttttatttttgtgttggttgtggttatgggygtgttygtgttttgttggtttttttttttttttagttatagtttgtayggtatttgtygygaggtttgttaggtgttyggttygttttttaagttttttttttggatyggttattgtaatagttygtttaattyggttatttatayggtttttaattaggattttyggygattttttaagtatattttttttygayggaggagaaggggttttaggtagtgattygtattygtttgggaattttggatagtttygygttyggggttgggtagaaggggyggttyggayg

SEQ ID NO: 11067 - DNA, 2661 bp, synthetic construct
  misc_feature 1..2661: note = Description of Artificial Sequence: Synthetic polynucleotide
  source 1..2661: mol_type = other DNA
gygyggttttgtttygygttttttttagttagtatttaygtgtttttatttattttatttaggttattagttttatygttygtagygggttagaagattygataaagygttttttattttgtaggattagtgttyggttttygttgttttttygttttttttttgygtagatttaaggtttgattyggttttaaattttaaataaaagttgtgggtttgtttttaagtgatggyggttggagaaaattagagttgggggyggtatagttagggtgtatttttgyggtgggtyggttyggygtatttatagtttttagttgttagtttaggygttggggtygtagggattgaatttygtatygttttygtagttygggtgygygttttatyggtyggtttgtttttygyggttyggtttatyggtggtagggayggtttygtttgttttagtttaygttygttttttttttttttygtttgtggttttgttygtttttatttaagtttttggtggtttaaygtatttttgtagagatatttattaagagatagygtgtgtattttgtttttygttttayggaagaatttattagtagygttatttagttttattygttttaaagtayggtattttttagtttaataaaaagatygaaggygaaatattgtgggtttttgttygygaattaatygtttagttatygaattttttaaattgatttatttggaataagttattttgtttttttattttttattttatatatatatatatatatatatatatatatatatatatatatattgyggatygggggtttagttaygtatatattttaaaataaaygagggatttattygggatttttagtygggyggtygggygttttygttttttttttttttttttgagttttttagggattygttaygtttttyggaattggggtagyggttygtttatttygtgttygttgttggtygggatgattttagattygtttattaaggaagatttgatgttagttaaatygttttttttttygggatgattgatttyggygaagattttttttttttgaggatygttttygtttttgaaggggattatttygttygtggygtagagtttygggtttttttygtygtygttatttttttyggagagttggggtatttyggyggttttgtaattttygtttygttgtgggagtattygygtaatagtaggaaagatagaggggtaatttaagggtgggggaggaaaggagagttggaagggttygtgtagtaggatagygggyggaagyggggygggygagygyggggtygtyggtyggtagtyggagtagttgtygyggygttygaatttyggyggtygtygygttttttygtttygyggagatygaygtaggygttygttttygaggtygaagggtattgggyggygagggttgyggtagttggygatttygggggygtttgygyggygygygttagaygaggttgtttyggyggttatttygygatttygygtygtygggatttgygygyggagaaygtyggttttggagggagtaygtttttttaaagtgtagaggagggttyggyggygygttttygyggaaattttttttattgtagttatttyggatgtygatttagtagtttgtttttygagaaaagagaggggatttgggtagaagggtttygtttgttttaaaagaaggtgtaaggattagaagataaygaaaygtttattttttgaagggtgggaaaaaaagaaaaagaaaaaggagttatttaygttggagatgttygttttagatttttttatttttttttttttygtttyggttttttttttygaggtttatttaatttgttagagaaggaggaggagtagaagatgggggtygaggaggaggggaagagaaagagaagtttgttaagaataaagtttttgtyggtaagygyggggatttygtagtggagggtattgyggagtttyggggagttatagygggggtttygggtttaaatgtttttgttyggagttygagtygatatatatatttagttygatttttttttgttttyggttygagttttttagtttggttygtyggttygtygttttgtaygttttygtyggttagttttgttaaagtaaagagttgygttttttgagttygttyggtygaggggaggggaygtttygagtttggtygygtgygaggtttygggygygttttggtttttyggttygagagygygtagttygggtttttttttygygttttgtttygtaggtgagyggttgygtttttttattgtttttttttttttygygtttygtyggygttgaaaagttatttatttgygtygtttttttttttttttttttttttygtttttagttttttttggttgttygttggaggggaggyggggggtgagggggagtyggygagaaggaggtggtgattgagggtttttttttttttttttttttttagattttgtaggaygagttttggttttggggtgtgtgagtgtggtgtgtgygygygygtttggagggaaggattaggtaatttggygagagaaggaaggatygggygttgtttataatttatygaaaggtaygttttgttygyg

SEQ ID NO: 11068 - DNA, 801 bp, synthetic construct
  misc_feature 1..801: note = Description of Artificial Sequence: Synthetic polynucleotide
  source 1..801: mol_type = other DNA
gygaggaaaattgaygttttattttttyggattttgttygagaagttgggggattygggttyggtgtygaggtgtggttygagtttggtattatttaygtyggtygggtgatttyggttttttggggttttygygtttygttagtaggygaygttgggaggttggggtaggtttagagygaggaygggttyggattgggtagtggggatgtattagggtygggtgyggygggagayggttygggaggyggaaggtygyggatttgttygatagaagagtagatgaggggagatygaggaygttygggttyggggagtttaygaggaggttaggatygyggggtaaggaattygygggtagttattttygttaggggtagggttyggttagttaggygygagaaggttaggygaggtygattgygyggggtgaagaygttaggtygatagttgygggttttatygttagttttgaygygagtttgygttttggygayggyggagggygggtagggggygygggygttgttayggygtttgtttagaatyggtygggaaygtygygggygggttttttyggtttttygtttttttagttttgtttttaggttttygttygggttttttaagttgttagtygygttygttttygggtttttygttttttttttygygygtttttttttttagyggtygtyggatttttttagtttattttttttagttaaygygtttttyggaygttgttagtttgagygtataggtattgggyggggtttaygggggagtygtttaataatyg

SEQ ID NO: 11069 - DNA, 311 bp, synthetic construct
  misc_feature 1..311: note = Description of Artificial Sequence: Synthetic polynucleotide
  source 1..311: mol_type = other DNA
tyggttttygtttyggtggttttaggtttygggttttgtttggyggttttgtttttaatgyggagttggyggttttgtagtaaygtttttgttagtagygtttattgagyggttttttagttgttgtatygtttttagygtttaayggaaygtttttygtaygyggagtttataagttgtttgtgtygttattttttyggttttggtatygttagtattttttaggaattttttaaattygttttayggtgtagaayggtaattgtatygagtttttgtgttaattagtattttygtaatatygttagtyg

SEQ ID NO: 11070 - DNA, 1048 bp, synthetic construct
  misc_feature 1..1048: note = Description of Artificial Sequence: Synthetic polynucleotide
  source 1..1048: mol_type = other DNA
aygggagtaggtygggttgtttaygayggaagtttygattttggttggggttgtyggtygggtagygygggagagttagggttagagtyggggtygggaattttagtttygtygtttaygygggatgtagygattatygttygtygttttygggtyggtatttattttygtggaggggtagyggygttagtatttggtygyggatttyggttttgggggagttaagttygtagygttygyggtygatgygaaaygtgagyggggygtygyggtygggtttttgtatygttaygttgatgagygtygtgtagtatttttggttygygttgtttgttygtgtyggttataggttgtaggttagtagggygagygyggygagtygggtagggttygttygtttygygtagtttatygttttttyggtagtygtygttgttygyggatygggtttyggggtyggygtttagaggyggggygggygyggttygggyggyggygggagygygygygygyggtttgygyggggtygagttygagygyggtttttttggaygtygyggtttygtygttygtygtttttaygtttattgttygtttgtggggaygygtttatgggttttyggygagggyggygttttaggtygtaygygggygttttttyggggttttaggagggttgtagaagygtgttttttttattttttygggtyggttttatygaatgggaggygtttygtaaggaygyggygggggaggggaagggyggtaygggaggaagygtttygaggagggttagyggaatataaagtttttttygygyggttgtygtttgaggygygtgttygtygtygtttygttttttygttggtttagyggtaaygygtaggtttaaggygtagtttygtttygagygtatgygtgttagggtttgttygttttygttygtttgtaygagggttygggtagtygggttagtygttggtgttggttgtttttttgttaggygtgatagtygtagggygtggagttygggagatttgygaggayg

SEQ ID NO: 11071 - DNA, 301 bp, synthetic construct
  misc_feature 1..301: note = Description of Artificial Sequence: Synthetic polynucleotide
  source 1..301: mol_type = other DNA
gygaaattygttttygtttygaagaagggttttaagaaggtygtgattaaggygtagaagaaggayggtaagaagygtaagygtagtygtaaggagagttatttygtataygtgtataaggtgttgaaataggtttatttygatatyggtattttttttaaagttatggggattatgaatttttttgttaaygatattttygagygtatygtyggygaggtttttygtttggygtattataataagygttygattattatttttagggagatttagayggtygtgygtttgttgtttttyg

SEQ ID NO: 11072 - DNA, 1395 bp, synthetic construct
  misc_feature 1..1395: note = Description of Artificial Sequence: Synthetic polynucleotide
  source 1..1395: mol_type = other DNA
gygaatygatttgtatttttttgtttattaggaagyggtygtygtygtygtaattgttggygttgatygygtaygattggaaagttgtaattttatggttygaggggtaggttygggttgagtaggttttygagtygttattgttaagtatggggtattttaggaaggagtttatttttgtattgtttatttgttattgagtgatttggttttgygaagttyggygtgattgtgttaatttttttattttttttatggggtyggagaagaaaaatgatatgaatgtatagtgygtaagagggggggygggagggyggaggaygttggaggaggggtaygtgayggtgttagttaatggttgagttttttgtaaaagtttgtyggttttygtagtgatggattatygttttagtggtatttaaattttyggygtttygtygtttaggtgaygygtagtygtttttttaggtagtttaggyggyggtagttgttgyggygattgtaaaggtygatttggagtgttggagygaagaagagtaaaagttgygttttgygygygttygatttygttgttygtttygttaggttttygggaggtgggggttgggaggygtttttygttttygttttttttttatygtttaatgaaagatgaattggygagaggtgagaagggaagagggttttyggttttttyggggygggaattagtgggttagagttygtygggtggtygtaagtaygtyggtttagttygtagygygtttagtyggaaggyggggaattyggttgatatygygtttygggtttttaggttattttttttgttttgaggttgggttgggagatygtggggttgtgaggagygtatagaatygtggtggagggygaggttgggttatyggttttttaagttyggaatggagggggaagagygtagagggttggttgggaggaattygggtgggygtgaaggagaygagggtaagaaaagaaatttttttttttttaggagggttttygaaattttttttttatagtttttttygttattagtatggtaatgaggagtttttgtaattygatttggaggggyggatgagttttggaaatttagagttygtyggaaaaggtygggggyggtygggttttttttttttattttttttttttygtygtttttygttttttttttttttttatttagttttgtatygggagtttttygggatgyggagttattygatygtyggatttttaggggtaggaggygggggagagagatgaygttggyggaygtggttagygygggggtygggyggtgygttgtaggttatttgtyggygttttgagatttaggagttttygygttttygygtgggttttatagggtyg

SEQ ID NO: 11073 - DNA, 766 bp, synthetic construct
  misc_feature 1..766: note = Description of Artificial Sequence: Synthetic polynucleotide
  source 1..766: mol_type = other DNA
tygggtttttttygttgtggttygtttgtatttttgagttggtatttgtttttygggyggttagaygttygtttggtttttttttyggtttyggtttttttttygyggygttttaatggttttygtttttygygtagggttaygattgtttttyggtgttgtttatttatgaygtygtygyggggatgttgagtttyggygggyggttggaygtttttaagtagagttygtagygtggtttgayggttygygagygtttttagaatttggataagaaggygagtttygagggtggtayggttgygggygygggtttagattygttgtataagaatagygttaggtgagagygggagtygggtyggygggtgggyggggtttyggttygtttagaaatagygtygggtgaggaaggggtttggagttttttttttggggtattgtgttgggattttgaggattggggattyggagggagggtaggygtgtttttaattygttgygtyggaayggygtttgatgagyggygggttyggataygaggggayggggtygatttgtgggyggggttttggygtygtattaaaatygygtggggyggaggtyggtagaggtygygtagygggtttagggtagggagtggttttgattygttgyggaataatatygttagttgtgggyggggtttattttgattttattatagtagtttaggtgttagtggagtttgggagggatayggtgygatygatataagayggggtyg

SEQ ID NO: 11074 - DNA, 691 bp, synthetic construct
  misc_feature 1..691: note = Description of Artificial Sequence: Synthetic polynucleotide
  source 1..691: mol_type = other DNA
gyggtaaagaggtyggatayggaatygttygttyggtgatygaagagayggygaggaggagttygygaattygtttttgtttaggtttygtttattygaygtaatttgttygtttttttttatttttygaagggtggagtttgaggtttygtttttaagyggttttttttyggagtgtttggyggttagtagggyggggtaggaggttgggagagggaygggtgygggggtgggggagaggaagggagyggttaygtgtgaggggyggttygaggttaygtgayggagygtyggagyggagggagtyggggttgggagtttttttgagggaagaggagtggagtaggggggaygyggyggyggygttgataatggtgagtgygyggyggttagygygttygtttttygttttygtttyggagygygyggygggtyggttaatygygggtygggygtygtyggaggaggggaygggggagtagggyggggagyggggttaggtttgtygggttatttttgggtttgggaaaagttggyggygttattttttttyggtttyggygaggttygagtatttaygggyggyggygtgtttttttggttatgtyggagtttttgttygygtttttygattgtttgttggggttttggttggggattyggatttygtttttgygggggttggtygtyg

SEQ ID NO: 11075 - DNA, 1024 bp, synthetic construct
  misc_feature 1..1024: note = Description of Artificial Sequence: Synthetic polynucleotide
  source 1..1024: mol_type = other DNA
tygggagggygtagygttygggtggggagttygagttagtttaggtyggttttggttttttgatttagatagygtagggygygagggatygygyggtygagttygggtygygtygtttttagtatyggggtygttagttaagagttygaggttttttygattyggatgtgatgaaaaagagtaatagagggagaagtgttttaggattgtaggagtggaagaggggaaagagaggtagagagggggaaggttttttygtaggggagtyggttggagtgagttggttggaaagagggggyggagtgygyggagttagagtygttatygttgtygtagttgtygttattgyggygtttgggttgagtyggagggaggygggaggaygygtaggggyggtygtygtygtygttaggttatyggggygaaaatgyggtygttgtyggaggttygttaatttttyggggtggaagaggaggaggaggaggaggaaggggtttggagygattayggggggatgyggaggtaggtagtggttttygggyggggaagaggaggggtttgatttttattttyggggtttttttaaattygatttttttttttagttttttttygttgggtttatttyggatttttgggatttygtygttgttaatttgygttgtaatagtttttttygtaagttttaaattaaaattttttyggggtggagtttgagggagggaagtggagggggagggaaygtttygtaggggtggtgtgtttttttttaaaaatatttttttttttaattttgtatattttttygttagaagtagttagttttttgtatttagtattttatagtttttttttygtgygttttgtygggyggygagttaggyggtagyggygyggygygggttyggyggagyggtttatgttyggygygggygaagttttygttttygggttygtggggtygtagygygtggtygaggygggyggyggttagttgggttttatagtttagggtgagtgygyg

SEQ ID NO: 11076 - DNA, 1339 bp, synthetic construct
  misc_feature 1..1339: note = Description of Artificial Sequence: Synthetic polynucleotide
  source 1..1339: mol_type = other DNA
tygtttttagygtttttaggtttatttttygtagatttttttygggtygtttttttttgttttattttaggygttttttttttttygtagttatatygtggttgtattygtygttttttttttyggtygttattatttyggttttttagaattttagtttttygygttygtagtygygtttttgttttttygattttygtatttttatttggttyggttttttygtttttttttyggtttttttttttaggatatttgtgtygttttattttttttattatataygtattttttattttaattttttygtttttttgttttttttttttygtyggtttttttttttygttgttgtttygagagttygatgtgggagggaaggygygggggaggggaggtygygaagggggttgttttttttygggtttttygtgttgyggaattgtagggttttttagygttttttgtttttttygtyggyggygyggaagtyggggtttttyggaygttttygatgagggtatttatttttttgtyggggatattttgtagayggttttaatattggtaaatattatagagaattgatttygttyggtygtygtyggtttttatttttygggtttttygtttttygttttygttygttttygttygttttttyggygttttygtygygttttttygygttygygtygygygttttygtttgygtagtygttttygygttttagtaygttyggtyggygygygygttyggtatyggttttatttttatttygtttttygttggttygygattaagygyggttattgttygygaygtagttttygttttttggyggttgtygggttttagtagttgtaggttttgyggggttagyggyggygagttgggtttttgggygagggttattttyggggggtttgggtaygygggygagygattgygtaaggagygygttyggttygtagttttttygttttyggygygatttttygttttttygtttgttaagggtgggtttggggtagttttttttatatttgtaattyggtaattttttttttygttygattgatygtttgttttttttggttygtattttgtgttttgatttttygttygtattttttttaggtttttyggttgtttttttgtgttgtgtaggggaygygygattatttygygtttgtttyggtygtygttgtgtaaygtayggtttagyggattttgtatttttttagaygggggagggggyggggaggaggttgttttatygtttygtttagtaaatattagggattygtgattatttgttygttaagattygyggyg

SEQ ID NO: 11077 - DNA, 2273 bp, synthetic construct
  misc_feature 1..2273: note = Description of Artificial Sequence: Synthetic polynucleotide
  source 1..2273: mol_type = other DNA
aygyggtggtattggtggttgtyggtagttgtygtttgtagagtgggtgagatygagtgtggtagatggtttggttygyggtgttggaggggattggyggagtagaagygttttggygtygggtttttgtttttttggagttggggtttggggaatggggtyggttattgtagggatagaggagagggtagggtaatgggtgygtaggggttttttttaaaggttgygggtggttaggggtgtgygggggygttgaggtgyggtygtygagagattttggtttttagggtggtygggtttggtatggattttaggggatggtgtatatatyggatyggaygggttttttttttattttyggatttttyggttgggtagyggttagggagaggggygatttaygggggygggtgtggggaygtyggattaygygttaggagttttagatgggtttagatttttatttttygtttygggtygtagtgaygttagggttyggaygttttyggaayggttttttgggggygttttagttttayggattygtagggagttttygtygtaatttgtatggggtttatttgtatgatttygtttygygygggagtygggggygtyggygattggaggagttattgttaatttttaggggaaagtgggygaggygatttttgggtygtttattttattttattttttagttygygtygtatttggggtttttttttatttaygtttygttagggyggggtygygggygtagatattygygggtataygtaygaygaygygtataygyggtygtaygyggtttttygagttttttgyggygatttygatttattttygygggtgyggggygyggattygttyggtttagtttttgttttttaggygtttttttttttygygatttgtttyggtygtattygttttygttttagtaygygaygttgttyggygygatttttgttttttyggtttagttttatygttgttttygatttaattttagttgaaygttygtagttttagttttattttyggtttagttttagygtttttagttttattttyggttttagttttagttttagygtttttaggtttagttttagttttatttttagttttaatatttttaggtttattttyggttttagttttagttattttagttttagtttyggtttagttttagttttagygttttyggtttygggtttagttttagttttagttttagttgagtattttyggtttygtttgttyggygtttttttttgtgyggygttttttygttygtattygttygattttttggaatttttygyggaygtyggggtttttggaggyggttttttttgtttttgttttygtttttttttygyggygttttygttttttatttatttttttagtttygyggggaygaggggagttggagggagttygggattyggygyggttttygtaggyggygtttttttttygttttygaygyggtygttttttttgtttgttygtttttatygtygttttygtttttgtyggggayggggatagtagattttyggygttyggttttygygtatttgtygygygtatygttttttyggtttgygyggtttygggggtttygggaagatygagygttggyggttagttyggggaggttgtgggtagtaggggtggttgygggtttttagtttttttttygtttatttyggagtttatatttgggatttttatttygggagaattttgttttttttttaygatgagtttggaggattggagtygggatttggtatttttagggttgtgattgggtgaattttgagggtatagttgttgttygtygttttaggggttttaggatggggygagtagttttgaagaggtttaagggtatttygtgaggagtttttaygttttgagagtggggygtagagtyggagtttygggttatgttttygttgtygttggygygggatattyggtagtygtttggygtttttttgttggtgygaggttttatggtgttttgtaaygtttgtttgattttgttggttatygttaygttyggtttygyggtgttgttgttttttaataattgtaggtggtygygggyggggygtygtattggttaagttttaatttygaggtttttgtatatagaggttggaggtygyggygggttygyggggttttyggtagtttttyggggatgggatgggttattttgyggatttttyggtttttggaggtyg

SEQ ID NO: 11078 - DNA, 5586 bp, synthetic construct
  misc_feature 1..5586: note = Description of Artificial Sequence: Synthetic polynucleotide
  source 1..5586: mol_type = other DNA
gygtyggttgttggggttgttaggtgttaggagaygtttttttygggtttgtttyggygttygtttttatyggygtttgttttgtygtttagttataggtttygggttttttyggtagygyggagttgayggtgggygyggyggtygtttgttttttggygttggagggygtygaygtgagttatattaattatygyggtyggagttygttggatttggtygtygagggtygygtgtttaaggttttttagggttgygtttagygttttyggtgagttygtggayggyggggatggggttyggyggttttygggttttttttaagtygttttttttttttgtagggagyggtaggygggygggggygyggtttygggttttaggtaaaygttygggatttttaatatygtgaygaatttgtaygtgggygtygygtyggggttygaggtygttgagtgtttggtgtgtttygagttggygttgttggtgttgttttygtygtgttagtatygtatygtgtgtgagggtgagtggggggtttyggggtggggaggttyggttagtagggtygtagttaatygygttttttttttygtagagtgygygygtaggatgaagaagtgtattaggtgttaggtggtygttagtaagaaattgygtttaggtgggtgaggttttgygtttttaataygttttttgtttagttggtggttygygggttttygttttttatttttttttttttatattttygtttatggtttttttttaggttatatttygtttttttaaggtttatattyggttttttagtttttagtttttagttttgtttgttttagattatattyggtttatagtttygttttaaggtaatattttttttttttattatattttagtttygttggattttayggttttttttagattatattttttttatagttttattttagattatagtttatttagagtatygtttttttattatatttyggtttagtttatagtttatttgtagttttgattttagttygtatattattttatgtttgatttttayggtttattttttgttygtattygggttttatttttgtttttaaattatttatttygttagttttttttgtaggttataattygttttaggtgatatttygtttttagtttygttttttygtagttttttgtttttygtatttttttattyggttttttagtttatattygttttttatttygtagayggttttgaggtggygagygtygttttygttttyggttygtygygttagttggtggaggagttgtagagtygttatyggtagatggaggaaygtattatttgttttatttgtatygatagttatattygtttygtgttttagtgyggttayggygtatgygttttttgyggtttygygtttagygtttgttttatttgtygttagtttattygygatygtatttagattttygtgtgagtygygtygttygtygygttygagttgttttygygtgttttygttttgtgttttataaaaagaaagattttyggaygttgtttttgttgtttgtttgggggatygggygtttttggggtttttttttygggataygygggygagtttgggggygaggagggggggtttttttttgggttygtttygttygttttaggttttygggtttagattttygttyggattgyggttttygggttaggatattttttaggygygggtayggtygtttttygttttttaggttygggttygayggggyggggatttttgtgtttgttttygggtttttttygttttttygttttgggggyggtygyggggattygygttttgatttaaggggttygatattttttagggttgtggggtttygttttagtagggagttagttggggggygttttaggtagggtttgggggtygggygtaygtaggyggggtgaygagttgggggggyggggggyggtgtyggagtaaatayggyggttaggtttagtttttygygttttttaagaatygttygyggtygtygttagttgtttggygttgatttygttggtygggttgtygttattttgggttygaygtyggygyggaaaayggggagggaygagatagatataggtyggtttggttyggaattttttgtttttttgtttaattttttattttygtttygygggaygtyggtgttyggtttyggttttagtttagagtygttygygtttggaygtyggtygtttygtygaatttttgggttttygagtttttygttttygtttttaattaggatyggtttagatttttaggttyggygtttagtttygtttttygtttttttygttttttttttttttttgttggggtttagtyggggatttaggagttatatattttttattttaygygttattttttayggggtttttygtagttagggttygttttttttyggtttttygggagattttggtaagtttttttttttygtttygtaatttggtatttttygyggtttttgtttatttaygtatttttttttygtttttttttttatygttttatatttattgttaygtttttattyggttatttttttttagttttyggggatattgttaggygagygaygygttttttgyggtttagtttagttgtttgggttaggatggagatttygtttatgtggggtttaggggttttttgaggattttatttgggaaaaaagttattagattatttattgtttagtagtgggggtttggggatttttattgttatttttttttaagygggagttttggygttgtttttttygggttgtttggggtttttttygttttttttttygaggatttygtttagtaggttatgtttaggtttttgtttttggtttaygggaygygggtttttatgttttyggttggagatagtaggtagttyggttaayggaygggttagttggttttttttaggggtagttttgttttttttttygtttygttttttttttttttattatatygggttgtaattygagtygtygagttattgtttttttttyggatttttttyggaggttttgyggttygggttttygygttttgttgttttatgtagttttgagttttatagtaagtttgttatgggtygyggggttygtgttttttyggaggtttygggggtaggygtygagygtygttggtttggagtygygttggtygttttgtgtttttttttygygttggtgttgttggttyggttgggggtttyggyggtgtyggtttggagygtagygtaggtgagyggygggggggaggttaggtgtygggttgggggggtttttaygtttgtgggtttggtttatyggggggttygtaggaygtgtgyggggtgtgyggggtgtttgagggttyggatgtgygtttygaggtyggagggttggaygtttttgtgtttagttgttgggaggggtgggaggtttygttttgttgtttagtttttttttttttattgggtygygtttttagggaygtgtaatagggygtttaggttaggagattygaaattataggtagataggattygttaygttygtttttagttttgggtatttttattttygtttttttttagtttatttttygyggtagtttttggttttggggatygttatygatgttttttaygtaygtttttttttttgaagggagaygtygttgygttgggtttttyggyggttttttttattygggtttygggtttattggtttttygtagaygtygttataygttgattttagttaggttgygttgggattattttaattttatttataggtgygttttggttgggtttygggggagggggygyggtyggygttygttgagtttattttttttgtaggattttttttttttygyggaatttgttgagttygygggagaygyggygggttttagttgtygtttttygtatgtggagygaygtgtttttttttagttttygygaggtggttttygagtagtttagygattttyggataggtgggygttygttttygtttyggttyggttttgygygttyggttttttagtttygtgttttttttaggtttttattygattaattatayggattgtttggttttygygttgtattattgtttygayggttttaygggggagttggtttaygttttttttttttygtayggyggtatttatttygaygatagygagtattgggttttgggttttaygygttatagttggaagaaaggtgatygtttaggttggttttttggaggttttttttttgtagtatagtgggttgtygyggtygggttttggggtagayggtaggagggatttttyggggtggtggttgttattggagtttagtaggtaaggaggggagttygtgggagtttttatttyggtagttttgaatttttttttttatttttttgygtttttggagygggagttggagttgtatttttgggggtygagtttatygtttgggtttagaatatttttattttttygtggttgyggtygagggyggtttygyggttgygttttagtagatatatygggtttyggggagttggtttaygggyggyggggttgggttyggggtttttaggygttgattttyggggttygtaggygtgtggtttayggatttggtgtaygtggyggtttaygagatyggttaygygttgggtttgatgtatttataatayggtygggygtttatgtatttgaaygttaygttgygyggttggaaggygttgttttaggaygagttgtgggggttgtatyggttttayggtgagtttttttgtygggygggagggyggggatygggyggttttgagttaggtygtgttttttaygttttygataggatgtttygataggttgttygtgtgygygttttgggygyggaggggtttttgygaygttygtyggyggtttatgaagaggttttgttttagtagttgygatttttgttayggtgatgtttayggggtygggatagggttgygtgggagttgggttttggttatggtyggggttgagggggtattgayggggtttttttttttattyggagtagaattttttttttttayggtggttattattttatygttttttaggattaaaattaggttggtgttygagggtaggaaygtgatttttygttgyggttagaagattttttataagaaagggaaagtgtagtgagtgagygtttygggyggttttyggggtgggtagttygygggyggttttggggtaggggtgyggggtaggtagyggggggggttgtgtttgtaggagaygtttygtttttttgtagttggtataaggattaggagtttttggagtttttttatttyggttatttggttttgggygaggygtatttgagtattatygttaaygtygttaatgagggtatttatatttgygtggtgygtygttagtagygygtgttgattatttatttttggygagttygtgtgyggggttgagttyg

SEQ ID NO: 11079 - DNA, 1264 bp, synthetic construct
  misc_feature 1..1264: note = Description of Artificial Sequence: Synthetic polynucleotide
  source 1..1264: mol_type = other DNA
gygyggttygggygtagtttyggygtagttttygygtygagyggtttygygtttygtattagtttttgttyggtttygggtgaygtygtatttttygattggattaygyggtttggggggyggggtttggttyggtgagtttatygtygygtttygttattggttygggyggygtattygggtagtggyggggagatygyggtattyggagtttygygagtygttttagttgyggygagtggagttgagygggygyggggtygggttgggtygggtygggyggggtygggyggggygygggagttagtgagyggyggttyggygtaagtttgaygagtaggagtygagtttagtaggttygggtaggtgygyggyggygyggggttaggyggagggygygtgyggtygagggyggyggttggygggggygygygyggggygggggyggggtyggggygtggggataygygtgttygygggtygggggygtggtgygyggttaygygtgtttttggygygagtgtgyggggttaggtygggagggygtgygyggatygggygtgtttaygygyggtagggaggggttaygagggtgygygygtttttggygygagtgggaagtgtggggattyggygggttyggtgtgaggggygtgtttttggggygagagtggggagtgagtgtgaggagtaagggtgaggggttgtagggaggggtgygtttggtygaggagtgggtgggagataygygtgtttatgtygygagggtgtgtygaygttygagtttgygtggggttyggggtygtgtgtttggagtggtygagggygtgaggggygygygtgtttgtgygaggggygtgtgyggygggtgtgagttaygygtgtttgggtgygygygygggtyggatgagtttttggagtggtgygaggaygygygygtgtgtttgtgttggagygagggyggggaygagygtgtygggygygygygggyggggttggggyggygtyggggygygygggggttyggttyggtyggyggygagtgtgttggggygttyggtttttttttaataygggtttttgggatttagtgtygtttttttttygyggyggggttygyggagttttyggtttttttgggtagataggtgygaggygaggtgygggtatagttttgygttttttagygggtgygggatygggygaygggggattgtttttaattatagattaggggagyggagggaygttygatttattygyg

SEQ ID NO: 11080 - DNA, 716 bp, synthetic construct
  misc_feature 1..716: note = Description of Artificial Sequence: Synthetic polynucleotide
  source 1..716: mol_type = other DNA
tygttttygyggggygggaatttygygtttttttttttygagttttattttttatggtaaagyggygtggggyggyggggyggagggagtygagggggyggggagggyggaygggyggaggggaygggaggtttagyggtttygggtttygttggttygggygtyggatyggagtygtyggggygygggyggtttaggtaagygggtygggtgggtgggggtygygttttttygtttttgttttyggtgtatataggtgatagygtyggtagtgttyggtyggagtttgttyggtygttagtygggattttyggygyggygtttttggaggggtttgygggtggggggtgyggtttttaygttttttgygttttagttttttggttttttttttyggagtyggggagtyggtaggttyggggygagggtttagtgaggtyggyggagggtygagttttagttygggagygggagtyggggattyggygygtagggyggaagttttygtataaaaggtyggagtttygtatatggatygaattaaagtttyggyggygtttagyggtgatttyggyggtygttttgttyggttgtttgyggagggtttygygttttyggagttygggggygttttaggtttttttttttagttagggttaggtaaggggagggaygggtttyggggttgtttttttttgggttttaygygttygtyg

SEQ ID NO: 11081 - DNA, 619 bp, synthetic construct
  misc_feature 1..619: note = Description of Artificial Sequence: Synthetic polynucleotide
  source 1..619: mol_type = other DNA
tygttygggattyggggggaggygygttgggtggttyggtagtygggggygggyggtagtttgtaggygtaattggtatgtaygtygttgtagttgagatygtttaataaagtattatatattttatygtttttatattttattattttaygyggagtttgtgagagggttttaatgggagttagttgtgtttttattttttgttgtyggtygggaygggtttttttgyggattttttgaaatgaaataatgtgatgtaygtygygataagggtyggtttgtaatgaggtttaggtygtygggyggttgttattgttttaggtgtygygtatttgggttgygaggataaggaggaggagggggyggygtyggaggatygggggggagggggaagtygygaggggtagggggtgggagaaggyggagggaggaggtagggggtagggggygggyggaagaggggaggaaggagggggyggygggtygyggtaggttaggygggagaagtyggagatagagagaggayggggatagtggyggtttgtagagttttaggaattygggtttaaattttgttygttagygtgagagagygtttgttygtttaggyggtttatyg

SEQ ID NO: 11082 - DNA, 293 bp, synthetic construct
  misc_feature 1..293: note = Description of Artificial Sequence: Synthetic polynucleotide
  source 1..293: mol_type = other DNA
gyggtttyggtaggggttgttgyggygatttaggttgttgyggttttagttttattagttgttgttgttttttaaggagaygtygtygatagyggagtagtggttgttgttgttgygggggyggtagttagaggttttagygttttaataatyggagtttaggatgttgtttyggttgttgagaggttygtaatttttagygttgygttagagaaattygtttagtttagagygggttygtttygttgyggtttttaygyggggttgggtttyggagtttgtttygtaaagyg

SEQ ID NO: 11083 - DNA, 2748 bp, synthetic construct
  misc_feature 1..2748: note = Description of Artificial Sequence: Synthetic polynucleotide
  source 1..2748: mol_type = other DNA
ayggtagggggttttygtgtttttygagaatttaagaattygtttygtttttaygyggaaagttgggagaaaaattgttttttttttatttttttttattttttatttattygtttttggagtttygttygtagatatttttttttttygagttagaaatagatatattattttttttttattttttttttygtgygtatattygtttttttttttttgtttgtttttygtttttttttttttttttttttttgttyggagttgtagtttgtagtttygattygggttggttggttggttgagtgyggtyggggygttgttyggtagtgyggtgtttaygggattgataggtaggtaggtygygggttgggattyggatattaaagtaaaagtatygttgggygtyggaggagtygyggggtttttattttttttttgattgatttttaaattttaatttgtatttttttygtygtttygttttttttttttygatttygttttatygtttttyggtttttttgtttttttttttttttyggttttttttttygygttttttttttttgygttttyggtttgttttttttttttttttttygtttttttttttttttttttttttttttttyggtttttttygttttttttttttttttttttttttttygttttttttttttgygttttygttttttgtttttttttttygtgtttgtagaygygyggatygtttatgygtttttygygggtagaatgttgggtagtagygttaagagygtgtagttygaggtggagttgagtagyggyggyggygaygagggygyggaygaatygyggggygtyggtaggaaggyggtagyggyggayggtagaggtatgttgtttaagygygttaaggygttyggyggyggyggyggtatggttaaggttagygyggttgagttgaaggtttttaagttyggtagygtggatagtygtgttttyggygggtygttygtttttaatttgygtaagtagaagttatttattaatttttttttttttayggatttygagaaaaagttgtagttttatgagttygaatggagygaygatatggttaaggygtttaaaggtttaggtaaggtggggtttaagggtygtgaagtttygttgatgtttaagaygttgtttaagtyggagtattygtttttttaggttaagggtagttyggygggyggygttaagatttttttggtttygttygygtttaatttgggaaagtygagtyggatttttygaggattttatgyggaggttaagtygtttagtaaggygtttgaagyggtygtgagygaagatggtaaatyggaygaygagttgttttttagtaaggttaaggygtaaaagagttttgggtttgttttttttgttaagggttaggaggagygygttttttttaaggtggatttygagttggtggtgatygtgttgggagatttggagtagttgttttttagttagatgttgggtaagttttgtygtttygtttygtttygtttttggtttttttttaattagttgttggggaaggtgtggggaaagygaagttttttttttttgygttttttyggagggtttttttgtttaygattaggttgtgatgggtattgygtttagatgtgttgagttggtttatttttagatgygtatggtttaagtgtatttttttaaagatattataggygggaattygggttygattttggtttgttygaggtgaggttggataatgggatggggggtgagggggttataggtttttagaaatagagttagaattttaatatggtaaaatttgggattggtggaaattttygttgtggtgtggtttgygtttgataggagtatttygtattgtaaggggagygtttagygagagttyggatttagaggatagatgtgggagagtagatgtgagggttgattggtttyggaatatagttgaggttttattttttttgtggatttygagtgggagygtaagtyggattttttygyggtgtgaggattttggttaaaagaagygtttagggtygggggygggygggttgttagttgtgygtatttgggygtatgttygatattttagtttyggttttggttttaatttttatattygtaggttttttagggygtgtygaaagttttgggygttagygtygagatttttgtttgatygggaagtttttgttttgtggttaatggaagtygagtaggygggaagggaggaataaagtttgttygagtggaggaagygygtagagttgttttattgtttttygtgtttgaagagtttatgtaaaaaaattygaagygggtttyggaattgtttttttttttttyggagagtttttgtttttagagaggaatagatttgggatgtgtyggaygttaggyggttatgtttygggaattggtaygggtttttttggggttayggaataaggayggtggggtttggtgtttaggygagttgttttggttgygyggatttgttgyggtggttgggttgtgggtttttyggygtygagggattygagttttttgggtattyggtaggttgttygttygttgggggttgggaaggggygtgttaatgygygtgtgaaagggyggggtygagtgaygggtttggygggtggggaatatgtaagagttygtygggyggttttggagaatgygaagtyggaggagatyggttyg

SEQ ID NO: 11084 - DNA, 433 bp, synthetic construct
  misc_feature 1..433: note = Description of Artificial Sequence: Synthetic polynucleotide
  source 1..433: mol_type = other DNA
tygtttyggygtttttatygtygtygtygtygtttaatagagtttttggggyggtttttatygayggtgtagttygtygggatygggaggaagtagttgyggttatygygtygtgygttygygttyggtygttaggtgttttagtagttygatygtygagatgtttagttygtyggggtttygggygttatggttttgygtygygttgtgygtttttyggagggtyggyggygttttttagttyggttyggggtttatygtttgttyggttttttgttattgttaggaggayggtattatgttgtttgtygattgttttgagttygggttgttygtygtttygggggatttggattttttgayggtttatttgtgagtattgttygtttgttttygtttggttttgygggttgttggttagygtttagtttyg

SEQ ID NO: 11085 - DNA, 1376 bp, synthetic construct
  misc_feature 1..1376: note = Description of Artificial Sequence: Synthetic polynucleotide
  source 1..1376: mol_type = other DNA
tyggtatyggggttgtatttttgggtagaygttgtatgtttgtttttaggygyggttttgttgttatttttttgggggttyggagygygatagtagtttggggaygtttttygygtttagtayggtgtatttgggttttgaggttttggtygaaaygygttaagttgggggtaggtgtagygattttatatttttyggttgygygttttggyggtaggaggyggggtygggggyggggygtgagttggtyggggyggggtttatggaggggygggatygyggygttttataagtattgyggagygaggygygygttyggttagagagygagygygtaayggyggygayggyggygattttatygygtattttgttaggttttyggygtttagygttttaygygttttygygttttygygttttygygttttttttttygygttttygtttttyggttygttaggtttttttgtyggttattygttaggtttygygtyggttygttygtygtttaggatyggttygygtttygtaggtygttygtygttygygtygttatgggagtggagggttgtattaagtgtattaagtatttgtttttygtttttaatttygttttttgggtaagggttgygtygggggtyggggygggagggggtaggtatatattttaygttgggtaggtttygyggtagygtgttaggtttygygggygtagygygggtygygaagttgtggggttatttgtgggttttaggagyggggtggggggtygttyggggttatygygtttttygatattggggttgagggttgygagtygagtttyggggtttttgtgttygggggtttatttttgyggtygggtyggggtttttgggggtygtygggtagttttygttgtggtggtgatgggtgyggtggtygygggtygggattygagtattyggtygttttttagttaaggaggggtttgygygggtttttggtygyggatttyggattgttgtttygyggggaygaggggggggttygygggygggatttttggygtttygtttttatgagtttattaagagtygtygtttttggatggtggggygggggygtatattttgtyggaggttgggggygattygttttattttttttttagtttagtttattttttaatttgyggttattattygagatttttttgggggtygygtttaaaaggagygtagattttygtygggatggtttagaagttggggtgygygtattttggtygtttttgtttgggagtygatttttttttttttatttagataygttttagyggaggtttttttttagaagggttttggaggtttygtaggagtggggatttygyg

SEQ ID NO: 11086 - DNA, 3393 bp, synthetic construct
  misc_feature 1..3393: note = Description of Artificial Sequence: Synthetic polynucleotide
  source 1..3393: mol_type = other DNA
gygggtgtatagggagygttaggattttagygttttgtyggattagatttataygttygaggtgatgtttattattaggtatatgaagtatttgagtatgaagayggygtagtygggtttgygtgtttggtygggttgtaggtttygtaggtaygggtagttgtgygtggttttttagygygggyggttgtgttgttygtagaagaggtaggygattattatygyggygggtayggtgtagagtayggtgaataggtttaggyggattattagtttttttagtttgtgygttttggtggggtygttttgttgtttgatgatygagyggatgyggaagagggataygaagtyggttagtaggaatatggtgtygatgaagaggtagatgattagyggygttagtaygaagtygygtaggttgtttaggttttggttgtttaygtagtagatgttygttatygggtygtygtttatygagttgagygttagtatygygatggatttgaygttgggtataagttaygyggttaggtggaagtattgygagtagtyggygatggtttygttgttttattttatatyggtygttaggaattatgtgagygataagattatttattagatggagttggttatgtygaagaagtagattagtaagaagattayggtgtatagygyggggtyggtggtttygtagygtaygtgttgttttatygygtttagtttttygtattygtygygttygttygggtygttygygttygygttygtygygttygygttygtygtygygtygttygygtttttagygtttttygygttyggygygttatygttgtaygttattttttygtggttygttattaggygtattaggtagtttatygataygaagaggtagtaggtygagaggaagataatgggtygtttygggtatttgaagygttttatgtygataaggaaggtggagayggtggygaaggtggataygaagtagagtatygattataggtygatttagaagayggtgaaggygygttygttttggttgaaaaaggggttgtggtagggtagygygtagttagygatttggtttgttttgaygyggttgtagagygggtggygttygttggataygtttattataggygygyggtattggtattygggttygtagggagtygygtygtygttagggggtygygttttttygttatygtygtygtygygagttgggggygtygtygygttttygtygttatygtttttgtygtygtygtggtgygggggtttggttttyggygggyggtygtggtygttgttygaaggyggttgttygtygggyggyggyggyggtaggyggygyggygggttgggygyggyggtggttaggtyggtgyggttgtagtttatgtatagygtgttagggttgttttgttygggtagtyggtygtagygtatgyggtygggttaggygaagtygtattggygtatgagyggygygtagtyggttttggygygttygtatatygagyggtagggyggtagyggttttttgtagttttttaggtagatgggygtgtatatgttgtataggaagaatttgagatygggygagtattggatttttattagyggttagaattggtgtatttttaggttygtttygttttgygtgtygtggttgaattgattgggtatgtaggtgtagttgtagtygatgtttttatatagyggtayggtgattttttggtatgttagttttttggtygaggyggtygtagygtygttagagygttgtagtagygttaaggyggttagtagygaggttatttttaataggtaattttattttatgttgtgygtttyggttyggtgttttygttttttaggyggygygtagaggggtgtyggggggggggtttaygagagagtygtagaygggtatagygggtgatttggggttttttttatgtttygttygggaggggggtttgtygataatttaattttttttaggggygygttygtagyggygyggttygtagtttgggtagggttttttygtattttttttygtygtttygggggtttgaaggyggttgtaggygygygttatagttygtaggttygttttgttggtttygggtygygtttagttttygyggygtagagyggtygggtttyggtttatygtttygygttygttygtttttttttygygygttygattattttttttygtygygtygggyggyggtgatttygtyggatagagagggyggaggygtygtaagttttttttggggtygyggtgygtagttaagatggttgggtygggtygtttgtygygtygggttagttttggyggttattattyggttttygggggtttatgttygtttttaaggttaagtygtygtygtygtygtyggagttggggattygtttyggtttaggtygtygtttttttttttyggygttygtttttygttygttygtygtygggatagayggattttygtygtttggaaaagttagygtygygtttyggtygtagtygggygaggtgtatatagttttttttttgttggatatttaggagtaaatttagatyggaaggyggagyggatatttgagtggygyggttygygtttagtygtygtttttttttyggygggagtagygtttttagtttaatttttyggttttagtttygttygygtygygttgtyggtttatgaatatttatatagygyggattyggttttygtttttagtttygygagttaatygtygggyggtagggyggagtttaygygtttttagggtttagttttttttaaggtagttttygagtgttygtattgttgtgygygttttttgyggatggagagttttggtaattttgggattgatygtagagatagagtgttggttatggttgtttttatggygttgagtgygtyggaggttttggtttttttatttygagtttgtttttggggatagggayggggtttggtgtagygygygttttttyggygygttttaaattagttaagtttttgttgttatttttygtaaatgtgggtgatttgtaggyggttggggtttygtgtttttyggggyggtaggaaggtttygtagtaggygagygtyggggaggtttgtyggggttyggygttgtagaagattygggaaagggtgttttttttggggtttttagaaygatggtttttgagatttggagatgtggggggtgtggagttattttaaattggggttggattygggayggttygggtgagatgtttyggagtttagttttgggygygygaggggygygggggataaatgttygttagagatttttttttygttttygttgyg

SEQ ID NO: 11087 - DNA, 1381 bp, synthetic construct
  misc_feature 1..1381: note = Description of Artificial Sequence: Synthetic polynucleotide
  source 1..1381: mol_type = other DNA
tygyggtagygttagttgtatttttttttaaaaatyggaggaaggagtttgggggttaggtyggggyggtttgtaggtgtgaatatttyggaagtttttggygttttggtttttaagagtatatttgyggttgtttaygggttttaygttttgygatagttatttygtggtttygggggttttaagggyggtttttygtatyggggttttaggtagyggaatttttttttagggtttatttataaagygtggtgtygtagagttttttayggaggggttttagtttggagttygggtatygtttatttttaattygtygttagtttyggattttttygygtttgtttygtattayggagtygggtttttagagtagtaaggttattaggtggyggtgttggygtagtaggyggagygtygggtgygyggggtygygtttttggttttygaaggtgatgaagatgggtttgygggtgagttttagtagtyggtataggttttttttgyggggygggatygttaggggggtgggtgttaygttggggtttatttaatttygygygggatttatyggaagttgtggttgtattaggttyggtttaggaaggygttygaaagtattaygatgaggygtyggtagyggtttaggtttattaagaggtyggyggagggttttgygggagggygggygtyggyggygtaggggygggggygggggagggyggggtyggaggtttaggggyggtgtyggaygtagagttttaagggaggggyggggtttgyggggtgggygggtttttgaggyggggtttygggtgggyggggatgggggyggagttygatggtgggggtggggtttygggtgggayggagtatggggyggggyggggygggtttttygggtgggyggggtayggggtggggttygggatattagygygyggtaggaggtygyggtygtttaggaagagtttgtagtttygaygtygttttagttgyggttttaggatgaagtttaygaatttgyggttttyggggtagtygttgtaggagaygtaggygtygtagagtttttygtttgyggayggyggttagttatttygatggttttygaggttttatattagttttyggggtttttaatatttttaattattttttaygtgtataggggtagattygtttyggattttaattttagtygggtygtatagagtattygggggttaattttttttygtygtaygtttttaaagtygagtttagtagygtatttttagggaggtygtggygattttttttygygtttaygygggttttaygtatygtttatttttatttttttataygygttttggtattagagtagtaygttgagayg

SEQ ID NO: 11088 - DNA, 493 bp, synthetic construct
  misc_feature 1..493: note = Description of Artificial Sequence: Synthetic polynucleotide
  source 1..493: mol_type = other DNA
tyggattygggggaaatggggtattaayggttgggttttaggagatattyggaggggttygygggttyggttyggttttttygttggggggttattagtyggtyggtagygagatatttagaggttygtttttttatygygttgttatagtaayggtttggtyggttgygtttygggtygttygttttatttygygggttygttttgagttagtgattttagggattatttatygyggtyggyggattggygggttttygataggtgygtatattyggygtaggttgtygttgagttyggaattttgtatygggagaaattttttagttygtagagtaatygtagggtagtggaygggggtygygygaggataaatagyggyggygggtgtaaagttttttttttaagtygyggggttggtygggaggtgtyggttgtataayggygtttaygtgatttaggtgtagttttaggygygtttaagggtagttyg

SEQ ID NO: 11089 - DNA, 922 bp, synthetic construct
  misc_feature 1..922: note = Description of Artificial Sequence: Synthetic polynucleotide
  source 1..922: mol_type = other DNA
tygygggygttttgtagggatggagattgagagaggttagggattyggtttttttgggaaaaygygygggygttttagtttttygttttgyggtattttatttgttttygaggattatygttaagaagaggtttygtygtgttattgatattttatttygttttttttygygaggtgttttygagttttygaggaygyggaaygtyggggtttttygtygggtaagtattagtatttagatttygtaygtagttttgtatttttaygttttttagggaaygtyggttygttygttttygggatttttygttttttaagttaaggttttttaagtttagtgttygygygttattttttttttygattttgyggygggatttttattttygtattttttygyggggttggttaagtttttagattttttgygttgtagtyggttyggaaagttatttttaggttattttttygygygygygyggyggyggttayggtggyggyggttgygattygaaygggtttttttatgtatygygtagggtagaggagggagyggygtttygtaygtyggggttggggygttgggtagggygggygggygtggggtttygggttttttygtatttagtygygygagtygggttttygggtttaggggaggggagttgaggggyggagttatyggggygygttttygyggttgygttttttttygtyggggagygygggtaygtaattyggagggtgttgggtyggttyggagtaygygagtagygggaggagggatyggggaatgattgayggaggygggtygtagaggtygttgtgtttygtyggttygtattyggtyggagtgtgygygygtagtttgttagattagyggygggggtaygggtygtattaagtgayggaggggggtayg

SEQ ID NO: 11090 - DNA, 719 bp, synthetic construct
  misc_feature 1..719: note = Description of Artificial Sequence: Synthetic polynucleotide
  source 1..719: mol_type = other DNA
tygtttttttggtatttayggygtttttgtttgtttttgttygggtttyggaggygygaatattattttaagtttgygatygygyggtattattttygttttttttttttttttatttygttttttttatttttttygggagtttttgggagtygggtygtygtgtgygtaagygtgtttagtttttttttygtttttaattygggttygggttttygttttttttgtaggyggattygttygtttttaggtyggattygygttygggatagggattyggtygagtygagtygtygygttagygttgygtygtyggtyggtgygtttagyggatyggagttgygygyggaatygtgttgtttygtttygttttattygtgagggtgagtaygyggyggyggtgygygggggtttgyggggyggggyggggyggggagtygyggggttttyggtygtttgattttagtyggygtygygtttttyggagggggtygggttttgtaygtgggygtagygygggtyggggtggggttgttatagttttgyggagttgtttttyggggtttttttttttggattagattttygygggaagtyggatttttttygtttttttggagtgagtaagygggatagttttgyggaaagttttygtttttaattttttagttttgygttyggattgaagyggyggtttttatttttagtattttygagyg

SEQ ID NO: 11091 - DNA, 958 bp, synthetic construct
  misc_feature 1..958: note = Description of Artificial Sequence: Synthetic polynucleotide
  source 1..958: mol_type = other DNA
tygygttgttagtatttygtatagttygttygaaatattagggaaggggttygtaggtgtgggggtggggtggygaggttaggtagtttggygygagggagagagtygaggtttgggttaggaaggtttttgggtgtygtgtgggygtagagtttaggagagygtattgttaggttyggattttttygtttttatttygggaagaggttygttygtygtagggggaaggygggattatagtatttyggaggagyggtyggttygggtatgygggyggyggggyggggagggaggttttyggaatttygagagagtattygtgtttygygggtttygtgtttygttttygggtttttttttttttaaygtaggggatttagttyggggtagtgtygggtattggygttggygtttygtttagttttgygattttttttygtttygttttttttygtttygtttygttttttttygtttygttttygggtygtttygtttygtaggttygttattttygggtaggtttygttttttgttttygttggyggyggyggyggyggyggtgtyggagygygagtagagyggagatttttaggttttgygggygyggtgagtgyggttygggyggygggyggygaggygggtttygagagygtgyggagtygygyggttttgagtyggygtygggygggttgggtatttttaggtygagattygagaagggggagyggtygggggygtttaygggaggtagtgtgggtagggyggyggtgggaygagaggaygaggaatagagtaggygtygtgygggaagygggtygggaaggggagggtgggtgyggggttygggtatygagygaagtggggttttttaggggatggtttygaggaagatygttttagaaagggagtaattyggggtyggtaagggttttygattgtgtgatttygtgtatyg

SEQ ID NO: 11092 - DNA, 3843 bp, synthetic construct
  misc_feature 1..3843: note = Description of Artificial Sequence: Synthetic polynucleotide
  source 1..3843: mol_type = other DNA
tygtaattttgaygagaagggttttttygttgaaagtttaattgtagagygttyggagygygttgtgagttygtaggaaygyggtygggtyggggaygggagaaaggygyggtygggattttgtattgtgtygygyggygtttgyggttggaatttggtttggaaygyggttttttyggttttagtttttygtttaggtttygtttattyggtygtttygttggttygtatygttgtttyggttatygaggagtttaaagttggyggygtttygyggatttyggyggagagygygagggagtygyggtygatttttgtattaygaagataattggaggtyggygggggaggygggttaygaggggttggggygagggagttgggatgygygggttyggttygtygggaaataggttgtygyggagtttygttttttttttttttgyggttttygtygygatttgattttygttttgttyggggagttaatttagtygttttyggggygttttttttttttttggatttttayggttggattagagtttttttggtagtygggttaaaggtttttttagtaaggttaaggygyggtyggttggtatttggggatttttttttagtygagtattggttttttaatygtattgttaaggattatggtagyggtaggaaattygaagggttttataggtttgygggagggaggatttattttatagtaaggaatagatttagatagatyggggattttagtgggaggggaygagaggttttaggaygttggaatgtggtaaaaataaaatattttttatttatgtatattattattttttgattgygggttggggggaagggagtttagggttaatgtgttttagattttagygttttttayggttgtgttagggttggggtggtttatttttttatagaygaaaattaagatttaaaagtatatttttattgtggtttttttattaaagtttattaaygtgatatataggttgyggygttggagggaagyggygaaayggggagaataaaygtaatagaagtaaattgttgtttgtagaggygagaggygaaggaayggaagttatattygattttagttttatttygtttttattagygtygggttagygtaggaaattaggaataggtgtaggtaagggtggtagttyggtagagttagygttttattttttttaatttttygttagygtgggtttggatggttgggttgtttgggtatttttaagggggattaggtatygygggtaggtttttaaataygtgaagggtatagggtttgaaagataaggaggggygtttaggaagggyggaaaagaggggttttggggttttttaggatattaagttagtttttgaaaayggygttttttggaaggttttttaatattttygagggaagatttggagttttgaagatttaatgaaattttagttttgattgattttttttttgygattaatttyggatgtttttatttagtttttgtttyggtaatyggttttttggggatagtagtattagtattygaygtttatygtataagtgggygtygtggtgygaggygtattttagttatttaggtyggggtgggggygtttyggtatttatattttttaagtaggtaaatttttaggtttgtttttygagaatygggagttygtattatagtttygggtaattatygaggtagtttatgtaattgttygygatgtygtttagtagatttttttttttattyggttttagagtttagtatatgggtatttttttttttttattttttatttyggygattggaatttygagtttgttttattatygttttttataaagtagyggggtgatttygtgtgttataaatattaagttagtatgtaggtttaggtaaaattttggttgtttttttgygttttttttattgygtygatggtttatagataattgtatttttataaattttttttttayggttagggggtgggagggagttagagatygggtgggggtttggygyggtattgttgagggttttgtatttaattgagtagtaatatatttatttatatggaygygggtgtataaatygttttaatattttgttttgaaagyggagttaatttttaaagttaaggattaygtagttgaatttttagtattttttaatttygtttaggygggggtaggtagagaaggggygggtagygggtagttaattygttygattttttygttaagaaggatttattaggtgaatttttygttttttatttaagtagttggttgtgtatttttyggttgygtgtgtgtgtttatatatatatatatatatatatatatatgtygttttattattttttagtttgtttttttaatgtaaygatygtatttaaaaatggtaattaaaatgattgaggagttyggtgattatattttaatttagagtatatttttygaagttgggggtgagagtagttatatagttatatttatattygggagttttttaagygtttatttggyggttgtagttttagttggtttttagaygaatattaatatygyggtygggygttyggtgaggagaggygggygtttygygggttgtagagggygaggagttggggtygtatttttaggatttgagttttaattatygttygtgyggggttgttgtagtyggtatttgtttygtagggtaggttgtagtygttgaagttyggygtygtttygygggtttttttagygttygaygggggtttggggygagttagtttgtagaggggttgtaggygatygggtyggggyggggaaygggattygggagaggtagaygaatttggggygygtygttttttttttattygttttttatttttttgtttttttttaatttttgtttttaggttttagttygyggygggtttygggggttgyggyggttttaggttttagaatagtttgttttttyggttattygygttttagtttttttttttttgggttaggggagtaagtaaatatttttyggagttttyggtagtygygtgagttattygaattttgttygggttagtagtgtagagggygatggagttggygaggygtygtygyggtttttaaggygttttttygtagagyggattaygtygttttatygtggttgtaggttgttatygtyggggaagyggygaggayggyggtagggaggtaaggygtygygtyggtggtttttttttttttyggyggygyggtttttttgtttygygagtygtagyggggygtttaggaaggagtaggttygggttttgygtttagttttagygagattaataatagttttygyggggagyggagttttagygagtttttagtygygygygtaygatyggttttygttttyggtygttttyggtyggygtttttgttagtattgttgttttatatgaaatagttgtaatttygaggtttttggggggttggggygggtgtgtgygygygygtgtgtgagtgtgtgtgtgtgtgtgtgtgtttaatagtttttttttttttttttttttttttgtttgttygtttgtttgttttygttttttattttygtttttttatatatagaaagagagggygagygagagagagatatatatatataygtataygtataygtaggttatatgaatgggaggyggtagttaattttaygaggtyggygagtygygyggygtattggygttgggagtagggtygtatttyggygygggggggygttaygtaggtgatgggygttttttygggggttaygygyg

SEQ ID NO: 11093 - DNA, 384 bp, synthetic construct
  misc_feature 1..384: note = Description of Artificial Sequence: Synthetic polynucleotide
  source 1..384: mol_type = other DNA
tyggaagtyggggggygggtttttatagttattgttygttattagttygttattgtgtttatatagggtgatttgatttygaggyggtggaggagggaataattttagagagtatattttgtyggttygtaggaygtttgtagtyggtaaatttttggtyggaayggtatagatygtattttygtaattyggttttygggttagattygtatgyggaygggtatygtaagggataaayggygaggyggaatttaayggaagtgaagaaaagattaaygggaaagaaggaygagtaygyggtttygggatagatttttaaagtttttttttgygttttttggyggtyggagggggagtagygyggataygtttttyggttaatyg

SEQ ID NO: 11094 - DNA, 1432 bp, synthetic construct
  misc_feature 1..1432: note = Description of Artificial Sequence: Synthetic polynucleotide
  source 1..1432: mol_type = other DNA
aygttttgygtttttagtyggggtttttttattyggygtyggygygtagtatgtygggagttgtagttttygygaggtaagtttygtttygtttttgtttgggggaggaggttggagagtygttttgtyggtttttgaattttgtygygaaaagygygygtggyggttttyggtttygtttttygtaggaygyggtgtygygttattttggtaatygttttttagtygtygttgattgggttgggtygyggggggygggygggggaygagaygygggggttgttgtyggygttygygtttgttagtygggttagagyggagtagygggtaggattgtttggtyggttgtttygyggagaggttgygygygtyggtygggggaggyggatagtygggttyggygtttgtggggygyggygygyggtattygggtttgagattaggygaggygtyggygygygttagayggygygaggttgyggtttygggagttttygygygtygttyggggttatgggygygtgagagtttagygygygyggtttttgttgyggtttgygagttygtatattyggtgtatagtttttygggtygttttygtgttygttttgygttattgggatyggttgttttttagygtygaggttttygaggttgtattygagtttgygtygttygttgtygtygtygtygtygttgtygtygtygttgttygtyggttttttttttttttatattyggggtttagagtaggaggaggaggggtyggtgtattttygtygttgttttttgtaatttgtaggggtyggtgtatgttyggygaggagtyggggtygttgygggtgygtgtaattttygaaggagataatttttttatttyggggygaattygggggttgtaagtygygggygggygggygagygagaggaagtaataaagataggttgtagttggggttggygaaaggggtygyggtygtygggtttttagygygggyggagagggygttttgggagyggygygggtygagttgtagttttgagyggggtttygaggggaggygtagygtygttygtyggaygtggygattaygggtttyggygaagatgygtygtttgagygttygygyggttttygttyggggygggygtgatttttgttgaayggagattttttttttttttygatttyggayggygtaggtyggygttaggatagtttttatygatagygtttttttttattyggagagaggtatygatttttaaggagggtttygttaggtagtttttgttatttttgtatggttgygattygtygagyggagygtygtggtagttgagatttggtgtttttygayggtttggttgattyggtgagttgtgyggggyggggttttgygttggagttgggggtattttttggygttyg

SEQ ID NO: 11095 - DNA, 325 bp, synthetic construct
  misc_feature 1..325: note = Description of Artificial Sequence: Synthetic polynucleotide
  source 1..325: mol_type = other DNA
aygttagygaaggtygtttyggygtattttagataatgagygtagtgtgtaggagygaggggttggtagaggttaggaagtttttggggttaggygyggttttttatttttaygttagataaagagygyggggtttggggagttggyggttttttygttatttggggygtttggggggttttggggygggggaggygggggttttgtttaatttygttattgttattatyggttaggtygyggtttggtaattygtgaataggaggtagggttgtagggygtgagggatgatgataaggaagtyggaggagtagyggyggtagyg

SEQ ID NO: 11096 - DNA, 1242 bp, synthetic construct
  misc_feature 1..1242: note = Description of Artificial Sequence: Synthetic polynucleotide
  source 1..1242: mol_type = other DNA
tyggttttggtttygtttygtaygygttggtgttatagttgtggtgtagaygttttttygttgygagggtgyggtygtttyggggygagtgtttttyggtttgtaggaggygaattygggttttttygggaggygttygtgggaaygygtatttgygagtttttgtyggttgaggagtygaggtttgygatttttgtygatttgagtttaggygtagtagygtagatttggtygtygtattttttttggttgggatgygggtttaygygggaaaggttgaaaggtggggaatatttyggyggaaaggaattttttttttttgttttgaaggaaagttttttaatatagttatgtttttggtggttttyggttttttatttttaagtttttagttagttttatatttattygttttagtagtygyggagtgggggtttttaaagaatttagttgtagagtaagttyggttgaygtagtgtgygttgggggyggggttttggaygggggyggagttayggygagagtygyggtgagggyggggttygggtgggyggtgttttgagyggggtttttagtgggyggggttttggggtggyggtygttgtygggttaygggagagygyggagttttgygttgggaggtgtayggtgtgtaygttggattggatttttatgtaatttygygttttgygttttaattaggattgtttygygygtttttgagtttygggtttyggttyggatttgtagttttttaggtggttgggaaggtaggtgygtygttgttttyggygygyggygtttygygaggtttttagttttygttttggtggattttygttgggtgggagtygggagtggaggyggtygttttagggagggaggagygtaggygggggttgtttaygggyggagtattgygyggygaagggaattttygaaggggttgatygggtttyggggtygtgataggyggygaggyggtgggaggggagygtgtgaatttaygtygggttttygygggygaygygagygaygygatttggatttttattygggatattgtaaatagatttgtttgtgaggtttaygattgggagtttgttattttgtttaagttygattyggtttyggygttygttygygttttgyggaggttttttgagttagygygyggttgtaggggtttyggggtygtatttyggattagygttagyggygggagagygttgtttgtgagyg

SEQ ID NO: 11097 - DNA, 1460 bp, synthetic construct
  misc_feature 1..1460: note = Description of Artificial Sequence: Synthetic polynucleotide
  source 1..1460: mol_type = other DNA
tyggggtagtygagttatttttttaaagtygattttygggagagatttttagttggaygtttttygttttttaggagygatggttgtaattatttygttygtttttayggggygtttttttaatttttyggttggttttttttttygtagggtttttttyggtttatygttttttttttgyggttttttyggttttttaggtyggatygaggttagygtttgatttttttggtttttagtttgtttttttagtgtttaagagygagaatatygttttygtttatatgtaaaggtygggygtagtaaatgaagtgggaaaagagaaaaatagataaatygttgtggtataaaagatttttttttygttygttttgttttgtagttygggtttagtaggagagggttggggagaattggataaaygttttggaatttataaaggtyggtggtgtygggggtygtaaagggagtgaagaattgaagtagtgagttggataaattyggggtaaagtattaaataatatggatattttggtaaygygtgygygtgtgggtgggyggataaaaggatttattattygtatgattgttttaattttttattttttttgtgtaygtgtgtggaygttgttttaggttygagttygtttttygtttaggaygtatagtttygggtygtggttttygygygttyggttgtgygtttygggtttttggttygygyggtagttatagtttggyggggtttgygyggaggaggtyggttaggygtaggttgtygattttttttatttygtttagagtagtgygtagtttttgygyggaygggtagagtagtyggygygttagttygygyggtatygtygttyggtygttgaagygygyggygagtaygaaggggaaatygaagygygygyggtattgygygttgagttyggttagtygtagtygttygttygygtttaggttttttaggtttgygtygttttgttttygttgygattyggtygtgagygtgtttygttgtagttygttgttygttaggttygggtggtagygtaggatgtttttttggtttgyggagaagtatagatatyggygggagygygttaatygygttygtttygtatygygtattygagggggygygtaggtygygttyggtttttttgtttygtttygtttygttyggttttaaagaaggttgygggagggtgaagtagagtatttaggyggtgatgttttggyggaataggggygtttttggygygtttttttaataagttttggattttgygtttttyggtttttattatattyggtygggattaggatttaggggyggggygggaagtgataygtttgttttttgagattttgggttaagaagagyggaggagagagagggyggtygttgaggttyggaatttaygattaggtygggagggagtagagaygyg

SEQ ID NO: 11098 - DNA, 1064 bp, synthetic construct
  misc_feature 1..1064: note = Description of Artificial Sequence: Synthetic polynucleotide
  source 1..1064: mol_type = other DNA
tygygygattgaggygttagyggyggagttggayggtttgggaaggtttyggtttttyggttgyggttttagttyggayggygtygygtaattttgttatttttttggtttagtttyggttataggaggatttygygggtaaygygyggagtttttggtatttttyggyggtgttttttgttgtttgttyggggatygatttygtatgtttttaggttgatttgtttaagttygaatatygggattatgtatttagtygggattttygggttattttygygtyggataggtaattttattagtttttaattaggatygttatygtygtttyggttgttgttgttgttgttgttttttttgttattggtaagtygygtttyggtatagttygttgttttyggtagggygttgttgttttttggtttygygggggttgtaggggtttttgttgaggaggttatagtgttggygaatygyggatttygggtgtttttyggtygtgaagtttggttggattttttgtatgatttggtgttgtaggtgtagttyggggatygttgygyggtttyggtattagataaygaygtattggtttagygatygggtygtttgagttttaagygtttttygtgygattttggttttggygaggtgygttatttttatttgggygygygtagttygtttygggatygygttyggttgtagttgygttatgaygygttyggaggggtagtagtgttattattggtattggaggtggaggtggtttttatttagttggaggttgtgattyggaatttgtttttggtygtggaagagttgttggggattagtaatgttttggaygygyggagtttggagttygttttttagttygagatagaggagtgtygygtgggtattttgttyggtttgggygygttgtttygttatggagaatttttttattattygtaggtttttggaggagttagagagggaggygtttyggagatttttttgatggattgtaaagttttttaggaattaggygtgygttatygttatatagtygttagtyg

SEQ ID NO: 11099 - DNA, 622 bp, synthetic construct
  misc_feature 1..622: note = Description of Artificial Sequence: Synthetic polynucleotide
  source 1..622: mol_type = other DNA
tygttagttagayggtgtttttgtygtttttgtygttattygttgggtttygtttygttttaagygtattttyggttygtagggtgggaataygaggattatagtgttttaygggygggygggttaggatygtaatttyggyggagtyggygtttttgggtatttttggttttygygtttyggtygtayggtgattattygggaggggatttygggygtttygtaatttttyggttttygtgggttttygggtygtttygtttttygtygtygygtatttttygygtttttyggttttyggtgtyggttttygtttygygtagtttygagtttttagttyggtyggttttttattygtygagygtatttatggyggyggtttttagggtttttgygatttgtyggygggaygtgtttttggtaggtgttattttttygatttgaygtttaggttyggtttygttgttttaggtatagttttagttttgygaggyggggtygtyggttttattyggggggyggtgttgyggggagtagaggttygtgttttygagtygtygygygtggatattagtttyggtttaggtgygggtgggtttygaygggagygygtggtaggtyg

SEQ ID NO: 11100 - DNA, 1622 bp, synthetic construct
  misc_feature 1..1622: note = Description of Artificial Sequence: Synthetic polynucleotide
  source 1..1622: mol_type = other DNA
gygtttttaaaatygagtttatygttttttttttttgygtagtttttatttttttttgtgtttygtattttaataaaygttttygttaagtgattttagtttgaaatatgyggtttttyggatttttttttgtgttatygattttttgygtttagtttttyggagttgtyggtttaatttygtaagttttttyggaattygtgttttttttttgggtagygttattattaygagygtttatttgagaggaygtttgtttttatttagtttttattttgtagtygagtaattttygtaaaaygaatatttggtttagtttttgttggaaatygttgaatagtttttattgttttttggaagggtttgggtagttyggygtggygtttayggttttattaggtttttgttttttgtaggtttygttatttygttattaaagygttygtygygttygtatttgttgtgaggttgtgttygggtygttttygtygagggaayggtttttttaaggttttgygttttaattttygttygtttgttaagaggtagtygtgtyggggagttagagtttttyggggatttttttttgtttttygtggttttttgtggaattttygttttaggatttgtaygtygtttttagtygygygygyggtayggagatygttygttgtgtttygygttgygtttttttygtttttttttygygtaggtttttttgtgttagtyggttgtygatttaggttaggaagttygaggtyggggygttattttaagggttttttygtttttttttygagggtagagaggygttygygttyggaygtattgygggaatatttggagygtyggyggagttyggttgttttygygggagggagttygaygygtatttttgggattyggattyggygttygygtttygggayggatttttgtttyggttgtaggygtagygygtagatttgagtttgtttygyggaatyggggttygagtttyggttygagygyggygtyggggttagyggagaggggyggaagtygtaagggattttyggygtttyggtttggtygygatgaagttttygtttttttttaggtgayggatygtygttgtygtttygggttgtttattatttyggygygtgttygggagtttttatttttttygggttttgtggtyggttaygygttttaggtaygygtygygtygggtygygttattaagttygttgtttttagtttttttyggtagattttttggttatttttattttgyggaggggtygtttattagatgttagaaaattagggtggggtaygtaggttaggggttttagyggttgggtatygtgtttttttygaatttggtgttggaagtgygttygttttygttttttttaggtatttatyggtattgtttagttttgtttggagggtttaggattgaaygtttgttttyggtttttattttggttgtagaggattggtygggtgatgtygygttgttttggttttgggttygtttggaagattygtttgtgtygygggttttttttttggttttggtttttaaagygttttyggtatagtttttyggtttttgtagttyggtggggtyg

SEQ ID NO: 11101 - DNA, 324 bp, synthetic construct
  misc_feature 1..324: note = Description of Artificial Sequence: Synthetic polynucleotide
  source 1..324: mol_type = other DNA
aygtgggttyggagtagggggyggygttygygtttgattyggtttgtyggttgtttgtygttygygtaggagttggtygggygtygtttgtaggttgtttygggtygagtyggagygaygttgtygygtatttgggtagttttygggggtygygttgtgttayggtyggggtygttgygattgyggygtttgtatttgttaygtgattgagtygggtatgtttttygggtttttgtgtgagtgttatgagtgggtgtgygagatttaygaygggagtatttgtgtaggtaagagggyggygttgttttttttttygggaggtyg

SEQ ID NO: 11102 - DNA, 1881 bp, synthetic construct
  misc_feature 1..1881: note = Description of Artificial Sequence: Synthetic polynucleotide
  source 1..1881: mol_type = other DNA
tyggggttttttagtttygtyggggygtttgtttttyggttgagttygttygtagygyggttttyggttattggygaggttgtgyggaattagaaggtygatygygttygggtatttttygygygtttttgattttagttyggtttttyggaagtygtttgggygatttygyggtttaatattyggttttgygaaatygttygygttttyggttyggtttggagggtttygtattattygygygygygygygttygtataggattyggttaataggygtygggatttttggagttygttttgttagaaatttgttaygygygtygtygtatatgygttttaggttttttyggaygtaggygttatygatttygttttygtttygygtttttyggttgtttygtygygatttygggtygygagygttgtygtataggygttttaggtttttyggggtataggygtygtygatttygttttygtttygygatttyggtaygttttaygtttttygtattttagattygtttttttygatttttattggatagtyggggaaaatggygttttaaagygttygtatttattttgtygaaatgygyggtttagtgtaygggygtttagttatagaaggagtttttagaggttaggtgggygtggggtgtttgttgtagtagygagtagagygtggttaggttttygtygyggtaggygyggtgtagygggaaayggagygagagtagtttttygttggagaagttygtttttaygttygygttygttttygtygtygatatggttygttatyggagagygyggggttygttggtttagaggaygygtyggggaggattygagaagtygtygtygtagtataaaggaaygagattagygtygyggtygygttttataggttgtygagyggagygygtatagagggggyggggyggggtttggagyggtygggttgggggyggggtttggtttagaggaygttttgtgtagtygggtaggggtyggggtttggagtygyggatttttggagtygtygggtagggggyggggtttgagtyggaggtygtttggagtagtygggyggagggyggggtttggagttgyggaygtttggagyggtyggtaggtggyggggtttagtttagaggatgtttggagtagtygggtagggagyggagtttggattagaggaygttagtagtagtygattaggaggyggggtatggggttgtygaygtttggagtagtygggtattgggtttgggttagaggaygtttggggyggtgggygtttggagtagttaggtagagggyggggtttggtttgggtttaygtttggggyggtygggggyggggtttggttggaattgaygygtggagtttyggtggagggggyggggtttggttgggtygttgtttatagyggttttyggggtttggaggttayggggttyggaggttayggggttyggaggttayggggttggttgtgtggggggtttaggggygtagagtggttaagtagyggtttgagygggtttyggggttttyggygyggtgggtttyggttgygtttygggtgyggattatgatgtttttagtttgggagtyggttygggyggggaatttyggttgtygggggygygggttgaggttttgygggttygygtttagagygggtgggagttaygggtttttyggaggtttagtagygygyggtgaagttgtttagtaaaaatttatggagygtttayggggagtagggattttygttaaaatttgggaattagtaagttttagttttttatagagtaggatagatttttyggttttgttygagggaygtttttttyggaatygagtgyg

SEQ ID NO: 11103 - DNA, 944 bp, synthetic construct
  misc_feature 1..944: note = Description of Artificial Sequence: Synthetic polynucleotide
  source 1..944: mol_type = other DNA
tygygtggggtttagggaggygygggttgygggggattgygtaaggtyggggtttttggaggtygaggtygyggtgtttttygygaggttattatgagttgagtgtttttggtaggygtttagggatttttygttttttttttttygyggtttyggygggygtyggttagatygtttygttttttygttagttyggaaygttttgtattttttttttyggttgttyggygttygttagyggttagaaattttygtttygttttatgtaatyggggatttygygttttygttgtygtttygttttyggtttagaggaygggtttggggggagggggygtgtggygaygttgttatttattagggtttagtygtygttttttygagttgggtyggtgtttygygyggttttgtagttttgtagygttyggggyggtgtaggagtttyggggtgtygyggygttygttyggttgtatygttggtttttyggttygggttttaggttyggygttttttatttttaggtygygygygtttygttttttygaygatttttagtttygggttttygttatttaygagttttygttttyggtgagttgttgtttttagggtttygagtygygyggtattttttgyggttygaggyggattttttgtagttttttgattatttgttygtatttttygttttttatggagtttaggtygttgtygtggyggtygtttagtagtygttttttttttagttygtygygggggttttttatggtttatttttgggggygttyggtygtttggaatatggygyggaygagttgygggygttgttgygggtgygttgggtygygggttgygygttgttttttygttggggygttggygggygggayggyggtayggattgttgtgggttttgtagygtygtygyggygttttataaayg

SEQ ID NO: 11104 - DNA, 1514 bp, synthetic construct
  misc_feature 1..1514: note = Description of Artificial Sequence: Synthetic polynucleotide
  source 1..1514: mol_type = other DNA
tyggyggygttttttttatttagygtgaaatttaygaggygyggygtttygagtggygggygggtagggggttgtaggatttaygaagttattttygtyggggatygttttttttyggagtggtttttttttyggygtttygttttagtaagaygatatttaggttaaatagtygttttyggttagttygattyggttttggagggagygtttygagggagtttagtyggaggyggagaaggttattyggttagaaggtggggagtygtyggygttttttygtattttygtttttatagtagggggaaaggttttgatygtygtggtttatattatygygtttatttgaggttygtttygttttttgggtttttagaggggtggygtatttygtttttttttgtttttaagtggtygtattttttygygggaygtttggttgggtttagggyggggygggygggygtttttygtattgtygygagtttagygygtagttttygyggttyggttgtygtygyggttagttggggygggtygggggyggggttttagggggyggggattygggggggygggtygggtygggaggygtgggtggggggyggggyggaygyggagygtttttttggttggyggggttaaggggttgagaggagtggggtaggttyggygtyggtaggaagagttagaggggtgattagagagtttaaygtttggtgtttaagatttttttygaggtatgaataagaattaggygtttgggtttttttygttygttttatygtttagtygtygygtttyggaygttygttgtgttttttgtyggyggggyggyggygggattgggtttygggagggtttttggaagtygygagttttagygaaggtagtgtatygtttttygttttttttttygtttttttttygtttttttagttttgggtgtygggtatyggtggtaaggtygttttttygtgagtyggaggtygtttattttgggaygggyggaygaggttttagggtagtygagttyggtagygggggaggygtggagttyggggyggttttagyggygggggygggaggttggttttggttgtagattgygygtttgggtttygtgygyggtttttggttttttgtatygyggaggttttyggattatagggttttttggygggtttyggtatttaggtttgtgtygttgtggttgggygtygggattagtattygagtttygygttttygggggttgygtygtgtygtttgttgtgygygygtagaggtyggatagttyggttgygggaagggattygagygtagggtttgtttygygtttyggaaagtgtttagtttgyggagtyggaggttgagttggggtagatyggygttagaygggggtttgggtgagataygagttgggggtgyggtttgtagaatttgggtttttggaggagtttayggygygttggyggagttttaggygaataggagtatyggattyggtttyg

SEQ ID NO: 11105 - DNA, 2144 bp, synthetic construct
  misc_feature 1..2144: note = Description of Artificial Sequence: Synthetic polynucleotide
  source 1..2144: mol_type = other DNA
gygtygtttttttttygygtttttygaatgttaagtgtattagtttttaattttttttttgggygggttyggtttggttaattttagttgtagattttagtataaatttaggattttttttygtttagtygtttttatataaggattygtygaatatattttgaatttygygttagagygtagttyggaattgtagttygyggygygggtttaggtygggggtygygygtttttagtyggtgatttaaggtygttyggttygggggtgggtgtgggtyggtaggatygattagggtygygygggggtagttgtygggygttyggttatttagyggtgggagtygaggttggttttggttagtygttatttygtygygggygtttgtttygtygggttttygggygygggaggaaggttygygtygttttttattyggygygttttttttttagtgygtagtggtttggtgggttagtyggyggyggttggagygyggggtyggttttgygtaygaatgaatgggygttygggggaygygygygttyggggttgaagggtattaggatygtgaggatygtttygygattttgtttttttttattattttttygtttttttattttttttttttttttgttttgtaggattgagtagttaggygygagygaaaataaatagttggggttgygagygttttygtttyggtttygagagtaygtyggtttagttttttatttggggygttygtttgtttattatgaggaagattygygttaatgttatygttattttgatygtagtttggattttgggtattttttattatttatggtaggataatygagtttaygtagtatttttyggyggtyggggygygtagagggtaggtaggaggtyggagtagtttygygaggatygtattatttygtttattgtgagtaygtttygagygtyggtyggtyggttagggagtygyggygygygtttagattttgygyggyggtygagggygyggggttyggttagggttgagtgttygttgygtygggtyggttttgtatatgttggagtatttttgttygttgttatggtaatttttgtygggyggyggggttggggygtatygattaagggagggtgatagagggtgggggttgggagaaagtgttgtaagtttggtgggttyggygtgygygygyggttgggaaygtggyggttttttyggttttgygttgtyggggtygggagtttgggggttgygggagtttygtgtgtttyggaaggttgtygggtttagygygyggygagygggyggtgggaattattygtagtygagygygtaggtggtagtgygtagtttttttttagttttttgggggtagaggatatygggtgggggygtgggtaggggaaggttttttaggygttgygtttggtttygaatttttttttgagtygggttaatttgaattygttttttyggygyggatatttagttttttyggagttttttgggttgaggagaggtttygtattgtaygygttttttatttttaattttagggttygttattaygggtaggtgggtagtgttagygttygaatttggygatatttttgtatgaagttagtttygygatatttaagygggtagggaaataaaggtagtgtggtatagygggggyggyggyggggttgygggggtttttggygttttggggattygggygggggygtgyggagtygtagtygttttgtagggggygattttgtygtygttttygttygagttttaggtgatagagttgtgygtggttaggtaggggtatttgttgaggygggaggttttggtattygtygagagtgygttygagygggygtatttttttagaygggggyggttggtggaygagagtttyggaygattttygggaattattagggyggggtagtttggtyggatgaggattaggaagaggagagtygagtggggygggggtaaaggagtgaggaagygtggygatttygataaggaaagatttgggtttgggggtggaggggtgaggagattygygggggaggtgtaaggttyggagggttgaggtttgtgtggagtygaattygagaaaygtatttagaygyg

SEQ ID NO: 11106 - DNA, 379 bp, synthetic construct
  misc_feature 1..379: note = Description of Artificial Sequence: Synthetic polynucleotide
  source 1..379: mol_type = other DNA
tygttyggyggggygtttttaygttgtgttttttgyggtgtatygaggygtattyggttgttttgttgygggttttttggttatttgtgggttatagggagagaygygtttatatattttygttygygtttaggatagttgygggagtttygggtygttttaatttaatgygtttttygtaggttgagatgyggttgtttttgttygtgtygttgttgttggttttagygttygggttttyggtgagtgyggttttgtttyggttttyggaggaatttgtaggggagtygggggyggggaygygygggttygtaggtaaygtttttaggaaaggggygatgttagggaagttgggttgggaggaggygagttygtatyg

SEQ ID NO: 11107 - DNA, 637 bp, synthetic construct
  misc_feature 1..637: note = Description of Artificial Sequence: Synthetic polynucleotide
  source 1..637: mol_type = other DNA
tygyggtaygggagtgygtaygygygtyggaggygaaggaggaatttatygtatttatagggyggtygagtgagggagttgttggygggtgggtttggtaattttttgggaggtygaygygggyggatyggygggtgttgggaatygagtttyggtttgyggtyggtagttttygtgggtttgtgaagaggtyggyggtttttgygggygttagttaggtaagtttagttyggtgttttttaggaagttygtttgygggygygggtagggagtygtatyggttatggtggttgaggagggagaggttgttgttygtyggtygttygattttaggttttttttygaygggttygtttyggggagtaggggtgygygggggttgtttttgygygaayggttygggygggggaygtggggygygttgggygtygttygtyggtttaggygygygaatttggygtttttagtgaattattygyggttygggygttygggttygggatyggtttttttttttttygttgagtygyggtygagttggttttttgtattttatttagygtygtygggaygygattatatygagatggtatygagttttttttaaaggtttyggtttgttgaaagtggggyggyg

SEQ ID NO: 11108 - DNA, 959 bp, synthetic construct
  misc_feature 1..959: note = Description of Artificial Sequence: Synthetic polynucleotide
  source 1..959: mol_type = other DNA
tygygggatyggggggatggtygatttttagataygggagggattgagygatgtttaaggagagtaggagaatattgygtttggagatttttgagagttaggggygggtygttttttaaagggatttyggagtttygatttttagttttagttttttttgtgatattatttttyggatagagatttaagttttaggttyggtttygtttagaggttttagggagaagattaggttatygtttattgttyggygtyggggaggaaagaggaggagtttttgtgtgtttatatttttggtygtttagggtagttyggttyggtttygtaattttagtttattggttygggagattttaaaggttttatygttagygtttttagygtttattgtgtgygttttattttagttttgtttgygygtygttttygttattttygttttagtttttgggtyggaagtttttttttttttttygtygtagtttttttttagttttttttttttygtygatgygggaaatttttttygtttygtttygttttttttttttagttgtattttygttyggttttttygtttagtttttaatttaggtttygtttttttttatttatttttygttttgggtygggttttyggttttatygtttttttttyggtttygtttyggttttyggaagttttatttygttttyggtttygttttttygaagttttttgggttttyggtagtyggygggatagaaygyggagagtygtygtttggtygggygtagaygyggtggtagagttygygyggygttggaagygagtggyggagyggygggatttyggyggattygttatggaggaggaggtgagggyggggttyggyggggygttgggttggggttttygagttttttayggggattgyggttttgggtttaggttttygtttttgttygttttattttyg

SEQ ID NO: 11109 - DNA, 826 bp, synthetic construct
  misc_feature 1..826: note = Description of Artificial Sequence: Synthetic polynucleotide
  source 1..826: mol_type = other DNA
tyggtygttagttttgggagtttyggttgggygaygaagttgygggttggggtatyggttgtttttaygggtyggttttgatttaggggttyggttyggagttgttttttyggyggyggggttgatttaattttttttgttygaggagttgtygygygtagttagygtttygaattygygygyggttyggygttttttyggggtttatttttygggttagtygtygygtttatttgtgttygyggttyggttttttttygttygygttgttttagtyggggttgaggtatygggtygggttttyggygtttygagttttygttttttttttttygttttttaattygtttaygttttyggttttttggatggygaygyggatttgtatygtygttttgggttygggtygagttttttygtyggattgggttatggttygygggattgyggygtygtyggggtttttaygtygtaaggtttagttagtyggtyggtagygattgygaygagggggygggggyggtgygagygygtttgtygttyggtttaggggagggataggggtygyggygtttygtttygygtygtygtygtygtygtygtygtygttattatttygatygttagtggagygttygygtaggyggggtttyggaggtggagggyggtttttyggagttttttygayggaggttygtttyggaaggattttygygattttygattatttttttygttttttygtygttgtggggttttagttygagaggaggtgttagggttttttttttttgygtttttttttayggygtygtagggatgggyg

SEQ ID NO: 11110 - DNA, 2156 bp, synthetic construct
  misc_feature 1..2156: note = Description of Artificial Sequence: Synthetic polynucleotide
  source 1..2156: mol_type = other DNA
tyggtygatttgatttttttttgttygygttttayggttttttggttgtygaatatttttagggagaatttgttgatttygggttggagtatggtttygaattggygttgtatgaagtyggtttggtttaggygtatttyggttttygggaggatttggtygtyggtagtygygtttttttttattttgatagyggtgtttatygagggttgttygtaggaggyggaggtyggttgyggtggttgttggggyggyggyggygaggttgygggttgygtygaggygtyggggygttygggttyggtygttaggtttgggggygttttgttttygtygggggaygygtygttttyggygatgagtygtygttttttygyggagttatgtaggtgttygtgattgttgtygtttttygtgtygtygttgtygtygtttyggttgtttagygaggttaggttttygyggaagygtttgtagtygtygttygtgttggatttgttygygtygygggtyggtttttygttgttygttgtttygagggtygagtttygggatttygtgttattygyggtygtygagggggagggygagggtagtggtygtagtyggatgtttttgyggttggggttttggyggttttyggttttttttttttyggygttttttttttygtttatgatttaygttttggtttttatttgttgygggaggttgtagagtygtttgygtatggayggyggtagtttgtttatggygttaggggtyggggtyggatygggtygggggtaggagygyggygtygyggaygggttttaggttygttygtyggttagttygttygtggggaygygttttttgtygtyggygtgggggtagttttaggygtttatgtttgggtaggttgygygtygyggggaggattttagtttygtttygagttttygggttygtygygttatattttttttygggttyggttgggygyggggatttygygttttttttttgtttttttttttttttttggygtttaggggygyggygygtygttyggttttaggygtttygttttygyggggaataatgggygtyggtyggagaggttttgyggtygyggygtttagggaatygtttyggagtgtagagygtayggttygygygggtttygggygtgygtttygygggagggttggttgttygtttgtttygtygttygggttttgtggttggttattygygagttygtttygttttttttgtttyggttygttyggttygtttyggggttttygtygtaatygagyggagtttagygattygtygggtttatattagyggtygtttttttygaagygtttttyggtagygttygggttttygygtttyggaatatttatgaagtygtygtagttygygggttgttataggagyggttttagtagtygggtttgtttatttgggttttttaaaggggtagyggygtaygggtygggggttggaaaggggyggggggygggtttggtaaggggtttaggttagattttygttagattttyggggtyggggtgagaggtatttatattgttgygtttttaaattttttttttgggttaagttgggagtgygttttaagtttgaagtttyggttttagttgygaattttttattttaagattgaagggtggggggtggttttttaatttttttattattaagttttgggttygtttttttttggtatttttgttttttagttgggttttygattttttttttgggaggygatygggttygtttggatgtagagtttyggttttttygtaatttttttggagagggggttttyggaaatgygtygygtyggggaggtttttayggtttttttgtgatatgggtagggtgygaatttygygttagttttttttttgtaaagtttygtagtagttaggtaaggagggygtggggaaatagggagataygtatagggygygygggtgggatttagtttttygaggtaagatttygaggaaatgygtyggtaatagtgayggatgygagattygaaygtygattttygtaygygtttttttttyggtagtttygagaaagggataagtyggttgtagyggggagyggttgggtyggtttttyggayg

SEQ ID NO: 11111 - DNA, 1441 bp, synthetic construct
  misc_feature 1..1441: note = Description of Artificial Sequence: Synthetic polynucleotide
  source 1..1441: mol_type = other DNA
tyggagggaggaattatygtaagyggagatttygggyggyggtyggyggaagggttgggygggaggygtygggatgtyggtaggattttgygttygagggggtagggggttygtgtyggggttttaggygtagattgatggggtttaagtagggaatgtgagggyggggagggygtataayggaagggattaatttygyggtttygagttgggagtaaatttygttttttattttttttattygttttttttttttagtgaagayggtttgggggygggtggggaggygygttttyggagygttttygygtttttttttygtttttygygygygatttatygttttttttttttygaggttagygatggttygggtgygggygaggagttgggagggyggttttygaygtaggtgttagattygttyggtagtgttyggygygttggttyggtttttagttttttyggtygtygtttttygttygtygygtygyggygttaggagggyggggtyggggygygygtygttttttagtaagygggygggyggygttyggtttgagggagyggggyggttttygtyggygtygygygygttgtgtgtgagyggggtygygygygygygyggtaggygagtgagggaaygaggagyggtygggtgtgagtgtgtgggagtgagagtgtgtgggagtggggtgagggagaagttgaygggaygygaggttgtgagaaattgggygagtgtgygaggaygttyggttagtttgygggagtygtagtyggyggaggagaaaggaggyggttttyggtatttygattttttttttttttttttttttttttatttttagtygttyggyggttygygttttttygaaggttttagttyggtttagtyggtygagagygagggaggagtttttygatttaggtgagyggtaygatygttgttgttttygggtgtagagtagtgaggygaaggygygttttttygagtgggygagtttagyggaatggatttttygattagygggggttgggtyggggaggggatyggttygagygygttyggggttyggggttagttgaggtyggtggtygtygtttygyggagtyggtggggagygaggyggggttyggttttygygygtgtgtygggaggygtyggttygtggygtgtgygtgygatygggygagtygtgtygagggggyggygatttygggygtgtaaggagtatggttttttygtyggygagggggtgtggtaatttygggaaygtyggttggagtyggattygygggttgttgatttgttttygggattgyggygatatttttttttttttttttttttataaattttatggagygatygygggaggaggattaygtggtgyggtttygtagttattgtattygattttaygtttttttttttayg

SEQ ID NO: 11112 - DNA, 734 bp, synthetic construct
  misc_feature 1..734: note = Description of Artificial Sequence: Synthetic polynucleotide
  source 1..734: mol_type = other DNA
tygattttgggtatatagyggtaaattttgtttygtaatatygtgtgggttttygygtattttttygygtgagygtttygagttyggtgtagtttyggttttygygygtttttgtttttygtatagygttttygtttygaaggtgttttgataatttygtaggygttattyggagtyggggtagggtagttggggttggaggyggygggygygggayggagttttatgaaagttggaagaagtgattataaatygggattygattttygtagttttggygttygtttttttaygtaggttygggatgtyggttttagtttttagatgtygggaagayggygtyggttagtttaaggaagagtttttaggaggttggggagtaagggtgtygggttttttatgtygggttaggttttttaggagtgtyggtttttagggttattaggtttaggtttgygygaggagggagygygygtttttttttatttattyggttttygtttttaattygtttttyggtttatatttatttgtttggttgtaagygtygtttygggttaggtagttaggtttttatttttagtgyggygygtttygatgtygttatygggattttygttttttaaattagttttttttttattygtaatttygttygtyggggygttygggggyggaggygygagtyggtyggygtygyggagtyggttygtagatagggygggyggggttyg

SEQ ID NO: 11113 - DNA, 935 bp, synthetic construct
  misc_feature 1..935: note = Description of Artificial Sequence: Synthetic polynucleotide
  source 1..935: mol_type = other DNA
gygtgygattygygtttattgtggtttygttttattgatgatygtgaatttgtagggtgttgggttagttttttattttaaggttgggtaggttttyggagtttttttyggtttagatagaagtttttttaggagygggggaggggaagggggygygyggttyggttttaggtgtggtygyggataatgagattttggggatgggggygtatttgygttayggygtttygtagagggttttttaggagattttttygggttttygtygygtygtgggggtggggtagttttgttggttagagtygggtaygggtygggygggyggyggggatygtgatygyggttgygtgygttygygttygggygtttttgtgyggggttttggtaygtyggygggggygattygggtgtyggttygtgygggygataygygygtttttgyggggttgygyggggttyggagyggttgggggttttttgtygggygyggttgggygyggggggygttttyggtygggatgagtttatygtagtygygtyggggttgagygtygagyggggyggyggyggggygggyggyggtttttyggyggtttygyggygttygggtygygygtygttatgttgggtttggaygygtgygagttgggggygtagttgttggagttgtttyggttggygttgtgygttygaggtgagygggtygggtaggggyggggggttyggttggttttagtttygggyggggagtagtttttttttygyggtaattttgggggygygtatggggatttygyggygtygatttttyggttggggtttggtaggggtgggggattttatttaggttttagttttgtggggaagggattaggtgyggaygggtyggtttgggaagyggyggygttgggattttttttttttggatatygtyg

SEQ ID NO: 11114 - DNA, 1054 bp, synthetic construct
  misc_feature 1..1054: note = Description of Artificial Sequence: Synthetic polynucleotide
  source 1..1054: mol_type = other DNA
gygyggttttyggaggtygatattataaygtttgtaagggtyggttggggtyggtatatgattygattttayggtygtttttaggggtggaggggtygttattttaggtttggggaaggaataygaggttttgaggagygaatttgttttaggtgttyggggaggtttggygyggggttgtttyggtttttttttagagtyggggagaggggatatygtaggatgtyggygttygaggyggtagtattaggtttaygggygttttagtttaaatatttttygtgtttttagagyggggattttygttttttagattyggaagygtygtttttttygttagggaygtttgggttttygtagatttygtyggtyggygygttattygygttagtattatggatagyggtygttttagtygygygtttagggttaggttygggttggtttttatygyggayggttgyggggtyggggtagtttygtaattttaaatttyggtagttttygtttagtagggaggggtttygggggygaagagtgggggagaagtygggaaggattyggaggaggyggygggggyggygttaggggaggaataatttyggygtagtgtygatttaggttgaaaaygtttttagttatgggtttgtaygtggagygtyggggttgggggaggtattygyggggtttttttttygtttygttygggagtttaygtttgtyggygtttatagtttygtttttatttttaggttttagggtygagatggagaaattaagtygtattttgagagtttataggagggaggggataggttgaggagyggtygtttgggtatgggttyggggtttggttttttttatttatattygtagygttgttagaaggygttgttttgtttgtggttagttttygattygtgtgtttggtgggagttgtattttygtataggtagttttattgttttttaatttygygtttaygtttttgtyggttttygttgttttttatattttyggtttgattgatttagttygaatattttttatttyg

SEQ ID NO: 11115 - DNA, 1474 bp, synthetic construct
  misc_feature 1..1474: note = Description of Artificial Sequence: Synthetic polynucleotide
  source 1..1474: mol_type = other DNA
tyggaygttgtggtagaggaggttygygygtygtatatttgttgggatttttagttygtttaggattggtagggagattttggaagattagygttyggaggggtgaggtttygttttgggggtaaggtygygaaattayggtttgtagttttaygttaggggtataaagaaaagygtygtygggaatttaatatttgtagaygaygygtagtygtagaggaggyggggygttygaggtttygtttygtatgttaatgaagtatatattatatygtttygtttyggygygagatyggtttaaygttgyggagatttagaggtyggyggygttyggaaatattygyggaggtygaggtagggyggggtygggygtyggggtygggtygttgggygggyggtatagttygggggaggttaaygggtyggtygggygtttyggggaygygttttttttayggtgygaagtggtayggttygtaggggyggggtttaggttatgtgaygyggtygyggtygttattttgttttgyggtgttggtatttagagygtagyggttgaygggtyggatygttttygtygtygttygttygtaaattttygtgttyggttygttttygttttygttttygttatygtttyggtttgtagagtttgttttttttttattygtagatatgttygagtttaagagyggtttygagtatgtttygtttttygtygttatgggygtttyggtygttatggtttttagyggtgagygyggyggygggagggattygggggygggggygygygygttgtttatgttygtagttygtyggggttyggtgtgtgaygttattttgaygtaatttygagttgtygggggygttygggtttygtgtgatagygggygggggtyggygtttygagggttgyggggagtygtygggggttyggggygtagggygtgygggtttggtyggggtgtgagtttygggggttygggtyggyggttttgttagtygggtygtgyggttgygggggtggggyggyggygtygttgttatattagtttygggagyggygagagggaggttggggtgggggygygaggggggyggygygaggggggtygattttgygggtaggtgatattatatttygaaggttttagtgygygggyggyggygygggttyggtttaggaaygtttagtyggtygttggagtttttyggttggtggggagtttatgttttttaygggaggtttttagttttygtttttatggyggtyggtttygagggttaggtgggttttatttataggtaggtattttyggttggagttggttatagttgtttaatattygtgtygttgtgtgggttgtttgggaaagttgggttgagggtttggttyggagagttygyggagattygggtgggagtgtgtggaagtggagggagyggggagatagtagtatyggygttggyg

SEQ ID NO: 11116 - DNA, 357 bp, synthetic construct
  misc_feature 1..357: note = Description of Artificial Sequence: Synthetic polynucleotide
  source 1..357: mol_type = other DNA
tyggagaatttygtatatataygtattygtaaataygygggttttttgygttattaggaagtagtygttagaatygtygggtgttttttaattatttttgggagatttggtttttygttttygttygygygygyggttayggygtttttttttttttygggtttttaaggtyggattatyggtttygttgttatggygaygtyggtttatttttttttattttygygygtttttaygtttttttttygtagggagttggggtttttttttttttttttttaygttygtagggatttataggttgataggagtagggggtygtttgttgttatyggtyggggatttyggggtttttyg

SEQ ID NO: 11117 - DNA, 814 bp, synthetic construct
  misc_feature 1..814: note = Description of Artificial Sequence: Synthetic polynucleotide
  source 1..814: mol_type = other DNA
tygtygggagtttyggggttyggttttagtttygggttgaataagtagggaggggagaggtatttaggtttygttttttygyggttttttttttttagtyggggaggaggagatttaggaagtygygttyggtttyggtgggtggagggtttaggtygygttttttagtttygyggttttaggtttyggttygttygaggyggagttygggaggtyggggyggggtttygggtyggttatttatttgggttgttagttattttagtttygygaatagttggtgtygtygttgtttagtygagatttyggggttttgyggtttattatttttttygataygatatggttaagygtygtygttygaatyggtygtygtygatatttygtttyggttyggggttgaggaggaagtygagaaggaggaggaggaggyggyggyggagggygggggaagaggayggtygtttygggtttygtttgagttygtagggtaggaygagggagyggygyggtgagagaggyggatgaaggygaggygaygttttttttagggtygtgygyggtttaygaygttggggtttyggaggaygaggaggaygaggagtaggyggtggyggtagttttttaygtttatayggttattgttttttygtttttyggtttygttygtygygtygtygttgtygtayggtaagttgggagygagaggyggggtyggtttygtygggtttggggagagaggygggttttgtyggyggggyggggtygatagtaggtagtttygttttttayggttttaggtttttggayggyg

SEQ ID NO: 11118 - DNA, 847 bp, synthetic construct
  misc_feature 1..847: note = Description of Artificial Sequence: Synthetic polynucleotide
  source 1..847: mol_type = other DNA
aygtaaagygtttttttttttattttyggagatggtaygtgygygtttttaygtagtggyggttgttgyggygagtaygttttttgygggatttaygyggggagtgggttggtagtgygygtatagyggyggygagtgggtygtgtaygyggatgyggggtgggagtgggggygtaygygygggygtgggygagygggtttyggtagtgtatatatayggtaggggygggygatagatgtagtgygtgygtyggagtttaagygtataaayggaaagagygggygyggtgygtaggggygggygtttagygggtttggtatgygygttttygttygaggttataaaagtatygttatttgttgttattagttaagtygygygtttagttgtttggagaagttygtttatygtttttagttgttgtttttttygatatggattttgagatttgtttttgtttttttggtgagttttygttttygttygtattttgygtattgygygtttttgtatttgtaaagaaatttaygttttgygttttygtttaaggatatttgggggaagggtttttgattttttattttttatttygtgaagggygggtatgtttgtgtygyggagaatagggagatttggtattttattttttygtgataggygtggggattygagttygtttatattaattttttttgtggygtygttttttttaggtggtttttgtatttgygyggatttttgtaagtgygagggatgtaaatgtattttttgtaagaagagtgagtgyggggattttttttttttgtygtygttttttttgttttgyggagtyggtgttttattayg

SEQ ID NO: 11119 - DNA, 589 bp, synthetic construct
  misc_feature 1..589: note = Description of Artificial Sequence: Synthetic polynucleotide
  source 1..589: mol_type = other DNA
aygggggtaggygtggygtttttgggattgtyggaaaaygaygtgagggaaaaatttagaggttaygaaaaggygaatagayggagggtttgttttaggggagttaagtagttygtttgaagttttttatttggaaatgaygtgtttaattyggygtttttgtagtttyggtygtttttttttgtttaatttygygtttttttagtttyggtygtttttttygtygtttttttttygyggtygtttatttttgagatttttggttttattgagaygtttagttttattyggtaattygyggatattaagygttataaatttaaataygagatttagagaygttgggttttaaaygttttttagagtgaaagatagaggaattaatygaggttyggttgattttagaygtttaaggygataggygttgttaagaaaagggggtgggaygatatttagttgttaagaygayggttttygggtgggyggtttgaggtggttttyggtygttaggygagatttygygggaaaattttttgttagagagattaggagatttggggttgyggtygtttttttyggagtatttayg

SEQ ID NO: 11120 - DNA, 848 bp, synthetic construct
  misc_feature 1..848: note = Description of Artificial Sequence: Synthetic polynucleotide
  source 1..848: mol_type = other DNA
acggggtcgtattcgagtcggcggagtatttttagggagggggcgggaggttttttttgtttagtttcgagtcggtggtgtagcgttcgttttcggtcgcgggcgtagattggcggtcgttttcgggttacgtggtgcgcgcggcgggcgcgttcgaggagtttgcggttgtttttggtttatagcgtttcgggcgaggagagcgggcggacgtcgggggttgggtcggtgcgggcggcgaggtaggcggacgaggcgtagagatagcggggcggtcggggcgcggtagtcggcggcgtcggggtcgcggtttttgttttgtcgtttttttcgcgtcggattttcgcgtttagggcgtacggtggagagggacgcggcggagtcggtcggtagttatggaatcggtttttttcgtcggcgtcgagttgtagttttcgtttttcgttaacgtttcggacgtttattttagcgtttgttttagcgttggcgttaatgcgtcggggtcgttaggcgcgcggagcgtttcgtttttcgttttggtaatcgttattatcgcgttttattcggtcgtgtgcgtcgtggggttgttgggtaacgtgtttgttatgttcggtatcgttcggtgagttcgttgcgggtcggcgtcgtagggttggagttcggggtgagggtggggattacgaatttgagattttaagttcgttttttggatttttcgcgttttcgtattttttgtaggggtatttggggtttagcgagaggcgaggttatttatatcgaggggaatataggaatgtgtgttatcgtgtgtatgtgtgtgtgtggtgcgggggggggagtgcgtcgcg

SEQ ID NO: 11121 - DNA, 1230 bp, synthetic construct
  misc_feature 1..1230: note = Description of Artificial Sequence: Synthetic polynucleotide
  source 1..1230: mol_type = other DNA
acgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgttcggcgtcggagttatgatttttcgtcgatttaggaagttgtagtagaaggaggaggcggcggttatttcggatttcgtcgttcggattttcgattcggaagtcgcgttcgtcgtttcggtttcgatttcgggattttttgtcgtagtcgttatttttgggtttttagcggacgagttgtacgcggcgttggaggattattattttgtcgagttgtatcgcgcgttcgtcgtgttcgggggtattttgtttcgtcgaaaggtgcgtttttcgttcgtttttaggatttgtttagttttttttcgattttttatagggtttgttgatttcgtagtgtttttttttcggcgttcgcggagttttttattttttttttcggttcgttgggtgtttcgatttttcgcgtttttcgttgttgcgaaggtcgtggttttcgtttgtatatcgcgtttaggttcggtggtttttaatttcgcgttttatgtacgttttttttttttttttttgattttttttagtatttttttttttttattcgttttatttggttttttgttttttatgtttcgttttttcgtggttaggtgttttgggtttttaggagtttttcgttcgagggatagagatagttttaggtaagttgaaggttcgagagttttcggtgggagaagcgggtcggtggttgcgtcgcgtgcgtttttattttgaggaagtgcgtggggagtcgttgatttcggatagtatattttttcgaggggatttttcgatttttgggttgggggtttgtcgtttggttttacgtttgacgtacggggcgcgagggttattgttttttggatttttgtcggaatcggacgtagtgggaggggtcgtagggcgttcgcggggtaggaaggatgcgggtcgcg

SEQ ID NO: 11122 - DNA, 1094 bp, synthetic construct
  misc_feature 1..1094: note = Description of Artificial Sequence: Synthetic polynucleotide
  source 1..1094: mol_type = other DNA
gcggcgttaaaaatagttggggggagggtgcgggggcggcggagtttgtaatttaagtcgttttagttttcggggggtagatttcgcggtcgtcggtcggcgttcggtttttttagtattcggtttagggttggagttggttgtagggttggttcgcggcgatttgggtagggtggcggttgttttttttttttttatttcgtttcgaggcgtagcgcgcggtagagcggttcggtgttcggcgggcgggcggttcgggcgggtttgcggtcgggatgaggacggcgttttcgttgtagagcgttggggcggcgcgggtcgggagttcgttggcggcggtcggcgtggcgggcggagcgggtttcggagcggaggtgagtgcggatgcgtcgtttgggcgcgcgcggtgtttggggatttcgggttggaacgcggggcgggggtgttatcgggttgcgcgggggttttcggttcggttttcgtttttgcgttttcgggggtcgtttttcggcggggtcggatttttttagcgttcgcggcgttcggttcggttttttcgatttttttttttcgggttcggacgtgcggggtagcgagcgtcggggttcggcgggggtcgtagttttgttcggagcggagcgttggtagcgcggggttcggtttcgtgggtagtttgggaagcgttcgggtaacgtattggcgagggtcgcggagcgaggggttcggggagcgggattttcgggcggggttgcggggagcggggttcgggtcgttttatttatcgcggatcggagtcgggggtgttttagtcgtgtcgtcgtttttttcgggtcgttcgttcgggcgtgttggtttcgcggcgtttcgagcgcggtataggtttgcgagtcggcggtgttagcgtttcggacgggggtgggagttttggagtttattttgggggagattacgtcgtattttcgtttagtttcgcgtatttttagaggtttttgtagagtcgggaagttggttggacgtttagattcgtggggacgcggcgtttcgcgtggcggcggtcggaagggaaggttaatggggttcgggggattttcgcg

SEQ ID NO: 11123 - DNA, 1979 bp, synthetic construct
  misc_feature 1..1979: note = Description of Artificial Sequence: Synthetic polynucleotide
  source 1..1979: mol_type = other DNA
tcgttatcgttatcgttttttttttagttattttttatattcgttcgtttattttttttttaatattttttatacggttgttcgtatttttgttttttttcggtttacgcgcgttttttgtaatttcgacgtttttaggtttttagttcgtttttttttttcggttcggagttcgagagtcgtttgtttttattttaaaatagcgataataatagggacgttgagaataataattacgattagtacggcgaaggcgtttttttcgcgggttagaggtcggcgttttagtttcgtagaattcggcgttcggttagcgttttttggtagtttttttcggtagttttaggtttttaagatttgtaggttcgtttcgaagtttttcgttcgttttttacggtcgtttcgagttttcgaggttcgtttcggagttttttgttcgttttttacggtcgtttcgggtttttacggtttttaggttcgtttcggagtttttaatcggttttttagagtcgtcgcgggttttcggttatttaggttcgttcggagttttcgttcgttttttacggtcgatttaagtttcgtcgattttttaggtttttttcggagttttttatgggttttttacggttatttcgggtttttaaagattttcggttgtttcgaattcggattcgtaggttcgtttcgggatttattattggttttttacgatcgtttcgggtttttaaagattttcgtttattcggtttcgattttttaggttcgttcggaggttcgcggcgtagtttcgtcgtcggggaaggtttgtaggtcgtaaggtcgcgcgaatgtttcgtgttcgtttcgattatcgtttttagattagcggcgttttttatcgtgtttcgagggttgcgcggtttcgcgacggtttagcggcggggcgcgggcgttgtttatgtagttcgcggtcgcgtttttcgggtcgcgcggttcgagcggtaaggcggcggcggcggcggcgcgggttcgggttcggtagagttgcgagggacggcgggaggcgagttcgtttttcgggcgcgtttacggttcgggcgagagtcgcggttttcggtgcggacgttattgatggggcgtttggtcgcgggttcggcggcggcgttttttcggttggggttttcggtttatcgcgtatcgttttagggcggtttttggttttaggatttagcggcggttgcggcgggagtcggtcgtatgagacgttttcgtttattggttcgtcgtattcgttatcgttattggttcgtttcggtcggtcgtaggggttgtgtacgttatagcgtcgtgagttagtgcgttaatggagtgaaggagagaggcgggattgatagtttttttggcggttcggaggcgggattaggaggacgtttcggtaacgattgggtagggttttgcgtaagggcgtatgcgatattggaagtagcgagtaattggattggttgttttcgtcgtaaaggagggtgggttttgtattttcgggtttgacgattggtttttttaagtgtcggaagtaatagggatgtcgtttggaaataaaatttggtattgaagcgtagggagataaaacgtttatttttagagtcgaggcggcggttgtttgtcgcgtgttcgtggttttttgtttgttttcggatatttcgggttacgttcggttcggttttcggtcgcgttgttttaacgggcgttacggggtatgaagagttttgggcggttgcgaggggagggtatcggggtagcggggcggtcgttcggggttttcgcgcggtgatttttgttttgtcgtcgaagagaacggttttcgggcgcgtcgcggtcgcggttttagagtttttgggtttcgcgttttgagagtttgagtcgtttgaggaggttaagcgtttacgaatcgtattttttgttttgttagttagttttttaatacgcgaaaaaggtagacg

SEQ ID NO: 11124 - DNA, 1930 bp, synthetic construct
  misc_feature 1..1930: note = Description of Artificial Sequence: Synthetic polynucleotide
  source 1..1930: mol_type = other DNA
tcgtttaggtagcgcgttgtttcgggtttcggtagggtggggattggtcgcgaaggttagagaaggtaatggtaggggaggttagtttttgtcgcgggtcggttgtagagcggacgtttcgttttgttttcggtttttttttcgttcgtcgggttcgtcgtgtcgaataattgttgttcggagttttcgtgacgcggagttttaattgttgcgattcggaagaagcgaaaaggagtttttttcgtttcgtattttgagcgttcgggcgtgtaaacgtgggtggcggagagcggttgttttttttttttttgtttttttttttttcgcggcgttttcgtgtgtgcgggtgtgtgagtgcgtgtgtttttttcgtttattttcgtatacgtttcggtattagtgtaggcggcgagtcggcggtttttcgttcgttcgtttcggtagttgcgttttcgtttcgtttcgtcgtcgtcgtcgtcgtcgtcgtcgtcgtttttgtagtcgtagtcgggtatggtgagtgagtgaggtttagtcgtcgcgcgttttttcggttcgtcgtcggattttagttttaatcggtttcgttttagggagttagtttgcggcgggagcgcgttgcggggtcgggcggttgggggattcgggcggtcgagttgcgtttggaggggcggttcgtgcgttttcggttttaggcgcgtagggtcgcgggatttcgttttgggagcgggttttacgtttttttcggtttcgagttttttttttcgagggttgcgcgtatttttttcgttcgtttgttcgcggttttttttttgttttcggagcgttagtcgttttatttcgtgatcggtttttcgttttgtttcgtaggattcgttcggacgggattacgtcgtcgtcgtcgtcgtcgtcgttcggagtcgcgtttcgggttttgtttgagtcgagtcgcgcgcggggtcgtagttatcgtcggcgggggatggggttgtttaggaggcgcgtcgagttcgtagggggagcgcggagtcggcgcgtagtttgagagttcgagtagttcgcgtcgggtcggttcgtgcgtatcgcgcgtcgtcgtcgttattgtcgttcgcgtttcgatggcgttatcgtttcggagtcgttgatcgtttagcgtttttagttcggttcgcgcggcgggtttttcgagttcggttcgtcgggggagcggtttgtcgcggaagttttttcgcgttttttcgttcggtttcgttatggcgttgcggcgttttttgttgttgttgttgttttcgttggagtttttggatttgttgtttagcgtttacggagttcgcggtcgcgtcgttaatcggattttgagtgtaggcggcgttgtcgtcgggggtcggagggtcgggggcgttttggtacggggcggtcgcgagttgaacggtatcgttcgggcgttcggaatttcggaggcgggaagtcggcgggggtagttcgcggcggttgtggcggcggcggttagcgcggtcgttatttacgagacgtgttggggttattacgacgtgagcggttagtacgataaggagttcgagtgtaataatagcgagagcggttatttgtattgttgcggtatttgttattatcgtttttgttgtaagaagcgttacgagaagttggattagcgttagtgtattaattattagagttcggtgtgggtatagacgtttagtattaaggtggtgtcgtcggggttcgagaataagtacgattcggagaaggataagattaattttatcgtttatattatttgcggggtgatcgttttcgttatcgtggtcggcgttttcgttaaggttttttacgataaggtttatcgttttttacgggagatgaatatttataggtgagagcgtcgcgtgtcgcgcgtttcggttttttcgcg

SEQ ID NO: 11125 - DNA, 3177 bp, synthetic construct
  misc_feature 1..3177: note = Description of Artificial Sequence: Synthetic polynucleotide
  source 1..3177: mol_type = other DNA
tcgcgttagtttcggggtttttattttggcgggaagggtaggtcgattcggtagattgcggtttttcgggagggaagaaggtgttagacgcgcggagtaattataaatagttttttttttttagaagacggtacggggtttaagatttaggcgtcgtatatttagaatgagagtagagattttcgttaggaaaaaaaggtatttaggggatttgtttattagtatgaaatgtaaatgagttcgttcggttttatttatataattttgtgtatggattcggcgaaagggtaattagggagacgacggcgtagtagttattttgttattttttttattttttttttttatcggtcggggcgggaattgagacgattttaattttttgcggtggcgggaggtgcgcgggggttgcgtgggtggtgtagttttaggagagtgaataacgtttaggggtgatggttttagtaaagtgaggggtggtgatggaggttattcgatttatttcgtcgttttttcgtagtggcgtaagcgttttaaaattttcggagagggaattgattgatttattaggtttcgtcgtgtttatttttcgtagatgttggggaagtgtttttcggcgtttaattttcgttgtttttttttttatcggcgtttagtatattcgcggcgtttcgttttcgggtatttatagttttttggagtggcgtcggcggtaggagagagttagagtcgattgagttttagaattcggggaggtaggcggggtaagggtcggggtttgcgcgtgcgtgtgtacgcgtggaaagtataaatttacgagggttcgttgtcggtagggttaaggtgagtgagtgaaggcggtagattcgcgaagttttagtttcgcggatattttttttttaagttatatagggatttaagagaaattgaggtacgaagttggggggtggcggtggtggggattttgaaggtcgagtcgataaagtttagttttgtgttttcgtttttttttatatattcgagatttttataggtttttttttaggggttttcgttttgtttcgtagttttttttggggattcgggttttgcggtttagcgcgatttgtttggggttacgtgtttaagtacgaagtttttgcgtggagtttacgttttttaaaaggtttttaggggtaaagggatgaagtttaggagcgttaatgtgaggttaggtttagcgggttagggttacgaggttagggtcgaagttttagaattgattcgggagtatgattaataagtttaagagatttgtggaggttacgtttagattatgtttattttagtttttttcgagtttcgttcgtttttttaagattgggtttttttagtttgaagttttatttttaggatatttagtttcgtttttttttttttttagtttcgtagttaagtttaattttagggtgggagattaattaggtggagatttgggatttcgttttgggattttttggtgataatttttattttcgtgtcgtttgtttttttttttttttaggttcgtttagagttgagtttcgtttttcggttgttgtttaaattaggggtcgtggataaaggatgtttggggtttgcggttttacgttaggatttcgcgtcgaatattttgatttttcgggttttttttaagggagttttaaagattttaatggttaataggaaagtgggttcggtttgggtagtagtttgattggttttagttttcgggagcggatttaggggtaaggggaggggagaggggcggttttgggttttggggtgggaatcggattttagttgtggttttttttttgcgttttcgttcgtattgttacggcggacggttaatgggcgcgcggttcggggtcggcggcgttcggcgattggttgcggggttgtttgggggcggggtcgaggtttgaagttgaagtgagggatttagttgtggtgtgcgcggggtttttcgtcgtcgttttcgttcgttcgtttcgcgtttcggtcggaggaggaggttgtggcgtcggcgatagttacggtagcggtagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttgattttttagattcggttttagttgcgtcgcgggaagagggggcgttttttttcggattttcgtttttcgtcgttgttttttttttcgttcgttttttcggggcggtttcgtcgaaggtagcgtcgaattcggtaatcggagtttgggcgcgaagcgaagaagtcggaataaagtgagggggagtcggtcggttggttcgggaagttttaggggcgtaggggaagcgggattcgcgtcgggcggggtttttttgcgtttcggcgtttcgcgggtagtatgtttttgcgggtagggggagttgggttgaattggttttttcgggggtttagtttgcgttttagagtttattagatgtgttttcgtcggggttttcgggttgcgtgaggatattttttttgaggggcgtcgtttgttttttttcggatcgttcggggtttcggttggttagaggatggacgaggaggaggatggagcgggcgtcgaggagtcgggatagtttcggagttttatgcggtttaacgatttgtcgggggtcgggggtcggtcggggtcggggttagtagaaaaggattcgggtagcgcggatttcgaggcggaggggttgtcgtattcggcgttggtttcggtggtttttttttatttgagttaggatagtcgttcgcggagttggtgttttcgtacggtttgtaatttatatttttcggggtacgacggttaggcgcggggttagaagggggacgggtcgtatcgtcgggggtcgggggggaagaagatttatcgttaggtgagtcgaagtgagttcggagggtaggcggatggggggggggttgttagggaggggagggggtattagagtgggagcggagacgcgagtaggtttcgtcggtaattcgggtttattttatttgcg

SEQ ID NO: 11126 - DNA, 2195 bp, synthetic construct
  misc_feature 1..2195: note = Description of Artificial Sequence: Synthetic polynucleotide
  source 1..2195: mol_type = other DNA
tcgttagtttcggtcgttaagtaaatattttttttaggagttcgagaagtcggtgtgcgaggggaggaattagtttgaggtttatcgttttagtaatttcgggtgatttatagagtttagattttcggttgtcgtagatcgcggtaggtacgtaaataagtagttcgggagatattttttttttttttagttttcgtttttttattttgttattttttagttcgtgattagttgttttttttttttttcgcgggcgtttagggttgagtaaatatttcgggtcgttcgtttcgttattagttggtttcgatcggcgtatcgttggcgattttttaggtaattcggcgttatgagaatcggtatttcgagattcggcgttttgtttttttttcgcgtttttagggttttggttaggtttaataattttttttttttttgtgcgttttagtttttacgggtttttggcgcgggttaattaggtttcgttgcgggtttttaggattgcgtattttatttttcgcgaggttagtagtttcgggggaaggcggtcggaaaattttttgtttatcgggttggataagtattagtttggattcgttttttaatttttgcggtttagttttagtagatttttggggtcggaggggaaagggtggtaatttatagatttatttcggaatagggagtggggggtggggttggtgggaatttgattttttggaaaggacggattcggagttagagttaacgtgtttcggagcgtagaggtttagggggtcgcgttaaatattgtatttcggggaataaaatcgtgaaggttaattaggataagtcggagtagggaacggggacgtcgggaggggagagcgcgtttcgagttgggtagaatttggaacggttataggaaattcgggcgcggggtagtcgggtcgagggggatttttgtttacggtttagagtggtttggattcggtttacgcgtgagaggagcgtttggtgacgattttacgtacgtttggtgattggtggaggttttagagaaggatcgtgcgtgtaaaaggcgaatttcggtgtgcggtgtgtttacgtgtgtaagttggggaggggagggggcgtagaaggcgtgataaagacggattttgttttgagtgtgcgtttcgtttcggttcgtttttagcgaattgtgtttgaagtgtgttttacgggagggttaggacgaaggtgataaaggttaggtgttttttacggagacgcgttaaggtagtttcgcgcgtgttcgtaggcgcgttttttggaagacgcggtggggggtgcgtagggttgtatttttatattaattgtttcggcgaaggtcgagtttagaaagtgagtgcgcgtgagtgtgcgcgcgttcgtatgcgggggcgtggtagttaatagtaataatttatacgtcggtagggttagaaatttttattttttttattagtcggaaagtacgagtcggtttagtttggaggtgagtcggggcggggagggtcgggtaggttttgtttttgtgtaaacggagcgtacgtatttggagcgcggcgggcgttcgattagcgttttgaatggaggtgatgtaacggtgatgtaggttttagtttattttcgtcgaaagtaaggagttttgtttggggataggttcgcgcgagagcgagtaatttagcgcgtttggtttagtttcggttttagggagaggtaggttttgcgtttcggttcgggtttcgttattttagttaggatcgggtttggtttagcgtttcgcgtcgcgttttttttattttcgttcgtttttcgtttggggttggagttggttttaaacgttgcgttggagcggggtcggcggcgagttttaggtaagggttgttgttttttcgtttcgtcgttcggaagagtcgggtcgggacggcggggagtgggcgagggtagaggcggggggattggatattttgcgggttggggacgtcgcgttaatttcgttcggtcgttgaaagtttttaaattcgagtcggttggggattgggggggtgggggagttcggcgttgcggttcgggttggagggaggggaaattattttataatcggggtttttaagaggagtttttttatcgtttgtttttcggtgggagttcgcggttattttttttcgtgggtggcgttttttttgtcg

SEQ ID NO: 11127 - DNA, 2063 bp, synthetic construct
  misc_feature 1..2063: note = Description of Artificial Sequence: Synthetic polynucleotide
  source 1..2063: mol_type = other DNA
tcgaggagtcgtggaatggaggattacggcggcgtacggagtatcggggaggaatcgtggggtgcgtaggcgtcggagcgttcgggttcggttcggatcgaaggtttgcgcggtgaaggtgtggtgtttgtgtttcggggaaagggttgttttttcgggggattgtttcgtagcgaggtttgttttgttcgtagttgggcgttttttggggagcgattgagcgtaagggcgggtcgggaggcgcgaggcgagtacgatgttttagggttttaaggattcgtgtgcgtgtgcgtgtgtaaagtggggcggtgtagggcgtgtgtacggtacgggcgagacgcgcgtcggtgcgggcgtcgggcgtcgtcgggcgtaattatagtataaagttcgggcgtcgcggggcgttggttcggagaatttatcggacgcgtagaatcggatcggtatttttttcgttagtattttaacgcggagttatagcgtttagggatcggagggtaggcggcggcggtaaaggatattacgtaagtttttacgtaattttttcgagtagtgtaagtttttaggattggcgcgcgtttcggttattcggagcgcgtatcgttcgtatttcggcgcgtttttcgcgcggtgtagggaattatagcgcgggcgggtattaaggggaaaggaggaggcgtggtttggtcgaggagttaatgggtcgggaggggcgcgcgggggaggagtttaggtgtagagtgtcgattggttagttcgtttttcggtatgtagatacggtgggagttacgtgttaggggtcgggacgattttttgttggaggttaacgcggggcggggaagggggcgcgagcgtttcgtttggttgaagcggggggaggggggtttttgttagttagagtaataagatggtcgcggtggtagtttcgtattttagcgcgacggtttcgggagtcgtagtcgtcgtcgtcggtttcgtcgtcgcgtagttttgagcgtcgttcgggtcgttttttgatagggtagttttagcgttcgtcgcgttttcgtcgtcgttatcgtcgtagtagtcgtgggttcgttcgagtcggaggcggagggagcggagcggtttcgcgtttagtcgttcgtagttgttatcgtcgtcgtcgtcgtcgtttaggattcggatttcgtcggagtcgtatttcgtcgggcgtgaggaggaggacgcgtcgcggcgttgtcggggtcggatttggatttgtcgggacgcgtcgtcgtttattcgttcgcgtcgtcgtcgtagtcgtcgtcgtcgttcgcgtcgggatttgagttcgtggcgtcggcgttgagcgggttttcgtcgttcgcgtattttcgaggttttcgggcggttgttcgtgtcgtcgtcgtcgttaggttcgcgttatcggagtttcgcggagtcgtcgtcgtcgtcggggacggagtttaggtgagcgcggtagttcgttcgtttttcgtcgtagtcgtaattttgtcgggaggttcgcgggttttttgttcggtcgagtcgagtcggggcgggcgttggtttttagcgattcgcgtgcggcgttaggtttcgggtcggtcgggtttgaggggagcggcgggaagcggtcggggtcggggcgcgtgtgtgttagtgtgagacggggttgtgtagacgttcggtgtgtattataattaaacgggagtggaatggagggttgaagatggatgtgtttttttttttttaaaatttatgtagcggtgaaattcggtttttttcgggtagtttttcgtagattttgtattggtgatggtaggcgcgaattcgtcgtgttttggtgtaggagttcggtgtcgttgtttgggggaagagaaaaattcggggcgtgttgcgggtgggcggagaaggatttttgggcgttttgcggttttgaaattaggtggattttttaacggtgttgcggattgcggagtaatgcgtatgaggaaaacgagtcgtataatatttgttttgttattagataacgtaattcgagcgtttggttgtcgtttttgttttaagcg

SEQ ID NO: 11128 - DNA, 816 bp, synthetic construct
  misc_feature 1..816: note = Description of Artificial Sequence: Synthetic polynucleotide
  source 1..816: mol_type = other DNA
gcgttcggagtgggaggaggggaggcgttgttcgacgcgtttttttaagttttcgcgttttttttcggcggcggttgttcgggggcggtggttcggcgtcgtttttttcgatcgttttttttagggtttttttttcgtgtcgcggttaggttgttcggtcggcggcgcgttggaaatatgaagagacgttgtagttgcggtggcggtggcggttattgtagtttagagcggcgtatgcggcggtcggggcgggacgcggggtcgggcgcggagaagtcggggcgggcggtagagaggtcgggacgcggatcgggtcggggcgtttatagtcgttcgacggcgtttagagagcgcgcgtttcgtagtttcgcgtttagttcgtcgggtatggggcgcgcggtagtcgtttgaagtttcggtttggttcggtcgtattcggtcggaggcggagggtagagcgcgcgtttagttgttcgggtattaaatcggagcgcggcgtgcgggaggttttagagtaggattggaaatgttttggtcgcgtcgttttttgtttagatatttgttttcggtttttttgttttacggtgagttttcgagggttattcgagcgtttttagtcggcggaggtagttcgggcgtcgcggagttcgcggaggcgtcgggtttggatcgcggtacggtttatattgtttttttggcggggcgggttcgaggggagtttcgcgtttgtcgttttagttttgggagagggggttttgtttatttttcgaggtttgggatcgtttttttttagggcgttcggagttttttgttgcg

SEQ ID NO: 11129 - DNA, 368 bp, synthetic construct
  misc_feature 1..368: note = Description of Artificial Sequence: Synthetic polynucleotide
  source 1..368: mol_type = other DNA
tcgttttttttatataggcgcgtcgggaggtttcgttttttggtcgcgcgattcgggtatttacgtttcgcgtagcgtcgcggtcggtttcgcgtagtagtattattcgtattatttcgttgtggtttatttgggacgcgatttataggggcgttgtttcgttttgcgggaagaggaggcggcggtcgtcgtgattggggcgttcggttttattcgtttatagaacgtttttaatattaggggtttgaaagcgaaaatttcgggaaggtattttttgatcgtagattatattttgtagttgatttatatcgtttaggaggtagtgagaaaagagggggtgtgtgtagtttacggacgtagacggtacg

SEQ ID NO: 11130 - DNA, 1411 bp, synthetic construct
  misc_feature 1..1411: note = Description of Artificial Sequence: Synthetic polynucleotide
  source 1..1411: mol_type = other DNA
gcgggtttttatttcgtcgttaggagttttttttataattttgagaatcggggtgcgaagaaagaaagggcgaaagggtcgtttaatttttagagagtagttagcgaaagattcgaggggttttttttcgtaggatttcgaataattgtagtatttttttagttcgcggggtttattaaggagatttttataaataatagtatttgcggcgaaggaattattttcgtaaagggtagaagcgttagattttattagttaattatttagacgcgtatcgcgattcgtaagttcgggtacgtttcgttcgggcgtaggtagcgggaggggtcgggtacgttcgtgggggtggtttgggtacgggtttgattcgggggcgcgttcgggaggggtttgggtttgagtcgggggcgcgttcgggggagtgggttgggtttggggcgggggcgcgttcggaggtgggggagtttggggtgggggcgcgttcgtgggggtggggtggggtgtttggttcggggacgcgttcggggaggcgtggtttgggtttgggtcgggggagagtcgggtgcgtgttttgggtttgcgcgggggagcgcgtttggtgtttagatgtttggtatcgagcgggtgggggacgtcgggttcggagtcggcggtaagtttttttttggtaggtaataagttttttttgtagttttgaaggcgttttggttagggttattttacggttcgggtttttagagtttttttacggtttcgaattcgagtagtttttggtttttaattcgtttcggaaaggtcgtttttttttttaatgtgtggcgcgtttcgatcgttttttattcgtggaataaaagagtagttttcgcggagcgggtttagagtttgttcggattgttcgatggttttcggttttttgagcgtcgcggttgtcgggttttgtgttcgcgcggggggcgggaaggacggtcggggtttttagtgcgcgtttcgcggagcggcgcgcggcgttcgaattggaaagttgtcgtcggcgtttgtcgtttttacgtcgttttagttttttttcgcggggcgttttatttattagttaggagattgggcgtagggtcgtcggggcgggcggggggtttattttgtttttgatttttattgcgttgtaatcgtagaatcgtaaggtttgagatttgtgaaaatttcggtttatggtttcggtttcggttagtttcgtcgtcgttttcgttttttaggggtcgtagaaagattttcgggggcggcgtttttaggtttcggtttcggtttcggttcgcgttcgtttggtcggcgggttgttttcggtgttgcgggttcgagttgggttggtcgcgcgttttagggattttaggggtcgcgcgcgggaggagcgcgggggacg

SEQ ID NO: 11131 - DNA, 1487 bp, synthetic construct
  misc_feature 1..1487: note = Description of Artificial Sequence: Synthetic polynucleotide
  source 1..1487: mol_type = other DNA
tcgtttttgtatttcggggacgtgattttttttttaggttgattcgtttttcgttttgtcgtttttaggtggaggaggagttgacgtatttttagaagaaattaaaagggatagaggacgagttggataaatatttcgaggatttgaaggacgcgtaggagaagttggagtttacggagaagaaggttttcgacgtacgtgtgtagggatgcgggagttcgcggcggggttaggtcggagtttcggggtcgggaaggcggggagagtcgtagggggaggaggaagaggaggaggagaaggcggcgttttttagcgttttttttaaataagtttcgaaaaggggtattttttagtagttgtggttagcggtgtcgacgttaggtttttttttagcggtgttgacgtcggcggttcggtcgggtgattttatcgtttcgacggtagtcggttcggggggcggggagaggcgggggcggttttcgcgtaggtaaaggtttggggggtcggggcgcggttgtgtagttttcgtcggagtcgagtttagtcgagcgttcgtcgttgttcgtgcgtttttgcgttttcgcgttatggtcggttttaattttttggaggcggtgaaacgtaagatttaggttttgtagtagtaggcggacgaggcggaagatcgcgcgtagggtttgtagcgggagttggacggcgagcgcgagcggcgcgagaaagtgagcgtttcggtttcgggtttcgtattcgtagttttttttttcgcgcgttttttttttttttcggtttttcgcgttgttcgttcgcgcgtagttttcgggtcgtttttttacgttttcggacgtcgatcgtcgatttatatttttgcgttcgtagttaggattttttatttttttcgtcgtttttttttttgggtttgggataggggagggggcgtcgttttcgggtcgggcggggtcggttaagcgggaaatggggggatggggcggagggggtgagcgattttcgggtggagaagtggagcggcgggagggggcgtatcgtgtaggtttcgatttcggggttggcgtcggggtttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtttttttcgcggtttttcggtttttgtttgtttttttgatcgtttttaggggcgcggcggcgacgtgtttgttttaggcggcgggggggatggggggtggaggaagtttagttttaagtcgttcgtttttttttagttgatttttgcgggaatcggggcggcgggattttgtttttttttagaaggtttcgggaacgttggcgcggggttttgaatttacgatcgtttgagcgtttgttgtgcgttttcgtcgcgagtcgtagggttcg

SEQ ID NO: 11132 - DNA, 602 bp, synthetic construct
  misc_feature 1..602: note = Description of Artificial Sequence: Synthetic polynucleotide
  source 1..602: mol_type = other DNA
tcgttcggttaagttattttttcgttagtaggtgaggttcgtgaatagttaagttttttttggtacggcggaatcgtagtggacgcgtggaggggtttcgtagaggagggatttttgtttgggatgcggggagttgtagttttttatttgtatttagtttgttagttgtacgtttgtaggattataattttagtataaagtaggattgtagggcggtgcggatttttggagggagatagcgcggtgcgtttttgtcggttatgttggttggggtggtgttttaggcggttttagtcgttagttatagggcggtcggattataattttagtatataacgggagtggaggtggtgattttgagagagggtttgtgttgtgcgcgtttcgcggggtatgttgggagtagtagtattttagttgttttcggtcgttggtcgtagggttgcgggattataattttcgtatgaaatggaagagagggtggtgcggatagtttgaggaaggtacggatattttgagggaggtatggatacgttgagggaggtacggatacgttgagggaggttacggatacgttaagggaggtatagtagcggtgcgcg

SEQ ID NO: 11133 - DNA, 628 bp, synthetic construct
  misc_feature 1..628: note = Description of Artificial Sequence: Synthetic polynucleotide
  source 1..628: mol_type = other DNA
tcggtattcgtcgtattatagcggatgggtgtatgcgggcggtgattcgagttcgcgcgggttgcggaattttttatttattaacgtcggcgtcgttatgggtttagggggttgggtgaggtcgtgagagtcggcgaggaagtcggttttgcgggttcggtcgatttcgggtttcggttttgggttgcgagggattttagttttcgtcgtcgtgtaaaatgtatataaggttcgcggcgtcgtttttgcgcgtcgtgaggatatagggttgtcgttaaggttttaggaagggttttgtagacgtttgtgggggtgggatcgcggttgatataaaagcgtgtaagtgggttttattttttttattgttcgtttttattcggtttcgaaaagtggtttttgtttggcgttttatttagtgtagcgttggtaattatagtagtcgtaatttaacggcggacgaagattggacgtcggaagtttcgtttacgtcgttacgggaacgtttttttgcgtttttcgtttatggtttggggtcggttttcgttttttgtagtattgttttttgggtaatgtagtttgacggaattcgggtggtatttggagcgtattttttgttttcggtgaggcg

SEQ ID NO: 11134 - DNA, 215 bp, synthetic construct
  misc_feature 1..215: note = Description of Artificial Sequence: Synthetic polynucleotide
  source 1..215: mol_type = other DNA
acggagggacgggtcgtgtagtgtagtcggcggggttagggttaggtcgagggcgcgaggtggtagtcggttcggggaggcggaggttgagcgagcggtggtgtttgtggagttgtcggttgcggtggaattatgaaaaatagtaggtatcggagtcggtttttagtttcgattaggggagatgggatatgataggtgcgattaatacgtagtcg

SEQ ID NO: 11135 - DNA, 2638 bp, synthetic construct; identical to SEQ ID NO: 6376
  misc_feature 1..2638: note = Description of Artificial Sequence: Synthetic polynucleotide
  source 1..2638: mol_type = other DNA

SEQ ID NO: 11136 - DNA, 2172 bp, synthetic construct
  misc_feature 1..2172: note = Description of Artificial Sequence: Synthetic polynucleotide
  source 1..2172: mol_type = other DNA
acgggatgtcggtttcggtcgtttttattaattgatttatgatcggtttggttagggcgttcggtagcgagagcgtcgtcgcgtcgttgggaggtagcgttagcgcggggaagaacggcggttggtgatttagtatcgcgtttatggcgaagttcggcgttcggtgaggtaggaacggatggtaggttatgtttgttttaggaatgatcggattttttatggagaggtttatttattttaggcggggcgttgggttttagtcggggataagttcgtagttgttgtgttttgttgtttttttgttgttgtttaatagtagtatataatttaaaaggggggaaaaagtaaaataaaaaagaaagaaaaaagaaaaggaggtagaaattataattaatgtattttaaagggaggaggggaagtgttttttggagaatgggaggtcgtttttaaagagggtaaggcgaaaaattagtaaatatagtcgcgcgggtgatcgtttttgtgttttgcgtttttaaaaagtcgtttttgaacgtcggttttagaagcgagaggagcgagtagggtttcgattcgcgttcgagttttgtcgttgagttcgaaatagatattttagttttgcgttttaggaatttttttttagtttttaggttttttgttgtaaatgtgaaaggtttttttagaagattttttatttttttttttttttttttttcgttttttatttgttttttttttttttttttttgttggtggcgtttgtagttgtgttagattcggttttaatagggagcgagagagcggaaaaagttttttttttttaaaaaaaaaaaaatttgatttaaatttttttttattagcgttattaaaatttgaattgtaaattggttttcgttcgtcgtttttttttttttttttttgtttcgagttttcggagggtgtttcggttttaatttaaattttgttgggtttttttttcgtgttttttttttttttttgttttaaaacgtgagcgaattcgttttttaaatttgtgtttaggcgcgtagggtagggaggatttagagggggaaaaaatggaatagagggaaagagagggaggggagagagagagagagagagagagacggagtcggagagggagggagcgagagaaagcgagagtttttcgttatttttcgtcgtttttagaatttatcgggcgtttgttcggcggttttagaaggtcgggttgcgttgtgggttgcggggagtcggaggttttttgattggttttttgacgttttcggattaattgtgttgttgtataggcgtggtttttataggtcgagtgttgggggatagagttgagttataaaaagaaggtgtcggaaattgtaacgtcgtagcgtcgtatcggtattattgtttgttttgtgaatatgttaatatgattagagggcgggcgggagttattggggagcgcgcgcgtatagagtcgtttttaggtggtttatcgagagatcgttgtagtttttgagttcgttcgttcgttttggtttagtttacgtttgaaatgttttagttatttagtcggggattgagggaggaggtagggttaaggaggaagggggagggagagagggagggagttagcgagtaggcgagtcgggcggggaaggcggagagcgcgttcgggcgtcgggtaggggcgttcgttttttttgtatttcgttcgttttttcgatcgtcgcggtcggttttttttttagttttttttttttttttcgtttcgggcgagtcgggcgggtggtcgagttttttcgcgagttgttattcggttattcggttttataaaagtcggcggtagtcgagaagcgagcgtcgagattttaggtttgcgtgttttttagttttacgtggagttaagtttcgttcggtcgtcgttgaagggttttcgagttcgggtgtttcggtgttggttttttttgcgtttgggttgggggagtataaggatgcggttatattttagtatacgtatgtgtgggttttttttttattgcgttttattcgtagttatgtgcgggtatttaaatattttcggtgtatttgtattcgaatacgcgttaatatattgggattgaaatatatatcgaaaaatacgtatatataaatacgtatatagtttgcgcg

SEQ ID NO: 11137 - DNA, 2548 bp, synthetic construct
  misc_feature 1..2548: note = Description of Artificial Sequence: Synthetic polynucleotide
  source 1..2548: mol_type = other DNA
tcgggtgggtttcgaaggcgaggatggttagaatatgtttttcgtgatattttttgtttttttttagggtcgtgcggcgagaggcgttcgagtattgttaatgtgacgcgggtttacggtcgtatcgtggggggtagcgcggcgtcgttcggggtttggttttggttggtgaggttgtagttcggcgggtagtttttgtgcggcggcgttttggtagcggttttttgggtgtttacggtagcgtattgttttgtagggtaagtaggatttttaggttttgtttagttggggttttcggcgttgggtttcgtatttgtcgggttgttcggcgggcgacgcgcgggaaaggtggtttttgttgttttttggcggcggtcggtttcgggtttttttattttaaggcgtcgcgttcgtttcgttaggatgttagttcggagggggtggtacggtcgggcgagttcgttttttttgggacgggattttttttcggttcgtttttcgtgtttttaggtggagaaagttcggtatgcgggcggaggggtagggttttcgaggggtttgcggggtgtgtttttgttttttttgcgttttagttgtcgttcgattcgtagcgtttcgaatgagtttttgtggattgtgacgttggtagaggggtttcggggggagtaagcggaggaggtgttagtgaatcgtattttgttttattttaaggtgagaaggtagtttttaggtttttaaggttgggtatcgtatttttattcgtgtttttttgattttgcgtcgtttttttttttttagtttgattcgcggattttttataacgatttggttttggtgtagttgtggacgtcggtgagttcggggggatcggcgcgtttcgtgtgtttgttttaggagttttaggagttttttgtcggaatcgtttgcgttatcgcgggttggggcgtttttttcgaaggtattgggcgtgggtgagtcggcgcgtggtgggaagaattgggggttcgaggtaatagagtgtagggaggtcgggttgttttggaaaaatgttgtttgtttttttaaagggggaggaattaaggggggtggtgggaaggggatttttaaggcggggtttttgttttttaaatttgagttttttattttttttttgtagacgggtttgaggttgaagtagtgagagaggttcgtgtttttttgtttagtatcgatatttgtcgaagagttttggggttcgggttgcgttttagtattatgttttgcgtcgggtatttggcggggggcgttgattcgtgttaggtatgaatttagtttgatgagaaaaggtcggttgagtttttttagggttattacggttttttttttttttacgtttgtttgttattcgatttttttgagtttttttgtttttatttttaaaatggatataagtggtaagtttatatttgttaggcgtaaggtaggcgttatagggggtaggtgaatgtagcgtttttttttttggtttcgtagggtgattcgggaggttttttgatttgttttgagtttggttttcgttttagagaggttttgttcggagttattttttggggggacggttgcggggagttagggaagttcggggtttatattcgcgtggtagtgtttaaggattggttttaggagtagatgagcggtgagcgttttttttttaatgtttcgtttttagtgttttaacggataatcgtgggataagttcgtttttattcggtttatgtttatttttagtttttttttgtttcgggaaagtttgttttttttcggggaaggagtgagggggttagggttttaaatagagggtgagttgatttttgtttcgttcgtagtagttttttttagtcgcgagtttagttgtagggagtttttggtttgggattttttttaggagttgtaggtagacgtcgttcggttttgcgttttttatgttcgtttgtgttcggggttttagggcgtttgtgcgcgtttggcgtattagtagtgtttgtagcgtcggcggcgatgcggttagttttgtttattcggattcggacggggggtagaggggagggggtttggttagtttttgatcgtcgtttcgatttttgttcggttcgtagagttgcgttcgttggcgtatacgttgttgggtttgttgcggaacgcgtaggagttgttcgggtttcgttcgggattgcggcgtttggttttcgttttggtttttttcgttttagcgtttagggagttttttttgtatttcgttcgggagttgcggttttatttaggtatttcgcgttttttagtttagtttagttttggttcggttttattcgcgcggtatagttatttttttcgtcgaggcggtattttaattttgtgtttttttaggatcgcgggttgtaggtattcggttttcgaagcggaggtcggagtcgcgcggagaagttaacggtaatgacgttttttgtcgatttttaggaggggataggttgagggtttggacgaggtcggaagcgtttttattgtagtttcg

SEQ ID NO: 11138 - DNA, 919 bp, synthetic construct
  misc_feature 1..919: note = Description of Artificial Sequence: Synthetic polynucleotide
  source 1..919: mol_type = other DNA
acgggagtcgttgtagggttaggacgtaaagatttcgaggttttttaggtcgaggggacgtcgttttcgttttatttttgcgttcggtaggtttttggtttcgttagtatttgtcgtttagggttggatttacgcggcgggcgggtgaggggtttttggcgcgcggttatcgttcgttttgtgttaggtgcggtgcggtagcgggagcgcgcggagttcgaattttgtacgtgtggtttcgtcgggtcggtcgttgcgagtttcgtttcggtttcggttatcgtcggggaggacgacgacgacgtggtgggggacgtgttggtattgttggtcgcgtttttggtttcggggtcgcgggcgtcgcgcgtggaggtcgtttttttttgtcgtttgcgtcgggacgcgttggtggagcggcgcgcgttgtacgagtttggcgtttattatttggtgagtgtcggcgcgcgggagggcgggtgagttcggtcgggcgggagtcggggtgattattcgtgtttttcgtagttcgacgtcgagggtgtttttcgtcgcggttcgggtttgaatttgattagcggttagtatagggcgttcgtggttggtttttacgttttcgtcgttacgttgtacgtgggtgaggttcggggcgtgggaggatcgttcgttttgtcgtttatttcgtcgttcgttcgtttgattacgttttattttttttcgtagcgttcggggagtcgtcgaggagggggtcgtcgcgttttcgggattatttgcgtttgtttatttgtatttagtttcggtgttagcgtaacgcgtgagtgtatttcggttcggattttatattcgtattcgttcggtttttataagttggaggtggttaaataggtattggacggggttttcgttcgtttatattttatcg

SEQ ID NO: 11139 - DNA, 2488 bp, synthetic construct
  misc_feature 1..2488: note = Description of Artificial Sequence: Synthetic polynucleotide
  source 1..2488: mol_type = other DNA
gcgtagttcggtaggggcggtcggattcgggtaaacgtagtttcgggtgggagtagggttatttttgttttcgagcggttggaataaaaatgcggattgtattttttttttttttttatttaaagtgtttagttttgaagataaggtggagggaggagagagagggcggaggtgtaaatttaatttaatttttgcgcgcgttttcgaggcggtcggttgttttcgtttcgtcgtgtttttttattaaggaaggttttttcgttaggggtcgttaacgttcgcggttttcggttagacggtgtatttgagagggatatttcgttttttttcgggagggattcgggtttgttgaagtgggtttaattttgtaaatcgcgttttaatttttcgcgtcgcgtcggggaatttttttttgatatttaacgtttttcgtttttatatttttaaatatagtttattttttttttcgtggcggtcgcggtaattcgagttcggttttcgtttcgtcgttagagaacgtttttttcgtcgggacgcggtgtcgagttcgttgtatatcgagcggtcgtggtataatatcgcggcgttgcgcgtataattatcgttttttaggattcgcggcgcgtatttcgggagtggggtgcgtttcgcgattttgggcgtttagggttagatatattttttgggcgtttcgcggtttttatagtgtagtttttatcgttttttttttattttcgggtatatttattcgtttttcgttttagtttattcggtttagggcgtagtcgttttttcgcgtttttttttttagtttcggtaaaggaagttttttttgcgtttttttttttagaatcgtttttagtttttcgtttttttaatcgtagtttaacggtcggcggtagtagtcggagaaggggggcggcggttcgggtttcggaaacggttcgatcgtcgggattcgggtcggatttcgtatttgggttggaagcgaggcggagatgggcggtcgggattcgcgagtgagcggggcgggcggcggtgatagttttatagttttagttgttgttgttgttgttgtcgtcgcggttgttcggggagaggggttggtattatcgcggcgcgttattgttcggttcgggggcgggggtggttaggaggagggtttaggcgagtagcggcggtagcggcggcggcgtcgcggttcggaggaagggggagggggtatcgggtacggggaggcgggagagggggcgggatcgggtacggggcgggggcgggggggaggggagcgtagggagggcgtaggtagggggagtaggaggagtagtaggaggaggtggcggaggggcgggtgagagggaggagtgggtacggggggaaggggagagaggaaaaggaggtatttagggagaggggagaggagaaaggagggagagaggcgcggggggagaagaggaggaaggagggggagttgggttaggtagggggggataagggcgcgttggacgcgtcgtcgtgcgtttcggtggggagcgcgtttttaagggggaagcgtttcgaggaagatttttgtacggggttgagttcggaaagaaggcgttgggatttgtgtttatttatcgttttcggaggttgcggtttttgggttcggtgggggttggggggagagggtattcggcgggttgtttgcggttaggttaggagagggagatttggtttaaataaagtgatttaggtatttttaggaattttcggcgttcggggttttttcgggtagttttcgatttttatgcgtttttcgggtttttagggacgcgggtatttgtggggcggggttgtcgggtttcggggttcggttttttcgggcggtcggagcgagatttcgggttgggaaagttaggtacgtggtcggttttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgttttttgcgggtattcgagtgttcgggaggcgtttatttgttcgatttaaatatttacgcgatttttagcgttcgtcgttcgcgtgttcgttttcgtttcgtcgtcggttattgtgtttcgttagtttatatcgggtcgggttttgacggcgcgcgagttatagttgtaaagtaataggataatttcggggacgtcgttttagtttagattcgggtacgtattgttcgtggagacggtatcgtcggggaggggagttacgcggattttagatgcggttttttaggcggatagatttttgttcggggcgtaggaggaggtaggattggtatcgcggggtgggagttttggattttcgagtaatttcggattcggttcg

SEQ ID NO: 11140 - DNA, 513 bp, synthetic construct
  misc_feature 1..513: note = Description of Artificial Sequence: Synthetic polynucleotide
  source 1..513: mol_type = other DNA
acgttgttacggtaacgattgtacgcgtatttttggagggtggtttgcggttttataggtttcgcgttcggggaggagaggaggtggtcgattagatcgtgggttttcgggtttttcggtttttttaggttttaaattttttttattagagattttgtttggagtttttatgttagcgtttttttttatcggtttttttttttacgtcggttttagtgtattacgcggttcggcgagggattgggaacgggatagggacgcgttttaatttatttagcggtggagttggggggcggcgcggttacgtgggatggcgggtagtttaggggattcgggcgacggggtttggcgggtagggttgttttagtcgtttttataaagtcggttttttcgatttttttttttttttgtagtttttttttttttttttgggggttgggaggggacggggcgggacgttggtagtcgggagagtggaaaaggttgtatagagtttcgtgataagttcggtcg

SEQ ID NO: 11141 - DNA, 1766 bp, synthetic construct
  misc_feature 1..1766: note = Description of Artificial Sequence: Synthetic polynucleotide
  source 1..1766: mol_type = other DNA
gcggatggtcggtttaggcgcgtttttttattcggggtcgtttgtgttcggtgtgtcgtgttcgcgggttaggggcgcggcgggaagttttcgttcgttcgttagttagcggggttaaataggttatttttttgcggacggtcggcgtcggagtttttttttcgttcgttcggatttattttcgtaagtagcgttggggttggagtcgggcggttcggattagtttcggtttatttgggcggcgttcgcggtcgggtttacgtcggggaaggtttcggtcgtcgcgagttttcgttcgagtttcgcgttttttagttatttatttgttttttacgttttatttattagcgcgtacggtttcggtaattttattcggagcggggcgtcgtcgtcgtttttgtcgtagttcggtcgggtcgttgggcgtaggggatttcgcgtcgtcgttgtcgttgtcgtcgtcgtcgtcgtcgttgtcgttgttgtatttttcggcgagcgttgttgtttttttttttgtttttttttcgttttttaacgtcgtcgttatcgttttcggtttttttttcgcgcgtcgttttagttaaagttcggtttcgtatttcgttcggatcgtttttaaatcgttttagttcggtcggttacgttgttttagttagttttttggtacggcgttatcgtttttcgttcgtttgttcgtcggtttttacgtaggggaggcgggcgcgtttcggggcggggagcgtcgggtcgggagtcgcggacggttggggttcggggcgcggggggtttagtcgcggtgtttttttcgagtttttcgcgcgttagcgtttttattttcggtttgggggacgcgcggttcgcgattcggttttgtttgttttcggcgtacggtttcggtttcggtttcgaagtttagtttcggacggggtagtgaacgtagagttggggtttcggcggttttcgatttttcgatgttttcggattcggttggtcgcgttttcggcgtcgagcgcgtattttcgtcgggatatatagacgtatatttattcgatatattttcgtttttgttcgttttcggcggagagttgaaatagatgtgggattcgtttaggagttggaaacgagggagggaagcgagttagagttttgtgtgtacgtgtgtgtgcgtaatatataaattagggggtatcgttaataaattaaatatcgtgataaatttaggagggttatcgattaggtttatttggttggaaacgacgtgaatttgtttttttttcgtttttttttttttttttttcggagttggagggagttaaatgtttcgcggggagtgcgatagtttcggtcgggcgtttttttcgtaatgatacgttaataaatgtttttttttatttgtttttataggattcgtttcggtttgtaaatattcgattgtttttgtcgaaagtttcgcgttcgtttttagttatatatatttgttattggagaggtcggcgtcggtcgcgattcgtagtttaatcgtagggtaaatcgagttgtttgtgcgcgttcgagaatttttcgagaaattaatttcggtttaagtgaaaatagtagttgttgtttagaaatggttcgggagtagtatagaaaggagaaatcggtttttttcgaaaggggaggaattggatttaagggggtgttgtttatcgtggttttcgttgtttttcgcgttatagaagaggtcggagggggatcggtttgacgcgggtgggtaaagagcg

SEQ ID NO: 11142 - DNA, 6511 bp, synthetic construct
  misc_feature 1..6511: note = Description of Artificial Sequence: Synthetic polynucleotide
  source 1..6511: mol_type = other DNA
gcgatttcgggggttagtagagaggagaggttgcgggaggattcgttgcgaagggcgaggggtggcgttgggtgggacgggcgtttggggtcgtgtagggtggtttttgggtgttgttcgggttgtttgtcgtttagtattggcgtaggaagacgggttcgcgtagcgtttggtaatagtggtttgttttacgtttggaggcgattaagttttgagttaaaggcgtcgggtttagtcgggaagtgtatggcgatttagaatacggagcggagaaggttttaggggatacgaggttatcgttttagttttcgggtttgcgtttcgagcggttagggtgcgtacggatgggtttcgggatgttagtggagaggtgataggagtttattattttacggttaagcgtgtgaggttttcggcgggcgggggtttttttcggggtagggtagggggagagttaggtatgtttttaacgggttttttagtagaatcgttaggaaagtggtttttaattttaggtatttttgtggtttttaggtagttgggcgattaaaaatttatttttgtttgttgtgaaatgggataggtggttgttaggttagagattgtgtttacgaagtttcgtttggcgggtcgggattgacgtggattcgggtttttttcggaagtttgggaatttgtgagttttttagtttttcgttttattttgtttgtttgaaaaaaggagttgtttgagaggaagagttaaggtttaaaaggttttaaacgaagagtatgcggtttgacgcggagcgtaaagaagcgagtagtgaattgaatttggtgggattgagattagaggcgtttgtatgcggcggtcgtttcgcgttttattaaagtaatttgttatttacgataattatttttgtaattattttggagtggttgtgatttgatgtttgtggtgttttagggtatgtttttattggatatagatattttagggtgttttttgacgttagtgtcggtttagtgggtgttagtgtcgcgaagggagggtggcgggcgtgaatgttttttttttttgggtttgtcgtaggtttcggtttttttattttgtttgattttggcgggtttgttatttattgaggtttttatcggcgtttacgttgtttcgagaggcgggataaacgttcggcgcgtggcgcggagtttgcgaaagcgttcgggggtttttattttttgttcgggagttttttttttggggcgggaagaggagtcgtagatttgttcgaattttgttttattcgtttggtcgttttttttcgtttggggtgggggtaggggtggcggatgatttaggtttggggtcgggagttttgtttttaaaggtattatttcgcgtttttttggaagtggcgcgttgttggggcgttttcgttgttgtagaggtttggtttgcggttttataggggcgtgggtttagggtttttagggagtaagtgagtttaggttttttagggggcggtagaggggaattttcgataattttttatttttttttttaggcggttgcgaggttttcggggttttagaggggtttttttttgtcggtgtcggttgttttgagcgcggttacgtagttcgcgtttttacgtgggtaaggggcggggacgttggagggaggttgttttggatgttggagttttcggttttcggttttgttgagtagaaaagttgaagttaaggaagggttgaggtttttttataagggcgcgcgcgtgtttgggtgtcggtttagaagtcgagaatgtgcgtattggggaagggtttttcgtgtcgagaagatagaggatttgttttagttgtttttcgtatagagggcgcggaggttgcgttttagttcgaacgtttatttattggaaagagggtagcgtcggggtttagggaagttttttgggaatgaatggtttttgttaagcggtttcggattttttgggttttttgggtttacggtacggtgttgcgcgagtttttagtgtttatcggtttttttcgttttttgcgtagacgtttttaggcggggaggtatatcggttttttcgggtagttttggttagtgttgttgtgggaaaggagagttagggtttgggatgggggatgagtatttttttgtttatttcgggttttagcgtgtaggaggtaaatttgttagtatagataagatagtttgtttaagttgtattttaggtcgggttagagaataaaatcgagggttagaaggtttagaatgtcggatagtttagcggtattcgttagggagttttaggcgttcgaaagaggcgtcgtatttttggcgagtttaggatttatttttttggatttgtgttttggagtgtttgcgggtttgggtttaatttttgtttttggtaggtgtttttttttttcgtcgttaatattaggagcgttgtttttgcggtaatttattttatttttagaagtttgttttgggatcgaagtgttagggttttgtgtgtttttttatgtattgttttttttagtgtaaagttttgtagatatgtttggtcgaaaagttttagtggttttaatttttagattttgttttcgcgttcggtcggaaaattatttgggatttggttgttgtttaaggtcgggggaaagttttttttggaggacgtttattattattatttttttttaggtttatttgggtttaaataaatgttaaagtttaaacgaattcgagaaggaatagcgaggtagtggatgtcgttatttcgtggatgggagagttatgtttattgtaggtgcggatatcgtattgataggtattgattattgtaaaatcgtatttagtattaaatagaaatagttttgttttttaatttttatagaatgtttaaatttagtttagggagttagttggggcgttttaataaatacgttttcgagaattagcgatgttttttttataatgaaagttaattgttgtataataattgggttaaagaatttcgttagtttaaattttaaaaattagtattgtattttgtttttaagtttgggtggtaagtatcgaaggggagagggaagtagcgtttgtgtggaaggaagtttcgttttttgtttaaatatgtgggatttgggtgtttatttttttagtcgagagttttttgtaggtttttttttaattttttgtatttttttatttttattttattcgtggcgttcgggttttatttttgttcggcgttttttttttagggcgagtagaggtttttgagtgatcggttcgttagaggtagttgtagagtcggcgtttcgtagggtagggtagggtcgggtcgttgggttggtttagtgcgcgcgggttttttttggttttagttagtcgcgggagatgttatttcgggcgatagcggcgagacgtcgttgttcgtaatttttgggcgggtaggatcgtttgttgtttttgcggtttttggggtagattttttaggagttttttttttttttttttcgttcgggggtcgggatcgcgttgtgtttacggagggaattgggcgtttttggcgtattggggttttagttgtatgattttagtttagattttaagttttagtggggtgtaggtgggatgggatgtgtttttaggagatgaggagatttcggttgttgagtcgttttttaaatgcgtagttttttaattttaggtgatattcgttttttggaggaacgagtgaaggtcgtttaggcgaaagaggggtgggttttagtatttggatttttttttttagttttgttaattttaggtgtgtttacggtggaggtgatagaaggaaggcgcgtcgggggatttaggtttcgtaggttttcggttgttaacgaggtatcgtttattgatttcgcgtttcgttttttatagcgtggggttcggcgttgcgttaggttcgggtgcggggcggagttaggttgggattggttgggggtcgtttcgttcggcgtttgggttttcgcgtcggttttcggggaggagttatgataattttttttttattaaggcgttcgggtttttcggttatcgttaggatatattgttcgggcgcggtttttttcgttcgcggagcggttttgatattcgcggcggtagtatttacgttcgtagagtcgtcgatgcgtgtttagtgattcggatagtaaggttcgcgcgcggcgggggcggcggtagacgtttggttatcgtgatttcgattttggatttatcgtttgggggttggggggattttggatttaattggcgattgttttgggggacgtcggacgttatgttgtggaaaataatcgataatgttaagtacgaagaggattgcgaggtgagttggggtttcggggtgtagtttcgtttcgtcgaggatagttcgggaggtaggggttattggatcgaggtcggggacgagggtataggagttttggtttttcggtgggacgggatttattttttcggatattttttagtttatttttgcggggttttttttttgtatagggtttttttttaaatagttttttttcgggaacgaggtttggaaagagaatggtaaattttatttatatagtttatcgggcgtttttttaagcggtaaatagttttgtttttcgttttttcggaaaagtgtttcgtttgtaatttttagacgtggtttttacgtacgaagtttttgtttaaaggggttagatgaggttatttgttagcgatattttggcggatatttttttaaggtcggtttgttatttgtttcgttattttttcggggaagtacgaaaataatcgaagtttggtttttaaaagaagtgggggttggggagtggtggtgggggtgttcgaggttagatggggtcgtaagagttcgcgagtgttttagtttgtcggataggttgagttagagtttcggagagtgggagggaagaaggaggcggcgagcgggaagaggaagaagacgtaggtagcgttaggcgagtttaggggcgtcgggagcgcggagttcgggttacggattcgcgggagtttattgcgttttcgggttttggagggttgtttttgttcgtaggttcgggcgttttcgttaggaggcgatagcgttatgtttttttaggttttcggcgtttcgagatttttgggtagatggggacgtattttttagaaattgagtcgggtcgtttaggggcgagggaacgtgcgcgggtaaggttgtttaatttttagggttttttatgttttttttgcgtttcgacgtgcgagaatattgtttttggtagtgtagggcgtttttatttattatttttttcggttgggttcggttagtagggagggtcgttttgtgcgcgcgttttttttttattttttagggcggcgtagggtggcgggttttgtttttcgagcgtcgttcgttcggaggtttttgtttcgagggcgtggaagggagggtttcgggggcgggggaggtgcgtatttttcgcgtcgcgtattttattcgcgtttgtcgcgttgttatttttagtagtttttgcgttatgggcgggttttacgagatagttttgtatcgggcgttcggttttttcgtttcgggttttggttttttcgtttcgggtttcggttacggatttttttggtttaagatttagggttcggatttggcgtttttaagcgtttcgggtttgggagtagcgtttagattttcgtcgtcgggttttgagaattcgtttttttaggttttttattagattttttttttttttcgtattttttgtttataacgaaattttcggggcgtattgttttcgggtatttttcgattttgggtaagtttcgtcgggcggggtgcggttggtttttcggggttttttgcgtagttcggcgatgtcggttagttcgtagtagcggggtttcgtattaacggggttttttgtttttttttttttttttaggatcgttacgacgggagtagtaatgggaattcgcgggttttttatttttttttcgtcgggtagtatttttatagtttcgcgttattttttttttatattggagtcgtcgaatattagtcgttattttattttttttttttttattagtagttggtttatttttagtcggtcgatttttattcgtatttgggggaagcgtacgtcgtcgttattaattttttgtattagtcggcgtttataggtagttagtagtaggtttggttcggtcgttagagttaggagggagcggggttgttttcgtattacgggcgttcggtcggtttattgttttattttttcgggttggaggcgggcgcggtgagcgttcgtagggatgtttatcgtcgtttcgatttgttgttgttttacgtatacgttttggatgtcgcgggtttggtcgagaatttggggttttacgatatgttttattagatggacgaggtgtaggtgagcggcgttgcggtttttgatcggatttgtttattttacg

SEQ ID NO: 11143 - DNA, 6511 bp, synthetic construct; identical to SEQ ID NO: 11142
  misc_feature 1..6511: note = Description of Artificial Sequence: Synthetic polynucleotide
  source 1..6511: mol_type = other DNA

SEQ ID NO: 11144 - DNA, 338 bp, synthetic construct
  misc_feature 1..338: note = Description of Artificial Sequence: Synthetic polynucleotide
  source 1..338: mol_type = other DNA
tcgtttttcgcgtatgcgtttaggtcggttcgtaggtttttttcgttttagtcggtagttagttcgttcgcgttggggttatcgcgagtcggttcgtagcggggttatcgcgattttcggcgtagatatagaggtcgtttttagtttcgtcgtttcgtggtttcgttttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcgcggattggaggttttcg

SEQ ID NO: 11145 - DNA, 936 bp, synthetic construct
  misc_feature 1..936: note = Description of Artificial Sequence: Synthetic polynucleotide
  source 1..936: mol_type = other DNA
gcgttttgttcgtttattgggtttttcgtcggtttatttgtatggttcgaggggggcggggttgacgtcgcgttgggaatgttttggtcgagatattgaggtagggtagagagcgtttgcgggcgtcgggcggagttgttgcggattaggattcgagtcgattttcgatttcgatttagattttaattcgcgttttcgtttcgtcgtcgtcgttatgtacgacgtagagcgcggttggagtttgtttttcgcgggttgcggttttttgggtttttattacgtcggggcgattcgttgtttgagcgagtacgtttcgtatttttttcgcgacgcgcgtatgttgttcggcgtttcggtcggggcgttgtattgcgtcggcgtttttttcggtatttcgttgggtgcgtttggggacgttgttcgggttttacgtgcggagtgggtgttttttaggtcggggagcgggggatttttaggggtcgcggggttttggaggagcgggtatcggacgcggatacggcggggtgtatttcgagggtttttttcgaggtagatgttttttgcgggggcgttgtttttgggttcgggaagggggcgttggaatttcgagcggttcgggtcgaagtttgggattttcgtgcgtttttatttttatttttattaggcgttcgtgtatgaagggagatttttattttcggattgagagtcggagcgtttcggagcgacggggagtagggagcgggattcggggcggagggtagtgttggtttttgcggatttcgggttttttgtgttttttcgggaggggttggacgggttgagttgtcgaggggtcgatttgttttgggtcggataaagagtggggttttggtcggttttttacggtgggttttttttttttggggattgagggatttaagatatttcgcgtttgcg

SEQ ID NO: 11146 - DNA, 2184 bp, synthetic construct
  misc_feature 1..2184: note = Description of Artificial Sequence: Synthetic polynucleotide
  source 1..2184: mol_type = other DNA
gcgcgtttttttaatttttttgcgttttagttttttcggttttagtattttcgtgatttgagtatcggcgggtttttgtttattgtttagtattcgacgtatttgttttcgtcgcgtagtttttttttttcggtttgagtttttttttcggcgcgtattgtttttgtgatttttttttttttcggttatagatgtagttttcggttagaagttttattttttcgaggttttcgtttttgttaggtagtttttttgcggcgtcgtttatttagagttttttttttggacgtttttttagtgtttttttagtagtttcggcggttttttttttatttttagtttttttttcggttttttaggaaggggttagattttagtttagtatttagcgttttttggttttttttttttgggcgttttttcgatagttttttttagggaagttggttcgttgcgcgtttttattttcggtcgtcgtttggatagaggcgcgtaattcggagggcgtaggtttcggttcggagaagggggtgtcgtcggcgtttcgattttttaggaatggggaaatagaggtacggtggattcggcggcggggttgggtttggggttggacgttgatttaggatttcgtttttgttcgttttgcgtcgcgtttttttcgggtcggttttgatcgagtagttttacgcgggttcggggttcgtttattcgataggagcggggggttgtagtttacgagtttacgagttcgtagcgacgtattcggagtgtaatttcgtagagttacggagatattttttcggtgtgggcgtttcgtcgcgtttttttttcgcgggttgcggttattttagggtaggatagagtcgagatgttcgggtgggagcgatgttcgcgtgggggcgatgtaacgggggagatgtttggggggagggtggtaaggtgaaatttggtggagaataatgggggtgggtgggcgatttttggggaggtgttcggtgtggggtgtttttggttcgttcggggatagtgcgcgttttttcgttcgcggcgttcgttttgttcgttttatcgaggtttttcgggagcgtttgggtttacggtttcggggggttttttcgagatttgggcgttgttttgggggagtaggggttcgggttattaaggttcgtgcggatcgtggggtgttttacgtttaggtcgggggattttagagtttcgttttttttaagggcgtcgcgtttcggattgtaggtggagacggggatcggtttcgcggggtcgtcgataggcgcggggcgggatagggtgggaggcggcggggcgtagagtttttcggtcgtcggcgcgattcgggtatttttttggaggcggcgggagcgcggtcgcggcgttttcggggtggggtttaggttggaggtttcggggcgtatcgttttagttttatttcggtcgggttttcgcgttgtttttgcggagagggaggaaggaaggaaggtagggagggaggggacggtcggtaggcgtggggttcgcggcgttagggtttttttttttcgttcgttttattttgtaattcgtagttcgggcggggtttcgttgtttttttttcgaatatagtcgtttttttttttttttttaatttcgagcgttttttttttcgaatgcgggagtttatagtgtacgggaagtttttttttttttttatcgaggttgttcgacgttttttttatttttcgatttttcgtaattattttttaaatgtttcggcggttagtagggttggggtgggcgtaggagaattaggggttttgttcgtatgtaggggtttggggtcggtgtggtcgaatgaacgcgcgggtttagacgagtttgtgatgttttcgttttttattttttcgcgatttggttttagaagatagtttgagaggtcggtggtcgcggattttggacgcgttttttttttgtttgtggtttttttttatttcggtagcgttgtgagtttattttttatttataggagttatatttagaatttttttttggggttatagcgtgggttttcgatatttgtgtgattttagttttgtttttttagggttgcgtggtgaagtttttaggatttttcgcgtgggttgggcgggtgacgtggatgagggataacgtggtgaggttttcgtcgtggcg

SEQ ID NO: 11147 - DNA, 413 bp, synthetic construct
  misc_feature 1..413: note = Description of Artificial Sequence: Synthetic polynucleotide
  source 1..413: mol_type = other DNA
tcggggcgtgggagttgcgttcgtttttttttttcggcgtttcgtggagatcgggaggtttagcgttttttttagtttttagcgtcgtttttttagattttagagacgtcggttagggcgcggcgtttcgggttattgcgggtttttttcgggcgggcgacgtggggggcgaggtatcgcgcggcggcgtttggcgggtattgttgttcgcggagggacggtgggggggttttagtagttggcgggggtggagggggcgggagagggagtttgcgtcgggttgagtttggaggtgcggggcgggttcggggagcgtttttggggttttttttgttatagtcggggcggttggaattttttttttttttttttttatttttttattttttttgttcggtttcgtcgttaggtcg

SEQ ID NO: 11148 - DNA, 403 bp, synthetic construct
  misc_feature 1..403: note = Description of Artificial Sequence: Synthetic polynucleotide
  source 1..403: mol_type = other DNA
tcgtttagtttttgcgttcggaagaaaatttagcgtaggtcgggtttcggcgcgcggaagttttgcgaattttaaatgtgtgcgttgagtcgaggtttttaagcggtaggagagaatttgattttcgatattttttttaagatacgcgtcggtggatcgggttttgggattggtttattttcgggttggattttggggttcgtatatttgaaagcgtaaatttgaggaatgacggcggggtgatgggtattttatagagtgggatttaatcgtgtttagtaatagatttttttaaatttttttttaaaaagagttttttagagttgtcgaaattttcgcggggtgaaagttaaatttttggagtcgttgtgtagtcgggtagaggatacggcggcgcgagtcg

SEQ ID NO: 11149 - DNA, 675 bp, synthetic construct
  misc_feature 1..675: note = Description of Artificial Sequence: Synthetic polynucleotide
  source 1..675: mol_type = other DNA
tcgtttttaaacgtacgattatttttttagttttttagtattaaatttagcggttttattcggttacgtttttacgttaggttatgatttttatatggtttattgcgtaagtttatatttagttttaggaagcgagttttacgtcgttttagttttgtatttatagtcgttaagcggtttcggaagtcgaatgtcggataggttaaagatagcgtcgttgtttcggtattgtcgttagagggcgcggagtcgtcgtgttggtttgtattttttttgttacgttagtcgaacggttacggtaatggaggattttgtcgtatgcgacgataggatgattgttttttttgaagttttattaaatacggagaggtttttttgtttttgggagacgcggtgatgtgacgtagcggttgtagcgaaggttttttgtaaaagatggtcgttgcggagttgttaggtgttttttggtaggcggcggtcgtattataagatggcggttcgttttagggttttatacgcggggttgcggaggcggcggtttcgagggttttcgttttttgttggttttgttttcgcgtgcggggttgcgatttgtttttgtgtgcgggtggaagtgcgggtcgttttggggtcgagttgtaatttcgcgatattttattggagtgcgatgagacg

SEQ ID NO: 11150 - DNA, 580 bp, synthetic construct
  misc_feature 1..580: note = Description of Artificial Sequence: Synthetic polynucleotide
  source 1..580: mol_type = other DNA
gcggtggtcgaggacgttttttttggcgttcgggggtatcggatcgcggttcgtcgggatggaggtaggtaggtagcgtttcgggagggttttagggagcggttcggagttgttcggcggggcgtttagggcgtagcgggtagcgtttatcgagggcgcgtaggtatttttcgaaattttcgttgattaatattttttagtatttagtgaagtcgattggtatttcggggagtgattggagttagttggttataagcgggcgggacggttggagattgtcgggatagcggttgtcggtgttacgcgggtggtgggcggttcggaaatgagcgtttttcggggatagggggttttgcggggcggcgatagttggatttttagcgcgtataaagtttgcgggaggatttattgtagcggtcgttttttttcgtttagcgagggcgggcgtaggggcgggggatgtcgaagggttaggtttgtttaggtcgcgttattttcgttttagacgtttagttcgttttttttataaaggaagaggagatcggagacgggacgtttgttttgttggtcgaatttttcg

SEQ ID NO: 11151 - DNA, 858 bp, synthetic construct
  misc_feature 1..858: note = Description of Artificial Sequence: Synthetic polynucleotide
  source 1..858: mol_type = other DNA
tcgggtacgttgagtttatcgagaattttaaggagttaacgagggcgggtgtttttatatttttttagggattagcgtcgttcgatcgtaattttggggaagatttcggcggttttggagaggagggataggtttttattatttatttggttagtttcgcggaagggttggtggatgaatgaattgttttttcgtcggtcgagtttcgcgggatagcggcggatcgcggggtgtttatttgtggggatgttcgagggttttttcgagttcgtatttagatagggattttaggggtggaggacgagcgttaggagtagtagttgaggttttatcgtgtatttttttatattcggttttcgagggtcgcgcgggtttaggcgtttacggtttcgtagcgtcgcgtttttcgcgagaacgtagagattcgggttcgttttgagtcgtcgattgcgggcgggagtcggcgggtaaggcgcgcggtcggtagtcggagcggcgcgtaacgtagttgagtgaggtcgtcggtggaggtacggagtagtaggcgttcggggcgttgcggaggttttataggtttttcgaggggaggcgacggggcgggtcgcgttttggttattggtcgtcggttgattcgtcgtcgttgcgcgttcggtgcggtcgttttagttcgtttttttgggttttacgtttggattgtttgtttagcgcggacgttatttaaggagttgtttgcggttacgtgtggaggtttacgtagcgtttttggttggaacggggaagtttgtatttagttttgggagtgggtttgggagagggaggaggagtcgtcgggagtttggcgggagggcggtgttttcg

SEQ ID NO: 11152 - DNA, 5715 bp, synthetic construct
  misc_feature 1..5715: note = Description of Artificial Sequence: Synthetic polynucleotide
  source 1..5715: mol_type = other DNA
tcgggattcggtttttcgtattcgtcgtcggtgttgtcgacgtttatagcgttgatgagattttcgaggtttcgggttcggttttaggagtttttgtttttcggttgaggaagcggcggcggcggcggttgcggttggggtggtagttcgggttttttttttacgtcgatggcgatgtagttgagattattttggaagtcggtagaggtttttttgcgtatgggcgatttatcgtttttaggataatcgattaagttttcgggttgattcggggtttacggtcggttttgcggtgttaaagggggcgtcggttgtaattgtcgtggggaggtgggcggttcgtcgttttttttagggtcgatatttacgtcgttttcgttgttttttttgagagagatattttttacggaggtcgagttgtggcgtttggggttgtgggcgaaggacggggatacgggggtgatcgtcgtggtggaggagaaggtttcggaattgtggcggcggcggtttttttgcgggtttgcgcggatgattttggcgtcgcggtgggggttcgggggttggttggtttgtaggaaggtttcgattttcgatatttgttttatgaggtttagtttttttacgttcgacgtcgggttggttacgcgggtagtttttggtttcgggggggtcgcgataggttgcggcggggtggcggttatattaaaagttatttcggtgtagttattattgttttcggtgttcgaggataacgatgaggcggcgttcgggttttgggcggtggtaacggtcgaggcggggggtaggcggtatagttttttcggggtcggcggcggtggcggcggttgtagagacgacgacggggacgcggacggacgcgggggtaacggcggatacggggaggaggtttcgggggataggaggtcgtttaaggagtttacggggtggtcgttcggggcgttcggtttaggagatttgggggagttgaagtcgaggtttatgtagtcggagagcggagatcgttgtcggttgtcgttgttggtgttcggggtgtttgagtttagcgacgaggtcgggttgttggcggataagagcgaggaggacgaggtcgtcgacgttagtaggggaggcgcgggcggcgataggcgggtttcgggttcgttaaagtcgatgttgatgtattcgtcggggtttttgggtttcggtggtagtgggtattcgtgtatgttgggtaggttgggtagtttttttagggataggcgcgtgggttttatcgttcggtcgcgttggtttaagaagtttttcgggcggtcgtcgttaggtcgtacgggcgaaggtattatagggtgagggggttgcgtggggtcggtttcgaaggcgttggtcgtttggttgggttttggcgtggtttgaggttttagacgttttttttttaggatgcgttttacgggggagtttatgagtacgtattggtcgttgttttcgttataggtgtagggggttttgtaggagcggggtaaggagttgtagtagtagtcgggaacgtttttgagcggtttttcgtcggggtgtagggttgcggagaagaagtcgggcggggtgttcgtggtgatcgcgtcgttgggggatacgttgaggtagttttcgttgggtagtagtttgttatttgtatgttttatggatagtttggaatcgtattatatgcgtatgtatttattgttttcgggggagttttcggcgggcgagttggttttgtagtcgttttcgttcgtcgggaatgttttgttcgtcgtagaggtgggtgttggtttcgtaggtttcgtagaaggtacggcggcggcggcggcggcggcggttttgggttgtaagatttgtttgggggcggatacgttggcggggtttatgggtatgtagtcgtcgtttttgtagttgtcgtttttattgttcgcgagggtcgcgtcgggcgttatgggtatgtagtcgtcgtttgtttttaggttgttgttggagtttttgtgggagtcgatttcgatgttttcgtagttttttgggtaggggtggtaggttattttgggagaggacgcggggtaggacgggtagaggcggttcgcgttgttcgagaaggtggttcgtattagggtgtatttatttagcgaggtagaggagggttggggtatcggtcgttgtcgggttggcgtggttagggagtaggtttttttgcgtagttttcggtttaggttttgggtcgcgtttttcgagattcggcggtaggagcggttatagtggtttaggggtttgtttatggttatgtattcgtagaatttatcgtcgtcgtcgtcgtttcgggtcgggggcgttttcgcgatggattcgggcgtgttgtttcggtggttgtagaaggcgcgtaggtcgtttgggttggagtcgtattcgtttagggatatgaagtcggggtcgttgggggagttcgaggcggaggcgttgtcgttggagggtcgttggtcggggtcgtggtgtagcggatgcggtagaggcgggtgcgggtcgggcggcggcgggtaggagttcgagtcgtggtcgttgttggacgatagggagtcggggttggtggcggcgggcggcgagtgcgttacgggtatggatatggagcggttgtgttgtagcgcgttttttgtcggtagtagcgttattttgttttcgcggtcgtcgtagtcgtcgtttagggtgtgcgagcggtttaggggcgcgcgtatcggttcggggtttagggggtttttagttatcgatatcggtttggcgttcgcggtcgtcgttttcgtcgtcgcgtcgtcgtcgttttcgttggcggtgcgtattcggtacgagttgtatttggtcgtcggcggggtggcggttaggttgtcggtgcgcgagcggcgtattaggttcgtttggttggggggtaggttgattaggtggtggtggcggcgcgcgtcggggacgttgatggggtgcgtggtcgacgatttcgacgattggtttttattgcgcggtcggaattcgaagagttttttgagcgtttttatggtttttaggatggtttcgtggatgttttgcgttattatcgagtcgttcgtttgtatttatagttcgtcggggtttgtgacggtcgagcggtttatttcgatgaagaagaagttgttcgagtggtcgtagcggcggatgtttatgagttgtagcgttatcgacggttgttcgtagttgagttttacgaagtcgatggtgcgcgtagataggtatagacggtatattttcgttaggtttttgttttggtttagatttttgggttttaggtttatttgttatattttacggtaggcggtcgtggcgggagttattagttcgtagttgttttcggtttcggcggcgtcggtagagtcgtttagggcgtcgggtagggaggcgttgtaggacgcggcgggcgcggcggcggggggcgcgttttcggcggtcgcgcggttttcgttgattaggtcggtgagcgcgcggtattagtttttttgtttttgttcgttttcggcggttacggcgaagtattcgtttttggtgtagagggcgattaggtatttgtgtttggcgtcggcgcgtttgttgatgtttaggtagtagtcgagagcgattattcgtttcggcgcgtttgttttgtttcgttattttttttcgttttcgtagtattcgagtcgcggcggttgcggcgtcgatttttcgttcgtcgtcgtttcgtcgtcgttcgcgtcgggttcgcgtagtacgaagaagcgtttgtggttatgtttttgtttgcgtaggtagtcgtatttgcgtacgttgtggttgttgttgttgttgttgttgttgaggttggggtcgttttcgttcgtcggttcgggcggttcgtgtcgcggcgggttcgttatcgcgggcgttttaggtcgcgcggttcgggttcggcgtttaggggttggggcgaggggcggagggggcgcgggcgggggcggtttttttttatttttgcgttcggtcgttcgttcgattacgcgtttttcgggtttaggcggtggggaaggttcggggaggttcgcgggggttagtatcgttcggcggcgtcgcgtttttcgcgttttggggtttttgaggatgttcggcgcgggcggtggtcgttttttttttcggttgtttgcggtcgttgttttttcgggttttcgggcggcgtcgggggacgcgttcgttgggtcgggagtcggggttttcgagtcgcggggtcgagtttaaggcgcgcgcggtcgtatcggggttgttgtcgtcgcgtcgcgtttcgggaagtcggggtgcgttcgggcgttcggggttcgcgtcgtcgtcggggttgttgttgttgttggtgttgttgttgttgttgttaacggcgattcgggttcgtcgcggttttcgtcgtatagtgagtaatatatcgcgtatcgagtgattgaattaagaagagtaaaataatatgtgattcggcgttacgtaggtatatatagcgcggtcgtttcgtttcgttgtttcgtattggcgtcgcgtttttcgacggacggcgcgttcggttaatcggcgcggcgttcgcgggggcgggtcgcgcgttttcgtttcgttttttttttttttcgggtcgcgtttttcgtcgttttttttttttttcgcgaaggtttcggttcggtcgggcggggtggggcggtttcggttttattaattagcggtttgttgtggatgtcggcggaggagatgttatttagggcgggaaaaggggcgcggaagaggggcggggcgggttacggcgcgtagggtttttttttttcgtttcggatttaattaattgggtttgagtttttgtcggggagggggcgtcgggcggggtcgcggttgggcggggcgggggatcgggatcggcggcgggggttgcggttttgtagtggaagtatgggcggcgagtcgggtcgtgttttcggggcgcggggtttttattttgggcgagggcggtcgttttcgcgttcggggtgggcgcgttttattttcgtttttcgtttttcgttttcgtttttcggtcgtattttcgttttttcgtagtcgcgaaacgcggggaggttttagggttcgcggtcgcgggttcgcgagtatcgcgttttagatcgagagcggcgcgcgttttttcgtggaggatagaggggcgcggagggggcgtttgtgttttattcgttcgcgggcgttttacggggcgttttttgcgttatttatttgttagtttgtcgggaagttgaaatcgcgtttgggaggtaataggagaaagagatcggggacggtaggcggagaaagtgcggtttttatagcgtcggggagagggcggattcgcgagttagcggtttttgagtcgggagatcgcgcgggcgtttttttagttttcgtaggagcgtcgtttttttttcgtaggggcgttttttttttttatcgttgtaggagtattttttttttttttcggaagcgtttttttattatatcgttttaagagtttttttttttttttataggggcgtttttttttttttcgaggtaggagcgttttttttttttttataggagcgttttttttattttaggagcgttttgcgtttagtagacgggtaggtgggcgggcgtttattatttgtgtgcgcggtgcgggcg

SEQ ID NO: 11153 - DNA, 858 bp, synthetic construct; identical to SEQ ID NO: 11151
  misc_feature 1..858: note = Description of Artificial Sequence: Synthetic polynucleotide
  source 1..858: mol_type = other DNA

SEQ ID NO: 11154 - DNA, 247 bp, synthetic construct
  misc_feature 1..247: note = Description of Artificial Sequence: Synthetic polynucleotide
  source 1..247: mol_type = other DNA
tcggaattttcggggaggattaacgtcggcgtatcgtgcggtcggggcggggcgtcgtttaaatttaggttttgtgatagcgattgtggcggtttggaaagcgtgggtttcggttattgggtacgagcggttacgtgatagcgggtttttttaggttagcgttggtggttgagtgatgtaattacgtggggtttgaagttttcgtgggtgtaggttttttcgttatgttgacgataggtagtgttcg

SEQ ID NO: 11155 - DNA, 224 bp, synthetic construct
  misc_feature 1..224: note = Description of Artificial Sequence: Synthetic polynucleotide
  source 1..224: mol_type = other DNA
acgttcgtttttttttcgggtagttttttttatttaggcgggatttgggttttcgttggatttagggtcgttttttcgtaggcggggtcggttcggcgcgtattttgtttcggatgttttggcgtacggtttcgcgtttcgtttttattttggcgtatttggttttgcgtttttttttcgtttggcgtagcgttttttgtcgtttttttttttttttggcggcg

SEQ ID NO: 11156 - DNA, 1174 bp, synthetic construct
  misc_feature 1..1174: note = Description of Artificial Sequence: Synthetic polynucleotide
  source 1..1174: mol_type = other DNA
gcggcgaattaaagagtagggaattataaaagacggtcggcggcgagtaggttggggtgacggggatttcgtggataacgggtttgaggacgtttagggttttagttttttttaggcgtttttcgtcggggtaacgtagagtagttgtcgtttttttcgcgttttagtagatggtggtgttagttcggtttcgtgttcggtcgtcgttgcgttcgcgtttttttttttcgtagatggtttaattagggttttcgttcgttttttcgcggttttcgtttcgcgcgtttgggcgagcgttgcgaacgtggagttaggtagttaagtgttattgcgtatagtaggtagtttggtaattgagagtataatatcgagtagatggtgttcgtacggcgtgatggatattatatacgatagtttgagataatttaggaattttttggtgattcgaggttttttttgtataaaatgagttttttttttattgtcgtgtatttttggggttatttgtttttttttttcgattgatattgaattggttttttattatcgattttttttttagtcggaggggaggaagaatttaagtgggggagggcgcgggaaggggacgtggagggaaacggaagggttgggagtggggtaggggggtagtggcgattttcggggggggagggtggcggatattagattttagggtcgatagttcgggagggatcgggttttaggattttagttgtataaagtcggttcggggagggggcgataaggagcgagtttcgggtcggttcggtatcgttgtttcggtttagagtttttgtaatcgtttggtttacgaataatttaaatgaaatttagggttttattgaaaaagttttttggggtttaatttagtttttcgattttagtttatatgtttataagtttttaggggatttcggttaggaagttaggagtggggttcgtgcgttttcggtaggatttagattgtttttcggcgtaggcggttttaataaagaagtttacgaggcggtttcgggcgcgggtaggggcggtgcggcggcgttcgggagattcgcgaggggttttggaggttttcggttcgcgcgcgtcgttcgggagttcgcgaggttgcggtgtgttttagcgggcgtattttttaggtttcgttatatcg

SEQ ID NO: 11157 - DNA, 8657 bp, synthetic construct
  misc_feature 1..8657: note = Description of Artificial Sequence: Synthetic polynucleotide
  source 1..8657: mol_type = other DNA
tcggattttttttcgggtttttcgggcgtttcgttttttcggggttggtttttttttttttttcgggcgtcgtcggtcgcgggtcgtttattttttttgggttcgtagtcgtcgttcggggatcggtagtgggattcgagcgggtgcgcgttcgttttgttcgcgtcgttggtcgtttttggcgcggtgtgtagggtttcgtcgggggtcgcggtcgtagagttgtatcgtaggagattttggttttgtagcgtcgcgtttaagttttcgtagtttgtgtagttgtcgtagaagggcgacgtgtagtagagggggcggtttagtagcggcgaggtagggtagggcgagttttttggcggtgtttcggttgaggtcggcgcggcggtcgcgggtagtttcggtggttcgtagttcgggtttaggttcggttgtttgaggttcgacgtggcgatttcggttagcgattatagtttgggtttgttggcggggggcggcgcgttcggagacgttcggttgttttggggcgttttgcggttatcgcggggcgcggtttcgggcggggggtttagtagcggcgtttttaagtcggtaagcggcgacgaggttacgggtttgggcggcgttaggtttcgttcgtttttttcgtcgtcgttttcgtcgttttttaggtcgttatatttgtttttgtatttcgagttcgattcgtatagggggttttcggcgcggtacggaagttttttttcgttcgattcggtcgagtacgagtgattcgtgagcgagtttacgtgtaggttgatttttgtgggggcgcgggtacggtgggtggtacgaggggatagcgtaggtatttggagtttttttcgttttttgttttgcggtattgggttttttttacgggattttttatttcgtttttattcggttacgtgataggcggagtttgattttttcgggaagggttcgaggaatcgttcgtttaaatttcggcgattttagggtaatgtggtgcggttggggtttcggttcggatttggggtgttcggcgggtaacgtttttttcgttttagttttgcgtttcgtttgggaagaaagcgtttcgagattttgcgtcggtcgttgttcgtttattttcgttttttgtcgaggttttcgtgtttttttgcgttttgtcgggattttcgtttttgtttttggtagcgtcgttttcgttttcgtttttattttcgtttttgtttttcggggtttaggttattttgtttttttttttgaggcgtcggcgcgcgttggcgaattaggtggagatttgggtgagggttattttggtgatgatggttagtatgattttttcgtttttggtggggtaggggtttttgcggtgttcgttgagttaggttttgagagtggtcgtggcgtttcgcgtggcgtttttgcggtacgcggggtcgttgagttggtacgggtaggtcgcgttgtcgtacgggtggtagttgatggcgtcggttatgtcggtggtgtgcgcgtcgtagggtgcgttttggaattaataagagtttgtgagtggagtatgcggagatttcgcgggtaattagttagaggatgttattttttcgttcgtttacggttatcgtttttttcgtgagtttggttttggggttgcgtttttcgtcgtaaaagagtaggaaaaacgtagtgtgattcgggattagttgttgattataaaaagtatcggagttttattttcgaatttttgaattattttatttttttaaaatgatttatttttttttaagtgtttcggagtcgttcgtggtaatgtatataaatttttgtacgtgcgcgtatataggtttataggtagttttttgatatttaaatttttgtagatgtttggagtgcggttgtttttttttatttttttttttttttttttatatggttaaaaaaatattttagagtttttaatttattatttattgttttaaagttgggtaaatttaatttgtaatttagaagttagttatcgtttcgaattttttaaatacgtcgtaattagtattttaatttattttttaacgtttaaattcgaggtatttgtagttttcgttaaggttttagcgattcggtcgttgtttagaaatttcgtcgagggtcggtagtcgcgataatttcgtaatggttttaatcgttcgtaacgtgtttcgtcgcggttcgggtttggtttagtttagtaatttcgagattcgcgagtcgtttttaggtcgtcggagtaggagttgcgttcgggttacggaggatttaggcggtttttagcgggttacgcgttcgtaagtacgatatttgaaagtatggttcgttggatagagtaaggtcgaaatttgggcgtttcgggtcggatttcggagtcgtagttgaatgttcggtttttgggtttaattcggtgatttttatcgttttgagtttcgcgagtgaatgcgaatcgttcggtcgtcggtttagaggtcgtagtgacgcggattttcgcgttttacgttaatgtaggcgagtatatagttcgtttcgaacgtttttttaggttgcggtgcggaaattagggataaacggcgttagatttcggtttcggcggagacgtattttttaggtttttagagaaaattagtcggcgagtcgaggggacgcgcggggggcgcgcgggtttcggtcgggtttagggacgttttcgtttgtcgcgttgttttttttattcggggttcggtttagtttgcggggcggttaatcgagtcggcgatttttgagtcgttagtcgcgttatattttcggcggttttcgttcgtcgaattcgagtttcgtttcgtttgagtttcgtttgggtttcggcgtttaggagtttcgcgtttcgttcgcgttcggttattatgtaggacgggaagtcggcggcggcggcggcggcgtcggtcgagtattgtagcgggttttcgaagtcggtggtcgtttgcgtcgtgaaggtcgtcgagttcgggtaggggttgaacgtcgagttcgacgtcgagcgcgttagtttttcgttgcgcggagtcgttaaagtcgacgcgtcgtaggtcgggtacgagtagagcgttagcgagtcgggcgtttggtataggtagttttgcgggtaggatatggtgggcgcggggcgcggggttcgcgttacgtcgagtagcgggtagggcgcgcggcgttttttatttacgttcggtcggggcgcggcgcggcggcgggtattcggacggtcggcggaggtaggtcggttcgggtattagtttgggcggttcgcgggtcggggcggcggcggggtggcggtggcggcggtagtagcgcggagtcggtgggcgtagtcgcgcgttaggtcggcggtcggggtttgggggagtttggagtcgggagtgaggagttgaggaaggagcgttcgagttttcgagggatattggaacgcgtagttgtttattacgcgtttatttgtatattcgggggttcgttttttttttgtttcgttcgttgtagttttcgggtcgcggttgggggaggggtagagagacgggagggaggcgggggagggcggaggcgacggaggcgggcggcgggagggatcggtaggtttttgtggcgtagtcgtttttttagtagtttcggttttagttcgcggttcgcggatttgtagtttagttcggtcgcgttgcgtgtttcggcgcgtattttttttatttttatttattcggagttacgttttttgttcggtttcggtcggtttttatcgttttcggttatcgttttcgtttttgttcggttttcgttttttttagttattatttcgtttttatttttttttttatttttatggattaggtagaggtcgttcgcggttaggttaggtcgggtttaattaggggatttatagtttgtttcgttgtgtatttcgaggaggttcggtttttgtgtttaattcggaagtcgtagggaagtggggaggttaggatggtggcgttcgcggttcgggttttttttcgggtagtgcgcgcggtttttatttttacggtttcggatttgttttgttttttggttcgaggtttttcgcgtggtttcgcgtttggtcgtttatttttcgcggtttatttcgtttagtatggatttggattcggggcgttttggttgcgaattgttaggagggttttgaggtgagttttttgtttttaaattcgtagcgtaattttcggggttttgaacgttacgattttttattgttgggaatgacgttagggttttagttaagaagacgtcgttttttaaagagttttattttattttgtttttttaagttgattttttttttagatttgtgttgttaaaatattggggggatgattgttatttgataaatcgtttttggtaggatttgaagttttttagttacgtcgagaacgggtaggagtttaggttggcgtcgtcggtgtagtgggtattataggtagtttaggtgacgcgcggttggagtaggggggcggttgttttgcggggtttagaagcgaggcggttggcgagggtttttaggattttagttttttagaattttttttttattacgtttttttaatttttttttattcggggatggtcgaagagggcgtttggttgtttatttcgaagggttatttatggggggcgtttagggggatggaagagtgttaggtttgtgttggtttattgggagtatttatttagtaggtgtttttattttcggaagtcgtttcgggtgggtgcggtggagaagagagagcgtagtggtttggggcgggttttagtttaggtttgtagtcgatttttgtatttttgttggttttgtagtttgcggagtagttttagtgattttaggacgtagggtatgttgcggtttttttgtggtgcggttgtagcggcgcggagggagcggagttcgggttgttagtttggtttagggcgtaagagaaatatttacggtattaggttgtttttttttaggtgtaagggaattagttgtaaattgtagtgttgtgtttgaggatggttttttttgagtcggtaggttttcggtaggcgcggtttaggtacgttatttttttcgttaggagttttcgagtcgagttattcgttttttattagttattttatttattttttcgtttatattgtttttttattattttttttataaattatatttttattttgtatatattttttttaggttattttaatatacgtatacgtatatatatttacgattatttttttttttatttatagatatttcgtttttataggttgggttttttgtaacgatttagcggggggttttaattttgttgcgattttatatgggatattttaatttagtttaggatagatatttttaattaattattatagagttgaaaaatagagagagagagaaagtagtcgggttgggtaagtcgtcgatagtttgcgatatttttgcgttttttgggagggaatttttttaagaagaggggtaaatgagaggtttatacgttggatggtaaatataaatattgttagattagatggtaatttttagggtttttttacgattagattagtttaaatgaaaaaaaaatcgggtgtaatttttattattagggagtattggtttggagtatttttatttttaaagagcggttttcgttgtggttttattagtatttggggtttatttttttttttttttttttgatttattttttttttttcgtcggatttttgttaggggtagaagagaaaatagttagttattatataaatatttttagtttggagttggagtgtttgttttggatatagtcgattttgatattaattaaatatataattagatacgtgtagtggcggggagggtttttttatttagggtgtatttttagaaacgtcgtttgtttttttttttttttagtttagtgttgggagtttgaagatggttttttttcgttttgtgtgtattttttttttagtaattatatttttttattgaaatttatatgttttatatcgttgttgtttgttattaataaaaatcgtttattttgtattattaaatagtcgatttttattatatgtcgtttttattggtagtgattgtagtaaattaaaatgtttacgtagggatattaaaaatttaatattcgttattgttattgaaatatataaattacgttttgttttaaagttttttgatattaaagaaaaaaattatattttttttttttaagttaaagttggtttggttttttttttaaaaaaaaaaaaaattaattatgagaaaatatgttgttagcgtggagttttggcgcggcggtttcggcgaggttgtttgagagggtggcgggtttagtttagatttcgtttcggggttacgagggttgtaaggtcgcggttttcgaagaggagggtttgggatgttttgtttaagggcgaggcggggtgtttaggtttgtggggtcgttggggagagttcggtatttggtttttgaggttttttagttgtcgttcgagtaggagggagggaatgagtaggtacgtagggaaaatttagtaattgttttgtaaacgcgatttttggttataataatttaggcgatgggggtagttttaggtttttggtgggttttgtttttttttttaggtgtgttttaggaggtggggaaaaaattaatattgtttttatttttttttattgtttttgtaatagttaaagaatttagaacgagtttacgtggatacgtaagttttagcgagcggggattttttgcgaggtcgagcgcgaggaatagtcggtttcggaggttcgggttcggggttttttcggggacgcggtcgattgagaaggtcggggcgttcgtcgggcgcggcgtcgtttttcgtgtcgcggggacggaaggaggcgacgtaggttaggagtcgtgcgcgcgggcggcgagggggcgttgtggttcgtgtttgtcggttcgagtttcggtaacggtgggcgcgatttattttttttttcggcggtttaattcggggaagaagaaaaaacggtatcgaggtattttaataaaatttaagcgatttttgatttttttttattgtggttttttatgagttttcggtgtttggcggggaaatagttatcgttcgggggtgtggtaaatttttttggtaattaagatgaaatagacgtttttatgtgggttttttttaatgaagtaatattggaaatgtaagtagttttagtgtattaaattatatcgttatcgtattcgcggttatcggttttttcgttttagggtttttcgcgtttgtcgagggagagagcgaggtaggaatagggggtcggggatatgagaagtttggttaagaaattttttttttttttgaaaataaaagcgttgttataaatggaataaaatttaagttaatatggaatttatattttttttaaacgtcgtttttaggtttagtattttgtgagtaggttggattggattttacgtttaatcggtatttttaggtttttaaagacgttttcgaggtttaaatgtttttttggaaaatacgtgtagaggagtattcgtggaagattgaaaggttttcgtagttttagttttggtaggatgtgtaaggtttttcgaggtttttaaatgggttttcgaggtttgggagattttcgagtagttacgcgggcgttattttagggacgcggggcggcggttattgtgggtcgggagggttttcgtacgggttgttttgagcgtttggattcgggattttgcgcgcgtttttttttttttttttcgttttttttttttttatttataatttatattttagggatttcgtatttagttaattagtttttgtttatttaattgttttgtttttagtttcggatttttgggaggtttttttatggttaatttgtttttttcggtattttttagcgttttgtaaaatttgttttttttttatagatgtttcgttttcgacgtgttttttgaagtttttttttcgtttagggtgtttataattttgaattttttagtatttcgtcgatttcgtttttattttttttttttttttaatttcgcgttggtttcgttttttttttttttttttttttttttacgcgtttcgttttttttttttaggtcgtattttttttcgttcgggtcgggagtttttcgtggttaggcgttcgcgcggtttaagatcgaggttcgttacgttgggtcgttcgtgggcggtttttattcggtatatcgtggaaacggcgcgtttcgttagttgcggttttagtttgggagggagcgtagcgcggggagtttgtagcgtttggagagtgaggaaaagggatattttttggaaatggatagagtcgagttttttaaagggatcgtagttgaaagagattttttttaaaattagtaacgatttggtagttttagttttttaataggagatggttcgaagatgaaatgtttgaaatttcgtcgtcgttttatttttgtatatacgcgtacggtaggtttagattcgtatagagacgtagatacgcgcgcgttcgcgtttttcggagaggtcggcgcgtttcg

SEQ ID NO: 11158 - DNA, 1059 bp, synthetic construct
  misc_feature 1..1059: note = Description of Artificial Sequence: Synthetic polynucleotide
  source 1..1059: mol_type = other DNA
tcggtttgttatcgttttttagggaacgagatattgttgagttggaagatttcgcgggttataggtatagtttttttgttgttggcggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgttggggtttcgggcggtacggggcgcgggtgggtcggttggtgagcgttatcgtgtttgttttcggtttgttttgggttttttattacgtagttaattttttgtaggcggtcgtagcgttggttttatcggaaggggttttggcgaagttgggcggagtcggttaggcggcgcgagcgggaattacggttttggttttttttagttttagcgttaattcggtgttttacgtttttatcgttggagatttgttgtttcgggtaggttttcgtttttttacgcggtttttcgaaggttttggggaggttcgagggggcggtcgttttagggaagggattatggagtttcgaattattttttagttgaaagtggtggggtagggtcgcggtaatggagattcggggggtgggatggagaaggacggttcg

SEQ ID NO: 11159 - DNA, 1663 bp, synthetic construct
  misc_feature 1..1663: note = Description of Artificial Sequence: Synthetic polynucleotide
  source 1..1663: mol_type = other DNA
tcgtttttcggttttcgtttttcgtttttcgggtggtgaacgtttgaagagggaggcgtggtttcgcgtattttgttttcggtcgcgttatcggtatttatttggttgttgtcgtgtttttcgttcgttttcggggttcgagatttcgcgggatttcgcgtcggttttgcgggaggaggcggcggttttagtagttgttttaggtaggcggtgttcggtagagaggagtttttttggtggtataagtgcgtttcggggttttgacgtcgtgtatttttatttcgggcgcggttttttttcgggggaggttggggtgaggaggatagggaggatgaggcggaggaagaggaaggagttgagtcgggggagcgttcgttaggaggcgtttttttcgttgttttcgaggtcgtcgcgggtttttttacggcggggagtaaatgttcgcggattcggcggcgtagcgtggatttttgttcggttttgtcggcgtcgtcgggttttaggggtttcggcgacgagtagtataggttgggttgcgaggaggagaagattcggtttagtatttgttttcgttttttgaagtcgttttatttgttgtttgtattattttttttggtcggtgtattttttgtgtttatcgggggtggcggggagggcgacggggtgttcgtagtgcggcgttttggatttttagcgcgttcgttttcgtcgtttttgtttttgtttatttttagttgtaggtttttttagagtcgggtttggaaggaggaggacgtcgtcggcggttttggttcgttcgtcgcggtagttcggggttttattttttattttttgttttttttttttttttttttttttttttttttttttgtttttttttttttttcggttgtattttttttcgggtttttgcggcgttggcggtggcggcggcggcggcggcgggcgtagtagtagaaatcgggagtgtttagcgattttaggttagttcgggggaaagaagcggtcgtcgtcgtcgaggttttttggtttcgggatttcggcgttgtttttttttttcgtatttgttggggtgggttggagtcgtaatcgaatttcggtcgcggcgtttgtaaagtttttttttcgaagtttcgcggttttagtttattggcgttttttaggtcgcgttttggtttttttttttttttgatcgagttcgggaagttgtacgtatcggggcgtgcgcgtttagttgcgttagggatcgtattcggcgttttttgggtagtatttgttagcggcgggggcggttgtttttaaattgggcgcgtacgcggtttatataataaggcgcgtttggttggagatttcggggattagtagtttttttggggcgtttcgggattattttttagtttttaggtgggagggtcggtaggagtcgggtggagttaggtagggttcgaagttagtttgttttttaggattcggttatagttgtttaggtagttcgttgtgcgttggtcgttggtcgcgttggcgatcgtttgggtcggatgaagcgagttggagtggaaattatgtgttttcgatgggtttcgtgggggcgtcgatcgtttatattgagcgatgaattcgacggagttttaaagttgaagacgtttgttttcgtttcgttgcg

SEQ ID NO: 11160 - DNA, 2065 bp, synthetic construct
  misc_feature 1..2065: note = Description of Artificial Sequence: Synthetic polynucleotide
  source 1..2065: mol_type = other DNA
gcggatcgcggcgtttttagggaatatatttatttagtaatcgagattagagttggagcgttgcgtttttaattttggggcgggcggggggcggcgggaatttttgtttcggttttttttgtatcgcgggggtagttgttatttgtaaggcgagcgcggcgcgggggatggaagtaggcgtttattggatagaatataaaggtagaaatttatttcgaaggtcggggttcggcggggcgttgggggtgggcgtttttcgcggttttcggcgtttttcgtttcgagacgtttcggtttagcggtattggcgcgatcgaggtttagtttcggggatacgttcggttggtcgcggggaaggtattaggtgagcgcggtcgcgtttttcggaatttcgttttcgcgcgtttcgcggcgacgcggcgtttattcgtttcgggagttaggaatttagggttttattatggcgttggtcgtcgtcgtcgtcgttgcggttgtcggggtgagttaggcggcggtgttgggttttttgtaggagtacggcgggaaggtgcgtaatttcgagttgttgagtcgttttaagtcgttgttcgatgtcggcgattcgcggggtcgcgtcgttcgtagggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcggagcgtttttgtttcgggagtttcgtttttggttcgggtgtcgcggttagtggagtcgttaggggatttgggtttgttaatagagttataggatatttcgggggggtcggttttcgagttcgtttagtcgttcggggagcggttcgtcgatttatcgtttttagtttttgagttagtttaggttatcgagagatttttcgtagacgcggttttatcgtttagggttttttttgaggcggtatcgttttgttttgattcgttagacgcggagttcgggttcggggtagcgaaagggtcgtcgtagtagaagttttgtatgttgtcggtgcgttgcgtttcggttttcgttacgtttcgttttcgggcggaggagttcggtttgcgtcggtagttgtcggaggagtcgagttcgcggagtttttttttgttgttgaggcggttttcggtggaagagttcggtttgggtttcggtttgggttcgggtcgtttttcgtatttgaggcgtttgtcgcgcgtcggttcgcgtttgttgagttttgacgtcgaggagttgttcgtcgcgtcgtcgtcgttcgcggtgtttttggagtcgttcgagtacgagtggttcgtgcggattgtcgggggtcgttggatttattagttgtacgggttgttgttgcgcgatcgcggtttggcggttaagcgcgattttatgtttggttttacggttttgtattgggtcgttaagagcggcgacggcgagatggcgttgtagttggtggaggtcgcgcggcgtagtggcgtattagtcgacgtgaacgtacgtttttacggcggttatacgtcgttgtatttggttgtattgtacggttacgaggacgttgtcgtgttgttggtggtgcgtttgggtgtttaggtgtacgtgcgtgattatagcgggcgtcgcgtttattagtatttgcggttcggtttttcgtacgcgttgcgtcgtttttttggcgatttaggtttgcgaggtattacggagttagatgcgatcggtggtggaagtggtagttttgttgttaggcgtttcgtataggtggtcgttattatttttagttttattattagtgtatttttgggcgttttggttgacgattttatgttttaggatttggttcgaggtttgaagaagtcgagtttttttagtaagtttttgagcgtttcgtttatggttttacgtaaaaagataaagattcgcggtggtttgttagtttttttagaaatttttcgtcgatttatttcg

SEQ ID NO: 11161 - DNA, 3487 bp, synthetic construct
  misc_feature 1..3487: note = Description of Artificial Sequence: Synthetic polynucleotide
  source 1..3487: mol_type = other DNA
tcgagagaaggtgagttcggcgggcgtagcgggttgggtgggtgtggttcgcggtttcgggaatagatttaaggtttcgttatcgtcggttagtagttcgatagttcgttcgtttggcgagcgtaggttttttttttagaaattgcgaggattcgagcgtattgtttgtgtattataaggttaagtcgggaagtggagtcggaggaggaggggcgaggaggcgaagggtggggagaggggcgtttcgttttttcgttatgtgttagtttttggaagttatttttcggtttttaatttttcggggtaatgggaaggaagagtaaggaggaaggggtcgtttcggggtaaaattttgttggggttaggatgtgtaattatttatttattcgtttattattgttttttttatttttcggaaatgcggggtagcgttaggcgttaggaggtattcgggaggggggagggggcgacgagtttaatggggattttttttacggatcgtttttttttttttgaggtcgtttataattttaagttttttcgttcggaatgttagttttttatttggagtgggtgcggggaggagggtcgcgttttttttttaagattcgcgttcgtttttttattttttttttgttagtattttttgtttatttttggtgttgtaaaacgttacgtaatttattcgattcgtattttaaaattagcgatttagaagtagggtttagggcgagggttttttagcgttggagtttcggggggcggggtgtttagtgtaaatttcgtttttttcgcgagtgtcgtttttaggttgttatttgtaaagaaacgtttttttgacgtagggagaaatggtaaattttaagtacgttattaatatggcgttaaaagatttttttaagtataagttcgtttttttttttttttaaggttgcggggggcgtcgttcgggtttggggcgcgtagggggcggggtgtgagtagaaagtgtgagtgaaagagtggaggggcggggtatgtgtgtgagtgtgtgaagtgtgagtagatttgatgggatttgtacgggcgtagtcgtcgttcgggttcggttttggggatagggcgggttaggggcgttttagagtttatggggagttcgggtttagggtgttagtaggcgtggtggtggggttgcgagggagggtattttttttttacggggttcgtaacgttatttggatttttcgtcggagttaaataattgggcggggggttgggggggcggcgacgggggtgtcgggagcggagattcgagtgaataagaaaaaagtggttattttttttttttcgttttttttgttcgtttttattttatttttattttaatatattttttttttttaaagagattataaggaagttttggtttaaaaagaaatagaaatatatatagggggttggtgaatggtgtcgatcgcggttatcgtagttggaggttattttttggggggggtgagtagcgtttatggagttattttgcgtttatttttagcggtatcggtttaggttttgcgggtcgatcgttttcggcggggggcgtggggtttgggacgtcgcgggttcggtcgtttttttcgtcgcgatttcggatggatgcgcgtttttcgttttttcgcgtcggttttaggagttttcggtttcgggagtatttttttcgcgtcggtttttgtagcggcgcgtagtcgagggtagcgttcgttaggggggtatcgcggagtaaggtaagatttagttttcggcggatgggttttgcgtatttttacgacgttatttggcgtttttgtaatagatttgttagcgtttttcgttttttcgtttttttttgttcgttcgtttttttttttttttgttggttgtttgttttaggaagttagcgcggagaggggggggatgtatagtataggggagagagattgcgtatgttggttagtcgtgttttaaagagtatagtgcggggaggttgagaggggcgtatgtaataataatttttggaagggtgagtttggcgattttttttattaatgattgcggtaaagcgttttcgggtcggcgagggggcgcgggcgggcgggggcgcgttagggttgtaattttttcgcgggtttcggtcgggcgtaggggttgcggcgggagatgggtacggtggggaggtcgagcggttcgggcgggggtttcgagaatttggagttatttgtttttttgttttttcgagttttattttgttgatacgtagtacgttcgggcgtcgaatcgggttgagtcggtgtatatgatttcgcgttgggtttacgtgtagtcggttcggttttagatatttttcgggggttatcgttttcgttttgtcgttttttttttcggttcggtgtacgcgggcgttgtacgcgggggtagtatgttcggtttttggggttggaggttttgtataaattagatagtttttttggaggggcgggggatattttttttaggtgagtgtggagggtgcggagtttcggcgttaggggtgaggattggggtcgggggtagtttttattttcggggtcgcgcggtagtttagttggggagaggcgttgggagagtggaaatgtatcggcggcggtcggagcggcgggtgcgcgttcgcggggcgacggtagggggcgtggtttttgtttatttttttttaattttgtcggttcgcgtttcgttttagggacggattcgtagtttttagttttttgtttagggttttgtattatgggtggtattaggaagatgtcggtttgtggcggatttcgtttgggacgtatatatttgatttttaaatgagtgatattgtagttttcgtttttatttagcgttgttgtagtttttttgtcggattttcggtttcgtttcgttttcggtagtggtattttttcggttttatttttttttttttttttttttttttttttttatttattcgtttgcgtttgcggagcggcgttcgttcgtttttttttcgtttgggtgtagatttgtggttttttatggttttttttcgtttatttttgggttttgagatatttttttttttcggttaagggacgagaggggttaatttggcgattcgtagttgttttgttagaggatggggttgtttgcgagatagttaggaaggttttattttagtttttagaggtttagttttgttttttattatatatagttattattttattcgtttttggggttcggttgtttttttcggtgttttttaaatttttttttcgatttgggtgttaagtttatttatttttcggcgtcgttttcggtcgaatagttttttgtttttttttcgtttgggtcggagtttttcgtagtttttttcggttttttttttcggtttcggcggtcggaattacgtcggcgcgtttttagtttgcggtttcgcggattgtttttaggggcgggttggaggcgcgcg

SEQ ID NO: 11162 - DNA, 847 bp, synthetic construct
  misc_feature 1..847: note = Description of Artificial Sequence: Synthetic polynucleotide
  source 1..847: mol_type = other DNA
tcgaggggaaaggacggatttggcgtttggggttttttcggtgggatttaggtgggtggttcgcgtggggtggggtaggggtatttataggcgtttagcgttgcgggggatgtttcgaggaatcgcgcggaggtttagttcgtggtagtttacgttggtagcggagtaggtatatttggtggggtaggcgacggttggaggtttatttaggacgttcgttagcgttaaggttagcgttaggcgggcgcgtacggcggcgtcgatttttgtttattcgggggttatggtgtgtagggtttcgtttttggaggaggttgtttttgcggggtaagacgcgtggagttcgaggaggcgcgcggggagcgcgggcggtttggggagcgggcggcggagttagcgcggaggaggggcgagttcggtgtttaggcgtacggggcgcgggcggagcggggcgtttcgggcggcggcggcggtagtaatagtagttttatcggcggggtcggcgttgtttcgttgcgtatcgttgggagtgtttaggtgcggagcgttttttggtttcgttggttcgcgggtcgggttggggatttggggcgagcgtaatggggcgtggcgttcggggaggttcggtttggggttgggttggggagcgcggcggttgcggttggggtacggggcggtcgggtgagttggtcggcgttcgttttttttatttagtgagtacggtagatatcggagacgcggggtttattttttcggttttttttcgattaagaaacgttaatttcgttttttattggttgcgtcgcgcgttatgtcgattaagttgggaattttgttggagcgatcg

SEQ ID NO: 11163 - DNA, 909 bp, synthetic construct
  misc_feature 1..909: note = Description of Artificial Sequence: Synthetic polynucleotide
  source 1..909: mol_type = other DNA
tcgtttagtatagacggggtattttcggtgcggtttgttatcgttttgtttggcgttggcgtttttagagaaggttatgtcgattttttttttatttcgttttagatttttttttttgagttgttttttttatagtttttttaggcgttattgagagtttttcgttttcgatgggtttggggcgtttggattttttcggggttattttgtcgtttttttttagtttttttttttattttttgtcgtcgttttttcgtttttttaggattttgcgtatttaggttggttttatgttttggggtattttagtagtgttttcgggttttcggttattcggtgacggagggagggagaggttggcgagggggcggcgttttaggttttagcgcgattcgttttttagtttttttcgtcggttatagtcgcgcgggacggggtagggatttcgagaatatcggggatttgcgggtcggtggtttcgggtaggttatttttgacgcgggtgcgaggtttttcgcgggcgtgtacggttgggtcggagtcgcgtcgggggtcgggatacgtttggggttagcgttggcgtcgtcgttcgggtggggtgggtcgggttcgggtttagttttttttttacgggcggttcgcgtttcgttttttagtgatttttatattttttgcgtttcgagttggaatttcggtaggttttgtttcgggtcgcgcgcgttttttggggattagggttgtggtttttgtttcgcgtcgtgtttttagatatcgtcgggcgttcgttttttatttttttttttttttttttatttcgcggttgacgagggtcgtttttaagtggttatgtttttcggtatggacgattttttagtgtttttgagggtttagggtttcgttttcgtttcg

SEQ ID NO: 11164 - DNA, 2150 bp, synthetic construct
  misc_feature 1..2150: note = Description of Artificial Sequence: Synthetic polynucleotide
  source 1..2150: mol_type = other DNA
acgtcgcgtttcgtcgttcgcgggttcgtcgggagattgcgggttcgtttcgcgggtggggcgtttcggtttttttcgttttttggaggttataggttacggcgacggcggtgatcgggagagtaggttgcgaggcgcgttttatcgggttatagataaattatttcggtagcggtcgcgtcggaattttttttaagttattaaattcgtttacgcgcgggagagtgttggggatgttttatgcgttcgcgattttagaagttaggagtgtgttatttttttatatatttattttcggttttgtacgtttttttttacggttcgagtttttgtaaatgtttggttagatcgaggtcgtcgagatgttcgttttagttttttttttcgtgggtatttagggtagttcgtgagcgtcgttcgtcgtcgtttttagcggcgtcgggttttcgaatattcgtcgggtgagcgaagtatagcggggttacggagcgtttcgacgcggggacggggagggtagtgttttttttataaattagttttttgggtgaagtttttggggtttggagattggagtgtagggtgtgtgtgtgtgtgtgtgtgtgtgtgtgttgtattttgattttatggaggatttgtgggagaggaggtgtaaggttttttttttagaagtttggcgtttttaggttttagttacgcgggacgtttttcgataattcgatttttcgttaggagagattcgatttaggtttgcgtcgcgaggtttttagttcgtttttttttgcgattttaaatttgggttttgatttttcgtcggtcgcggtggttcgggttattcggcggcggttgatagttgagcgtaaaggcgtcgcggttaaggttttcgcggagtagttcgggatgcgtacgtcgagggttaaggaggaggtcgttcggtttggagttgggatcgtaggttgggggtcgggatattcgggtttcgtcgggtcgggggtagggtcgcgggtttgatagttgttgcggttcgcgcggacgcgcgttttttgtagttcgttttttttatgtttgatttattattttttgttttttttttttttgttgttttaaaatatttttcgacgttagtaaaatataatgcgtttcggtcgtcgtaaatagtcgggagggagagtatatattcggcgcggcgcggtcgtcggttcggtttttatttttttttcgtttttagaaaatgttataaaagcgggtagggcgcggggagggcggttgcgcgttcggcggtcggggtttttttttcgcgtcgtttttttacgttttttcgttcgtttcgcgcgttcgtttttttcgtaaatttgtttcgttatttcgtttagcggcggggttcggggttcggggttcgggatttatttcgtcggagaattttgcgttttttttcgttttttttttttcgcgttttttcggttcgtagttttttttcggtagtcggcgaggtgggtagttcgtgggttatcgaaagttcgcggaggggacgcgtattatatggtagttcgtttttagtttttcgagtgcgttgggaagggggaggggaaggggcgaggggaggtcggggggaaagcgagagcggggcggcggcgggagtgggtaggcggggtggcgagggcggcggtcgtttacgttagcgttgtgcgatcgtagttcgggcgtgtacggtcgttgttgtcgttgttgttgttgttgttgttgttgaggcggcggcggttcggcgttgtttgtttcgcgtcgcgcggtttgcgtttttttcggaacgtttatatttttaatcgttatattgttgatattcggcgttgacgttattcgttttttatttataataattttacgggagtcgggtagcgtattttttcggtcgttggggcgcggtacgttcggcgattagcgtaagtcgtttcgcgaatggcgtttcgggggttggggcggggggcgggggacgggggcgggcgcgcgcgtttcgttggttcgcgggagggggcgcgttttatgtcgtcgtagtagtagattttttcgttttgtgcggtcgcgcggttcggagagtttttttttttcggttcggttgatcgtttcgttcggtttggttttttcggttacgaaagacg

SEQ ID NO: 11165 - DNA, 506 bp, synthetic construct
  misc_feature 1..506: note = Description of Artificial Sequence: Synthetic polynucleotide
  source 1..506: mol_type = other DNA
gcgttcgttgttttcgagtttcgggtttgagtgttggttggcggagatttatagtgggtgtttcgttttcggacgatgtttttgggtttttagatttagagtttcgggacgaaattgttttaggaagattcggaaggattcgtcggtcgcggtaagggataggcggtttttgagataggaggagttaggaaatgcggggtttggtggggtgaggagtacggggttttttttttattttcgcggggattttgttatcggtttagtgtggaggttttatcgtttcgttcggattcgtggggtttcgatagtgtggtttttgcgaggattttttttatttttttcgttttggggttgttgcgggagggcgttcgggtagtattaggttttgagtgtttagggttcggtaggggtttttcgttgtcgtttttttgatttcgtcgtttgcggtttagggttgttggttttttcgttggtttgggaggttttagtatggacgtcgtgaggcg

SEQ ID NO: 11166 - DNA, 1503 bp, synthetic construct
  misc_feature 1..1503: note = Description of Artificial Sequence: Synthetic polynucleotide
  source 1..1503: mol_type = other DNA
tcgagtgggacgaatttttcgttagttttgggtttttttatttgtcggttcgcggtcggcgtcggtataggcggagggcgtttttttttttttgcggttttaagttaagtggaagatttttttttaagttttttttttcgaagtttcgcgggtttttcgcgttttagttttagttatagtttgtggaggcggtatttcgaggttgggcgttcgtgcggcgttttggttttagtatttttcgtttcgaggttcggtttcgggggcgcggtcgttcgggttttcgtgtgttttagggggtttcgggtcgcgagtcgttgtcgaatggtttttgataaaaaaatttttgattattaaggttagtttttttttgaaagtttcgttcgtttcgatataggaagtagaagggagcgagagttttagagcgcggcggtagcggcggtttggtttttttagagggttagagttagggatatgcgggcgttcgggatttcgcgtttcgcgcggttcggcgtttgagcgttttcgtttttcgtttcggagttgtcggcggtatgattcgatacgtcggggcgttcgcgcgcggggattttacggggtaagttcgggcggtcgtttttttttttttcgcgatttttacggttcgcgttttggtcgttttattttattttttgttttagagagtttttcgggcgcgtgatttcggggttgtcgggttgatacgggatttttatcgtggtcgaggttagaatttggttttgcggggtagggggcggttttggtgatttcgttggattcgatgttggttaaatttttaaggttaggtattttattgggaatttagtgtatattttaggttgttggtggacggattacgagggagtgcgtcgttatttgttagcgtcggggttgttcgcgtggacgcggttttttttttggcgtttgtttcgtttgaattttgtaaataaaattcgcggttttagtttcgttagtttgttgtattcgttgttttgcgagtcgtagcgcgcgttttcgggtattagagtttcgttgggcgtggggtcggagattcggattttcgtaattttgggtgttcgcggtttaatagttgatcggtttttttggatcgagggtttattgggtttttttttcgtcgtttttttgttttggtcgtagacggtgattttcggatcggttttggtcgagtttagtgtttgggtagggtttagggcgtacgggttgcgcgcgggttgtggatgtatgacgtcgaatggtttgggaattgatttggagaggagttttcggtggttaagttttcgtttcgtttttttgtcgtttttagttttatttcgcgagttcgggtattgttcggggttgggttttgggagaaagttttttcgttttgtttagtttagagggcgttttgagaagttttaggtgttgtagagacgttcggtcggaggcggattttcggggaaagtttatttttgggtatttaggagcgcg

SEQ ID NO: 11167 - DNA, 907 bp, synthetic construct
  misc_feature 1..907: note = Description of Artificial Sequence: Synthetic polynucleotide
  source 1..907: mol_type = other DNA
tcggatcggtatagggggacggttagacgggatgtcggaagttaagggacgtagaggtcggcgggtggcggcgatggagaggatagattcggtttttagaggaggtcgtgagcgcggggtttgcgtcggtcggaggagggattcggggggttgtaatatggttgttcgggcgtcgttttttttttgttaagttagggttttggggagttgttgtcgtttttcgttcgggttggggcgaggaaaggaggggacggcgttgcggtttcggaatttgtattgcgattttggtagagtaaacgttgtatttgtagtttcgaattgaattttttgtttttttttttttttttttttggttacgttttttttttttttttttattattttattttaattggttttaaacgagggtgaaagttgagtttgaggatgtcgttgttatagaaattgtatagtaattaagggttggggaggcggggggggggggcggtaggttttttttttttatttttagtacgcgtatatttttttttatttttttagttcgtcgcgttttttcggagatttatatcgttatttttcgtcgtagaacgggagggataggaatacggacggagggatcgggacgaggggagggttttacgtagtatagttgtttttttgcggagcgtttaggagattcgggtatttttggaagcgttgcggattgagttgttcgcggttgttttcgtttcgagggtcgggatagtattttaggagaagagggacgaagagggacgatagataaatagttggggagaggcgggggggggcggttcgtggggttcgttgggttttatttagttttgttcggagttgttcgaaatagtatttaggtttttgcgggttaggatgaaaggtacgtgggtcg

SEQ ID NO: 11168 - DNA, 1925 bp, synthetic construct
  misc_feature 1..1925: note = Description of Artificial Sequence: Synthetic polynucleotide
  source 1..1925: mol_type = other DNA
tcgtcggttttaagtaggaaggcgttttcggtatattagttttttttagcgtttttagcgggttcggcgtttggagggttaaggcgggcgcgtttcgcgggtgggcggggggggggggacgggatcggtgtcgggagtttcgttgttttggcgttttttgggtttaggtttagtcgttttttgggtttttttcgcggggtcgttttcgttttttttttgtcgagacgggcgtggggtacggggtcgtcgttcggcggggagtttattcggcggcgtagacgtttcgcggtttcggggagggatttggtttgggtttcggtttcgcgtttttttggggaggagtcgagaggttgtagttggcggcggcggtttcgggcgggagggggttttaggaagcggttaggtcggagttttttattcggtcgtagttgttggtttggttagaatcgagcgcgttttttcggttttcgtcgtttttttttgtaaatcgcgggtaggaggagttttttttttagcgggttcggagtttagaggcgtcgcggggcgcggtcgaggggaggaggaaggagagcgggagcgtagtcggttcgggtttagtcgtgattcgtggggcggcggtttcgttaatttgtgggcgttgacgcggggggcggtttcgcggcgttcgatatttgttcgttcgggacgcggggcgtcgagaggttcggttaggcgggagttgcgttcggggcggtcgttgtatttgttcgggatttcgtcggtcgtttttcgcgtttatttttttcgtttttcgttttttttttttttttagtttcggtttttcgggcgcggcgtgagagtagagttcggttcggaggagtcgtttttttttcgttcgttcgttcggcgtttggagaggagcgcgttgaggatcgggacgtttgcggtcgtcgttatcgtttaggttcgtcgcgtttcggtcgggatggatttatacgttcgatgagtttcgcgtcggcggttgcgagcgtcgagtttttttttgttgcggttttagtcgtttttcgcgcgttcggtttcgcggattaggatttttgggtttttcggttgagggcgcggtcgtttcggagaggtcgagcggggacgggttcgagatggcgcggggatttagcgtttcggcggcgggcgttttgtacgcggttcgggttcggggatagtttcggagttggtagtcgttcggtatcgatggattttgattcgcgaggcggcgtcgcgttcgtgtttagttgtagttagaggggcgcgcgggtagaacgcgttttaggttcgggtcggttcgcgcggttatgaagatgatgttggtgcgtcggtttcgcgtgtttattttgatggtgtttttggtggtttgcgcgttgtatatcgttttggatttgttgtttaggttggagcgacgcggcgcgcggttttcgggggagttcggttgttcgtgcgcgtagttcgtcgtcgaggtggtcgcgttcggttgggtttaggttcggggtcgtttcggggagttttcggtcgtttttttcgtcgtcggcgacgcgggttggtttaataagtatacgtttcgtattttgtaggattttagtttcgattttttttttaatttttcgttttattcgttggagaaattgtcgttcgcggtcgagtcggtcgagcgcgttttgcgggggcgggatttcggcgttttaagattttacgatttcgcgtatcggtcgttgttgcgagatttcggttcgcgtcggttcgagtcgtttttcggtttcggcggagacgttttttttttggttaggttgttcgagtattcgttttatcgggtggcggtttcgtcgtttacggaggaggacgttttgtttaatgtgaatagcgatattaggtttagttttaaagcggcggagaattcg

SEQ ID NO: 11169 - DNA, 1287 bp, synthetic construct
  misc_feature 1..1287: note = Description of Artificial Sequence: Synthetic polynucleotide
  source 1..1287: mol_type = other DNA
tcgtggttcggaagtggattttgttcgacgcgggggtggtcgttggagggtcgaggatgtttatataggtttttggagggtgtgttttcggagtttgtttcgttttttggatttatgggggattagtaacgtcgttatatttttttttgtttttgttagtcgttttttcgttttttttttttggttgaggttggtaaaggtaggtaggtatgggggggcggggttttaggagggaggaggggttggtgggcggggtttacggatatttcgtttcgtttttagtggggtttcgtattttttatatttcgcggtttttttaggttagggttttttattatcgcgtttagaggtcgggttagtcgggcgtgtattttaggggcgtttcgtttttcgcggtttgggattttttagttaggatagtataaaatttttttatcgtttattttttgtaaaaaatcgtggttttcggcggattttggagataggaggtgtaaagggcgtttatacgcggttcgggttcgcggtcgagagttggggggatttggagcggggtcgggtcgtaagaagattttgattttgtttcggcgttggggcgcgtgttaagggttcgcggggtattagttgtattttcgaatttttgtgtttggtcggggagtttttaaggttttatttcgttttggagggggttgcggaagttcggaggtgattcgggttttgggaggggcgtttttaacgtgggggaagggagataggggttttcgaagatagcgcgagattcggagggggttttttcgatttaagacgtggtaaattgaggtcggcgaggagcgaggttgagttcggggattaggcggttttttattgttttttcggttcgtcgtttttttgcgtttgttcgtacgggtagggtcggcggtcgagtttagcgggttcggggttaggtttgggtttcgggggcggcgttttttttttcgcgtcgtttttatgttcgtttttcgcgtcgttttcgttcgagttgtttttttttaagtagtcgttatcgcgtattttgtgttggggtcgcgggatgcggggttggcgcggggttacgtttcgtcgtagtttttgttttattcgtaggtaggagatcgcggttattattagcgttattagtagtatcgttagtttagtttgggcgtaaggagagggatgttagggattcgcggtcgtttcgtttcgtatttttttcgtttatatttttcgttgagataggtttttttttttttcgggagtttttcgggttacgcg

SEQ ID NO: 11170 - DNA, 2906 bp, synthetic construct; identical to SEQ ID NO: 6464
  misc_feature 1..2906: note = Description of Artificial Sequence: Synthetic polynucleotide
  source 1..2906: mol_type = other DNA

SEQ ID NO: 11171 - DNA, 2146 bp, synthetic construct
  misc_feature 1..2146: note = Description of Artificial Sequence: Synthetic polynucleotide
  source 1..2146: mol_type = other DNA
tcgcgtgttaggaaaagttgtgaggttggaaatttcggagtaaggttcgattttggttagatttgtaggttgcggaatcgggggcgcgcgggcgtagcgtagtatagttcggttatggagtacgcggtggttttttgcgttttttatttagggattgagttcggggttgtcggggagagcgagagcgagggcgtcgcgttttcggcgtagatattttgtagtttcggcgcgtttttgtgttttagtttcggggaagagttttcgtcgtagtttttcgttttagcggcggaaggcgcggttattttttcgttttttagcggtggttcgcgggtggtggagcggtagtgggaggtcggtagcgcgggcgtcgcgttttcggaggagttcgcgttttttgaggagcgcgcgtgttcggaagagttcgcggcgtcgtttttcgaatcgcgcgtttggtttgaggatttcgcgtttttcgaggagttcggggagttcgcgttcgtattttcggggttcggggcggtgtacggggagtcggatttggtgttggaggtgtcggggcgtcggttgcgcgcgtataaggcggtgttggcggcgcgtagcgattattttcgcgcgcgcgcgtcgcgggacgtgttgcgggtgtagggagtgagtttgacggcgttgcggttgtttttcgtcgacgtttatagcgggcgtatggcgggcgtgcggttcgataacgtggtcgaggtggtggtcggcgcgcgtcgtttgtagttgttcggcgtcgcgtagcgcgttatcgacgtcgtggggtcgtagttgagtttggttaattgttacgaggttttgagcgcggttaagcggtagcggttgaacgagttgcgcgacgtcgtttattgttttatgagcgattattatttggaggtgttgcgcgagttcgtcgtgttcggtcgtttgtcgggcgtagagcgggatttgttgttgcgtcgtcgtttgcgcgtcggtcgcgtttattttttggtcgcggcgttcgggtcggcgggggagcgcgcgggtagtcggttttagagtttttcgggggacgcggacgcgcgcggggacgcggtcgtttattgtttttacgcggcggtcggagagtggcgcgagttgacgcggttgttcgagggcgcgtcggcgcggggttgcggtttgtgcgttttttataattattttttcgtggcgggcggcgtggcgttcgcgggtttcgacggtcgcgcgcgttcgttcgattaggttttttgttataattcggttacggatagttggagcgtcgtgaggtttttgcgttaggcgcgttcgtagttgcggttgttggttttggacggttatttttacgtcgtgggcggcgagtgtttgtttagcgtggagcgttacgattcgcgcgtcgatcgttgggttttcgtggcgtcgttgtttcggggcgttttcgtcgtggcgtatgaggttattatttgttacggcgagatttacgtgttcgggggtttttttttttatcgtttgtttaagtatgattcgcggcgcgacgagtggtaggagtgttcgtgtagtagtagtcgcgagcgttcggtcgatatggtggttttcgacggttttatttatcgtttcgatttgagcggtagtcgcggcgaggcgtaggcggcggggtcgagcggggttagcgtgtttcgatattattgtttggttaagtagtggagttcgtgcgtcgcgtttttgcgttttttcggcggttttacgggtttgtagttttttcgttgcgtcgttttggacggcgttatttattgcgtgagtcgcgcgggtatttggcgtttttagtttgttcgggaaggcgaggtcggcggcgacgtaggttagggcggcggtttcgaggcgttgggcgtttttttggacgttcggggtgtgtttatttcgttcgtttttagtttgtttgagaagtcgtttcgaggggagtagggcgtttcgtaggtcggcggggtcggcgggcgtttttttcggtaggggtttgcggggtttaggtttttttgggttcgcggaggaggacgtggtggggagtcggggtcgttggttacgttggtggtttggatatttcgaaggagtttcgaggacgtttttagggtcgttttcg

SEQ ID NO: 11172 - DNA, 865 bp, synthetic construct
  misc_feature 1..865: note = Description of Artificial Sequence: Synthetic polynucleotide
  source 1..865: mol_type = other DNA
gcgttttgcgttttttttttacgttatttgttagggagtcgttaaatagtaagatcgcgcgttttgcggttttagagtgcggatttcggtcgcgtgcggttttgatcgcgtcgttttatttttggcggggttacgtacggacgttatggttggcgtcgcggagtcgggcgatgcgcgcggattttttcggggttttgattgtttttgagttttttttgcggggggcgtgcgcggttcgtttttcgcggcgttacgcggttttttttcggtcggggattggtgcgttgggcggggcggggcggggcgggataaaggcgcggggtttggttgcgcggggtttgcgggtagttttaattttgggttcgtagtttgcgttgggtgcgtaggaaggttagtgtgggggtcgttcgatatttttttttcgcggaggtgggagtcgagttatattttggagtggggattggtcgcggagcgggttgtttagggtcggtcgaggtcggggcgagttttgcgcggcgttggagattttgtattttcgggcgcgcgtagggttttcggtcgtggtcgtagagttaggaggggcggtttcggagttcggcgcggggagggtttaggcgtagtcggggttggtagggcgcgatattcgtttttttttatttttgaaagggttttttacgtcgagaagaggggcgggtatggtcggttcggcgaaatcggtttgtatagattttgggaagttatcgtttgcggagggtgggattttatagtttgtttatttgtttaggttgagatttcgtgttttagttttggatgttttacgggtttttcgtttcgggtagcggcgtacgggaggagaagattttcg

SEQ ID NO: 11173 - DNA, 865 bp, synthetic construct; identical to SEQ ID NO: 11172
  misc_feature 1..865: note = Description of Artificial Sequence: Synthetic polynucleotide
  source 1..865: mol_type = other DNA

SEQ ID NO: 11174 - DNA, 1463 bp, synthetic construct
  misc_feature 1..1463: note = Description of Artificial Sequence: Synthetic polynucleotide
  source 1..1463: mol_type = other DNA
tcggggggtcgcgggacgtttaggaagcgaagcggggaaggtttcgggcgcgtcgtaggattcgcgttggagatgggtttgaagttttgttttgaaaaagtcggttcggagtgggttgttttcggtgtttttcgagtttttatgttgttatttaagtagtagaggaagaatcgggtttggttcgggaagggtgggtttagggttaggggtgtaaatttttcggtaaaagtcggtaaattaaaagtcgtatatattttaggtttcggtttaggtttcggcggggtagggttttcgaagtttcggggcgcgtagacgtcggggttttcgggggttaagggaacggcgggattcgatttttttgttttcggtttttcgggttttcgtttttcgattagtcgttgagtcgggggttggggtcgtcgttttcgttcgcggttcgttgttttttttcggcgcgcgttattcggtcgtcggttttttttttcgcggggggtttcgtttcgcgtttcgttttttcgggttgtagtcggtagtttacgtttagggagggtggagggaggaggagaggcgcggagaggagggaggggagaggggagggaggaaggcgagagaaagggagttgtttttatttcggattttttagagtttgtttggagcgcgtatttagcggttttcgggttttagcgttttagtcgcggttcgcgttttttcgtttcgttttttttttttttttttttttttttttttttttttaggtattttcgttttttttttttagcggttgtagtttttagttttaatttttcgcgtttatttttgggacgcgcgttttcgttttattttttgttttttttttttttttttttttttttttttttttggttttcgttttttttttttaggtcgttttttcggggttcgattgtttcggtgtttcgttttcggttcgcgttttgtttcgttttttttttgtattttttgagtcgttcgtcgtcgtcgtcgtagattcgtcgcgggagttttagtttaattcgagttcgatagttattgtttcggttttagttttagttttatagttcgcggcgttcgttcgagggagtttcggcgttcggggaaggttttagtgggttagcgcgttttcgtttagtttcgcgttttagttttgttcggttcggcgaggaaggatcgggaagatgaataacggcggtaaagtcgagaaggagaatatttcgagcgaggttaatttttaggaggaggaggtattgggcggttcggtgtggtggcgggggcgacgcgggatttagtgcgggcggtcggcggggcgcgggttcggggcgcggcggtggaagaaggtttaggtatggttcgtgtttcggacgtagttttatagtgtggttcggggagggtggatttcgggagcgtgtgtttttgtgtttacgcgcgtttgcgggttttaaattgcg

SEQ ID NO: 11175 - DNA, 1437 bp, synthetic construct
  misc_feature 1..1437: note = Description of Artificial Sequence: Synthetic polynucleotide
  source 1..1437: mol_type = other DNA
tcgtaggaatcgaggagtcggtcggtttaggtttttaaggttacggggagggggttagggcggaaaaggtagtggagtgagggtgtcgttttcgggtcgtgttaatttcgtttcgtttcgtgtcgtcgaggcggggttttggttacgtaggaggtgcgtttcggaggagggcggcgagcggttacggggtggggagtaaggggcgcgcgggcggtaggtatggaacggacgcggcgtatttcgtttatcgcgggacgttcggacggcggtcggcgcgcgcggttcgtttcgagttcgagagggcggggagataatgtttgttcggcggggtagtttaggtcgtacgttttcgttcgcggatacgggtcgtttttattcgggcgagagggtagcggcgggaaggcgtcgggagcgatggttatttcggtttcgcgaggcgcggtaggtttcgttcgttttttttcgcgttcgtttggcgtgcgttttattcggtaagtttcggggttatagatttatttttttttttagggcgtcgtcggagttcgcgtcggagtcggtgtcggtgttgtcgtcgtgttcgtcgttcggttttaggttgtttatggtgcgggggagggggcggcgggaaggaacgcgagggcgagcgcggcgtcggtttcgcgggaagtgggaaggggcgcggggagcggtgcgttcgcgggtgcggagcgggtggcgggggatttacggggtagtgagaggggtagttttcgcgtcgggttagggttatattaagtttggcgggtgcggaaggtggggagggggtgcggcgggggaggtagtgggagtcggaggggtcgtcgttttcgtttttttattgcgatcggcgagtgcgttgcggcggcggcggcggcggtagcggcggcggggggcgggcgtcgggggagggggcgggcgtcggcggcggggggcggggtcggaatcggttttagttggggttcggttagttttttttttcgttcgtcgcgcggttttcgggggaacgcgtagttaatttttatcgtttatcgtgggttcgtttcggtttcggtcgcggggcgtcggttttcggtcgggttttttttttttttttcgtttgggttagcgttttttttttttttttttttttcgcgtttttttttacggcgagtttttaaattttgatgaattcgttcggcgaatttttttaaaggggtcgcgcgttgcgcgttttagttcgcgggaggtggagtttcgtgtttcgtatttagcgtttcggtttttgggcggttttgttcgggcggtttcgcgtttagggtattcgtagcgaggttttcgggtcgtcgattttttttgtattttgatttagggttttggggttttcgacgtatttattttgtttttaaatttagtcgcgtagattttagtttcgggggatcg

SEQ ID NO: 11176 - DNA, 717 bp, synthetic construct
  misc_feature 1..717: note = Description of Artificial Sequence: Synthetic polynucleotide
  source 1..717: mol_type = other DNA
gcggtaggggcgggattcggaggcggggcgtttgtttacgtcgtttagtagcggagggaggcgcggttttagtttcgcgtttaggagtcgtataggcgttcggggtcgtagtaggagtttttttagggcgtttagcgttgtatttacgagtcgcgcgtcgttttcgtttagtgcgtttaggagcgtcggtagtagcgtgtttacgtgtcgtatttgttgggattcggggttagttttttgtagatttcgtcgcgatcgggttaagtttttttttattttttttttttttttatatttttttgcgatttagcgcgaggtggtttaggtttagtaggtttaattagcgtatagtgggttcggggtttttttgttaggtgaggagtcgttttaggatgattttttttcgtaggagtcgtgcggtgggtcggttttgtaatagttaggcgaggtatatggggttagtacgttcgcggttttcgtgtaggtcgttgcgatttagggattaagtttagggttattttttattatttattcgggaagtaggtttatttttgtgaagaaggttatagtcgtgagacgttgcgggtcgttcgcgttgcgaagtcgagggagtaagtttgcgaagaggtttcgtaggtggtggtcggtatgtgttattatagtattggggtgggtggaaatgggagttttcgtttcgtttggcggttttttttttcg

SEQ ID NO: 11177 - DNA, 1713 bp, synthetic construct
  misc_feature 1..1713: note = Description of Artificial Sequence: Synthetic polynucleotide
  source 1..1713: mol_type = other DNA
gcgttgtagattcgggttttttttttagtttacgcgtaagtcgggttcggtttatatttattatattttttcggttttcgtttagcgtcgttttttttttcgggtttttttagtatcgatttagtatttattagcgtcgtttttaggtttttggtttagtttattttcgggtacgtgtgagtgtgtgtttgtgttagtttgttagttttatcggggatcgggttcgtttatcgagagagaagcgttaatttttgttttagtattatttttagtttttggttttgtttggagatttagtggtttatttcgtgtaggcggtagtacgtttttagtattaatttgaagttcgttacgaattcggtgatgttttcgtattggtcgttggcgaattttttttttatttgtagtagatatatgttttgttcgggttgttgcgggaaggcgcgatcgtttcggttttcgttgcgcggttttttcgttattttttttttcgcggtggtaacgttttttaagggttgtagaaagggggcggtgaggtttcggtgttttttttgtaggaattcgtttaggatgcggtagttttgttgtagttcgtaggttagtttttgttttttgtagtaatcgttttcgattattatcgtttttattttttttttttgatcgttcgcgttttttagcgaggaggtatttttttcgtgggtcggttttgaggtttgggtcgtcgttgttatttttttttcgtcgttttttttttcggtcgtcggtggcggtcgttttttttttttagtcggttttatcgttttcggcgtttcgggtatatttatgtttcggtaggtttaggttgggcggtgtggaatagtcgttcgaggtgttgggggacgcgtgagcgcgagtcgtttttttacggttcggtcgcggcgcgtagttttcgttatatcgggtttggttttttttagtcgtcggttcggttcggtgcgcgcgggggttttgagtttatcgtcggcggggcggggttatatggcgcgcgaggaggggggagagaagaggagagtttaggtgttttttttttttttttttttcggcggcggcgcgcgtacggttttcgtcggttttattttttcgtatttcgttcgtttgttttttatcggttaggttttgtcgggtcgtcgcggtttcggcgttttattttttttcgggttagcggggggttgggagggggcgaggaggaagggggtttttttttttttttttcggagggggtcgtagcggcggtttcggtttttttttttttttatattttttttcgtttttttttatttgcgggggatacgggtagaaggaggcggtgtacggacggggttcggcgataattgttagttagaagtttcgttgggcggtgaggggggagaaaggggaggggtagggagagaagggggagggtatttagtttttcggttgggaagagttgtggagagaagtaaagaaagaggttttgtcgttattttcggtgcgtatgcgtagtagaataattttttttttttttttcgttattatcgtgtttcgtttcgttacgtaaaaggaagagtttcggtttagttataggtttagaagtttgttagggttgcgcggattaatgatgtaattaatcgtaggttaatcgaatatgttgatggagggggaagtaaggcgtttgcgtagtttaattcgttatcg

SEQ ID NO: 11178 - DNA, 699 bp, synthetic construct
  misc_feature 1..699: note = Description of Artificial Sequence: Synthetic polynucleotide
  source 1..699: mol_type = other DNA
gcgcgttcggaaagtcggtttgggttttgttaattattttgaaggtaaagtatttgtatttttttcgtcgaggttggttggcggcgtcgcgttggaggggaggaggttcgggaggaggaggagaaagagtagcgggaggattcgggttgggaggggagcgtagggttggggaggtcgatgagcggttttcggtttttcggagaagtagtcgagacggtaaggaggaggcgaggttttgtcggggcgaggcgttgtttttacgcgtttcggtcgtcggttgcgggcgcggttgggcggggagtcgaggcggtcgttttcgtattcgttcgttcgttcgttggcgtttttttttcgtttcgttcgtatttataggtatatattttacgtttttagtagttgtcgttcggttttacgtatttatttgtatttttttaacgagttatttgatggttgttagcggcgtgggtttcgtttcggcgggcgggggtcggggcggggagaacgcggcgcgggatgtttcgagcgttcgttggggagagaagcggcggcggcggcggcgttgcgggcgcgttagatggggcgggaggaggggagattcggtatttatcggtttagagttgtttgacgcggtttgggcggatttcgtcgttcgggtgtttaggtacgattttagggatttagggtaaagcggttcgcgcg

SEQ ID NO: 11179 - DNA, 1191 bp, synthetic construct
  misc_feature 1..1191: note = Description of Artificial Sequence: Synthetic polynucleotide
  source 1..1191: mol_type = other DNA
tcgatttttattaagcggatggttaagcgttattcggaagtgtttattggtgggggcgggaaggtatcgtagtttaaggtattcgcgggtagggagcgggttagggcgtgcgcgaggtcgggggtagttgggaacggaggaggaggggttcgttcgaggtttcgttttttatcggttgcggtttcggttatagttagggtttagagggtttcgagtttcgggagcggaggtcggagtcgggtttttgtagaggttgtttttttttgttttcgttcggacgtggttttcgttgttcgaggtgtagttgtagtagggttcggcggtatatggtttttagttttttaagtcgggtttttagggttttggggttgttcggttcgttttttcggtcgttgtttttagtttttcggttcgtgttggtttttttagggattcggcgtgttttcgcgggcgtttcgttgtcgttttcgtcggggagtcgtaaagtttgacggaagaggttgcggttttcgcgttttagtcgtcggttttcgagtcgtagtcgggcgtttttttgacgtagtcgcgcgttttgtcggttttattcgtttcgcgtacggatggtttttaagtggttcgtcgttaggtcggtaaatcgtttttttagttgttgtcgggcgtcgttcgcgcggtttcgttagtttacgtcgtcgtcgtcgtcgttggggttgtttttattatgagttcggtcggagcggtttggttttcggtcgttcgtagtatcgttttcgtcgtagtaattttcgcgtttagtggcgttattacgtatgcgttatatcggttttattttaatcgcgtcgttagtttcgtgggttgaggggtcgcgcggttaggcgcgggtaagttcggggttggtagggcggtcggggtgacgacggaggaggagaggaggtcgcgggcggcggttgttggtttagagttaaaggaggtcgggaatttgtttagattgaggcgtgttttgttttttgtggtggagttgttttttgggtttgttttttttaggttgcgttgatatatagttttttcggggagtgttttgttgtttagtttttcggttgcgcgggaaaaagcgtgtatttttagttgagttgtgttagggcgttttcgtgtaggtttgggtattgtaggaattagtcgttttcgttcgtttcg

SEQ ID NO: 11180 - DNA, 536 bp, synthetic construct
  misc_feature 1..536: note = Description of Artificial Sequence: Synthetic polynucleotide
  source 1..536: mol_type = other DNA
tcgttttttacgtgttcgcgggggggggcggggtcggtggattgggcgtgagttaattggttggggggcggggtattacgggttggtttcgtttaggcgttcgcgcggatttcgggtggaatgacgggagggagtttcggtagtttttattttttagcgatggcgtcgttgtgtcgcgtttagtttttagtttgtcggtcggtatttatcgttattcggagttcgtttagacggtgagatttggggcgggttcgaggtagcggcgggacgttatttgcgatcgggattatgaggagttgttagattcgtggggtcggtaacgagagtagtcgcggtatttgttgagaggaaagagggagcggttcggcgcggttggggcgcggtagaggtttgttcgattttcggttatgttattgttttgcgtgcgcggtgagtgcgcggattgaggcggggaggcggggtgtcggcgtagaggttttcgtatttttttagtggacgttcggtgatcgttttatttaaattttatatttcgttcg

SEQ ID NO: 11181 - DNA, 728 bp, synthetic construct
  misc_feature 1..728: note = Description of Artificial Sequence: Synthetic polynucleotide
  source 1..728: mol_type = other DNA
tcgggcgttttattcgtcgtttatcgttttatttttttattttttttattcgggttttttaagtttttgatttaggcgttagatttttttattatatttttttattttaggcgattcgttttggtttcgggtgtttttagtttgcgcgggtcgtttttagttttcggtggatattcgtttttagttcgtcgttttttgttcggttttgcgttttttggaatttttgggtttttagttttcgtcgtttttagaattgcgtttgcgtaataatggttatagtggtgagggggttttttcgtcgagatttggggatggggcggggcgtagggaagggaatcgtcgcggtagtgtttgttcgggggttgggttggttttatcgggcggggtcggtttatttgtttttttttacgtagtgtaattgattttgttttttgggttagagatggttttgggtttcgggcgggagtatcgggttttgtagttgtatttgtattggggggttgtaggtcgttcgggttcggagtatattgtggaaggttatcgtttttttgtcgaggtgagcgcggagttggtcgagaaggggtaaaggagcggggcggagcggggttagagacgtggtttttttttattttcgtgttttttttagatttacgtggtttattttagtatcgtttttgttagagttgacgaggttttggggcgttcgggaggtttggtcgtgttggtcg

SEQ ID NO: 11182 - DNA, 1431 bp, synthetic construct
  misc_feature 1..1431: note = Description of Artificial Sequence: Synthetic polynucleotide
  source 1..1431: mol_type = other DNA
tcggtcggtttttttttttttattttttgatttcggtcgttttacggatcgtagggattgttttatcgtttttttttacgtaattattagagaatttttttaaaaatatagattcgatgaggagtggttttttcgttttttttttgtgtcgagaagggatttcggtcgttaataataaagacgtttttcgttttttttttttcgtcggttcgggttcgtttttttcgcgttgcggttttcggtttagcgtttttttttcgagtcgggttgcggcgtttttaaatttcgaggtcgtacgtatttgtatttgagcggttcgggtcgaagcgtcgggtagaaggggtcgagagagaatcgtagtcgacgcgttgttttttataaggcgagattcgcgtttcgggcgtcgttcgatttttttcgtttgtagattggttcgatagaggagcggggattagggttatagttttcggcgtcggggcgaagaaggacggcggcgttttaggggtttcgtttacgttttcgagtttcgtttcgcgtcggttttgtttttttataagagttcgcgttttgttgattaacggtttcggtgcggggcgttggagcggtcgtcgttgttcgtcggttgttttcgggttttacgtttcgcgcggtcgtggtcgtagtcgtcgtcgttatcgtttttttttttggtattgtagacgttatttagatttagttaggttttttttttttttaattttgttttttttgtttttttttagtttgttaagcgcgaggttcgtttcggtagcgggaggaagattggaggggaacggaggggacgagtataatttttattgagttaggagttggttattgattggaggaaggtgttaaagttgatttcggttttagtttattagcgggcggggggagagacggagtttagttttgttttatttttattaattagaggtcgttcggtagggtgggaggcgttttgagtttaaggagaggttgagttcgtttagtaggaggcggggattgcggaaaagaagaattaataggaataaaggtttttcgtttttttgatttgatggattatatattcgggttaatgggggaatttttatttcgaagaaagtgggatttgtttttcgggtttgagaaagaggttgcgcggagtcggaggggtcgaggttgcgtcgcgtggagtggtttggtttaatagtagggagggtagagcgatgttttttgattttttagaagagttacgtgggttgatttagagtcggggcggaaaggttgcgtttgtttttttcgggttattgatagaagcgttaatttttgggagtagttcgttggttttttttttttttatttttttgtttgttttcggcgaggggtggttttgatttcggcgatgagtttttagaaaggtaacgtggttcg

SEQ ID NO: 11183 - DNA, 588 bp, synthetic construct
  misc_feature 1..588: note = Description of Artificial Sequence: Synthetic polynucleotide
  source 1..588: mol_type = other DNA
tcgtagaataggcgcggagttaggtttttggatttgttttgttggaaggagggtcgcggagacgtaggcgtttcgggtcgttcgcgttgtttttgtttgtttcgtgcgggagtcggggtttttggttttttggttttttggtttttgcggttcgggcgaatttagagcgtattcgtacgtcggtttcggtcggtttttagcgttcgggttttacgggtcgcgtttttacgcggcgttttttagagattttttttttttcgggtgggcggcgtagcggggtttcggcgtcgcgaggatttttcgcgttagaataaaggaatgtggggagggggtagggaggagtttaggttattgagtagttttagtataattgtcgttcggaggcgtttttcggtttcgattcgaggttttcgttcgttattattagattcgtttttagtttcggattttcgtagattttatcggttcgtaggagggagcggcgtattgggggtcgtacggattcgttattggagatcgcgatcggaaggtggcgttacgcggtttttataggtttgggatttttattcgagttcgtaaagtaggtcg

SEQ ID NO: 11184 - DNA, 1203 bp, synthetic construct
  misc_feature 1..1203: note = Description of Artificial Sequence: Synthetic polynucleotide
  source 1..1203: mol_type = other DNA
acgtttaattttcgagtttgtacggtgtagtatcgtttattttgggtttagggtaatttgggtgtaaacgtttttgcgggcggatcgcggggtgggtttcgggtatataggaggattagtagtagtcggtcggtaggcggagcgttgttagaggtttgggttttataataatttttataggattaaaataaacggcgagacgggttgcgcgtataatagtatattcgggcggttagtcgagtcgggggtttcggttcgcggttgcgttaagttttagaattatttagtttcgtgtttgtcgttcggggttcggtttcgtttcggtcggcgtttatttggcggtgtcgttttcggaagattacggcgaaggtttcgtgttttacgagattttttttgttgtattcgaagttatttattatttttatggtcgcgttttcggggtatatagcggacgggcgggcggcgtagtgcggcgtaggtattagtatcgcggtttcgcgggttcggagcgcgttagcgtgcggcgggtttggggtagtcgtagtttcgggttcgggcggatttttatgtcgagagatcggagcggaaattggggaagttgtcgcgcggagttagggttagcgaggttcggttcggtttttgtcgtttatggttcggtttgtcgtcggtcgttggttgtttggcgaagcggtttcggcgttgtcgggttaggggtgtcgttatcgttattgtgcgcgtttagagtcgtatacgcgttttgaggtagtgaggggttcggtattttttatttttagttcgtcgggttttttcggtttttttcgttcggggcgttgttgcgacggcgacggtcgtcgttttagaattcgtatcgtcgcggtttcgcgttttttcgtttcgcggcggcgtttaacgttttcgcgcgcgttattcgttttcgcgcgattggttgtttttcgcgacgttcgcgcgttttgaaggtcgtagcgttagtcggtttttttcgtcggggaaaggagtgcggttagggtttggcgttcgtagttgggtagattttcggtcgtttttgaggcggggacgaagggcgcgattcgttgcggttatagcgggttacgggttgcgggtttcgttttgggtttggggagtagattcgagtcgattacgtttcgggttttaggtcgttgggaggcggattttagagaagcg

SEQ ID NO: 11185 - DNA, 5370 bp, synthetic construct; identical to SEQ ID NO: 6514
  misc_feature 1..5370: note = Description of Artificial Sequence: Synthetic polynucleotide
  source 1..5370: mol_type = other DNA

SEQ ID NO: 11186 - DNA, 1691 bp, synthetic construct
  misc_feature 1..1691: note = Description of Artificial Sequence: Synthetic polynucleotide
  source 1..1691: mol_type = other DNA
gcgtgggggagcggggcgggtttggtagggacgttggtttttcgatcgtgggataggggttgggttgggacgcgggtttttattaggagtcgcgggggaggggtagggtcggagtttttattttcgtaggggaggggttggttcgggacgcggttttttcggggcgtaggggcggggtcgggtggtacgtcgggtttttttttacggtcgtgagggaggggtcggcggcgggggcggatttttggcggtttttttggttggggttcgcgcgttcgcggtagtttttcgtggaggttattgttcgtgttagtttttttcgttgtttcgttttttttcgttgtcgtcgtcgtcgtcgtcgtgttcgttttagcgtttttatttcgcgtttgggagcgaggagtcgttagcgttttcgtttcgtcgtcgtcgtagcgtttttaggtcgttattcgttatcgaaattttttagcgttcgcgtttttttcgggattcggcggcggcggggcgggggcggttcgggggcggcgcgcggttgtttcggggcgtcgggtttttttcggtcgtcgtacggtcgggattcggaggttgtcggttggagggaggttcggagcgcggtcgggcgcgcggcgtcgttataagttgcgttgttcgcgacgaggtgagtgcgtagggttcggcgggtcgggcgcggggttcgtaaatttttgcggggaggcgggtttcgcgttgattttttagggttcggtcggcggttcggggcgttcgaacgttttattcgtttttggaatttttgtaggtgtaggtcgttaattgttttcgcggcgttcggattggggtgcggcgcgtttttaggagtttgaataatatttcgaggtggtcgtttttcgaagtgtcggcgcgttttgcggggagagacggaggtcggcggggggtttttttgttttggggagggggaagtggtcggtaagtttagggaagcgttcggtttttttttcggtgtttttttgtttgtcgatttaggggtttgttgggtaaatttgcgttatcgcgggtttcggggatcggggtggagggcggtggcgggattttttcgttgttggggagaagagttttatttatattcgggacgcgggtcggttttttcggattcgggtggaagcgtagtttcgcggagtggggtaagcggcgggcgaggtggcgcgggtttcgtgtttgtttagtttttgacgcgtagaaattgttaaggaagtcgggagttttagtttttcgtttattttttcggtttgagcgtacggttgggttgggggtatttttggttcgtcgagggtttgtagagcgtcgttcggggagagcgtagatttgttgttgtttttgggttttgacggggcgggtggggtgggtttcgtagattttgggtttcggttttgttatttagggggattttttttaacgatgggatcggtgttcggagtggagtatggggagtgcgttttcgggagtcggcgttggtcggatatgtgataattgtgggtcgttggaggttcgtttgcgttgggatagggtttggattttacgtgcgtcgtttgtgtttcgttagatcggggtcggggttcgttttttgtaaggtttcgtgtttttttagttagttgcgttggacgttttataaaggtagggattgacgtttattttcg

SEQ ID NO: 11187 - DNA, 1223 bp, synthetic construct
  misc_feature 1..1223: note = Description of Artificial Sequence: Synthetic polynucleotide
  source 1..1223: mol_type = other DNA
gcgttgttacggagatttcggtcgtcggagatttcgtcgtagcgaggttattgggtttttcggtcgcggggcgggagcggcgtcgatacggggtgttaggaggatttatcgggcggaggagggggtttgtttattttttcgtatttttttgggtttttttttcgggcggtgacgtgacgtgttgacggcgggttcgtgtcggggagttgggtcgttttttgttagtttcgagttcggtttttttttttttttttcgttcgttttattagtcggagttcggtttagtgttttagagaaaggtcggtttgtagtattcgttatcgtcgtcggtcgttcgtacgttcgttcggtgagtttcgggtgtcgtcgcggtcgcggggtttagtgcgcgtatagcggtttggtttcggtttggtcggcggttcgtaaggcgttttttcgcgttaggtcgggcggcgtggcgcgcggcgtcgagtaggtttcgaggaggtcgtagttaggttcggggaggagttcggttgtttcgagcggcggcggaggcgcgtttcgtaagcgggcgggggttgggggagggtcgttcggttgtgtcggaggcggtcgaggggtttcgggtcggtttcgcggtcgatttggggtatcgcgtcggggtgaggtttggcgaggaggcgaaggttgtaggcgtgaggtgaaggtcgtaggtcggtcgggtcgattttcgttatgtaaatatcggtgagggggggggagggacgggggataagatggcggcggttcggcgtttgttgtaggggacgatagagggggttgtcgggagggggagtcgttattttggaggcggtgtttggagagaaaatttcgttatagttcgtgagggggggtgggagagcgggcggcggcggtagcggcgtcggtgacgggtttcggaggttcggcgcggcggcgtgtgcgcgcggaggggcgtgttcgtttttcgtggcggttattgtttttgtcgttatgatgagcgttcgggttttaggcgttcggcggtagcgttatttttttgttttgtttttcgtagtttcgtgattggttgtagttttcgttgcgttttagttgagttgtcgtaggcggttatcgtcgtcgttcggacgtcgggatcgttttatttttagcgtttttggttttgcgttttttttcgcgtttgtagttattcgagggtagtcggggtaggtggtatttcg

SEQ ID NO: 11188 - DNA, 1103 bp, synthetic construct
  misc_feature 1..1103: note = Description of Artificial Sequence: Synthetic polynucleotide
  source 1..1103: mol_type = other DNA
acgttacgcgtcgttttgttatcggtgttttttgagtgacgttaaaacgttttggatggtggtattgggattatggatggggtttatttagtttttttcggtttgttattaaggggaggggtcgtcggtgggtttttcggcgtcgttgtaagttatcgggtttcgaagtcggaggtcgaaacggcgtgggtttcgaagcggggtcgttttttagggagtgcgtaggttagcgaggatttcggtgaggcgagacgttatttttatttggttgtttttgttgtttttatttttttagttttagtcgtttgtagtgattcgtgattttcgtaggtttttaaggatcgttgcgcgagggagggggttcgaggcgttttcggttcgtttttttttcggttttcggattcgagtcggttttcgggaaagagtttgttatcgcgttttcgtagttatttttttcgcgtgttcggttttttttagtggcgggggtacgtgggcgcgcggggtgcgtggtaagtcgtttttttttttacgttcgttcggtcgtttttcgcgcgcgcgtttcgtatatagttttcgtgtagtgggtagagttcggtttcgcgcgcgtttcgtttcgtttttggttagtcgcgttcgttttcgcgtttttgttttttttttttttttttttttcgttttttaggcgcgtattttttttttcgcgtttttttcgcgttttatatttatcgttcggcggagggggtttagttcgtagtcgtcgtcgttatcgtcgcgtttcggtttcggtgtaggtagcggtcgtcgtcgtcgagatagttgcgcgggcgagtatttttacgtagtaagttcgtttttttttcgtttgtgcgcgcgtgtgtgtttttcgttcgtcggcgttttgggtttcgggggagcggttgtttttttgtttcgtcgtcgtcgtcgttcggggttggtttttgcggtttcggttgtttggttttttagggttgggtattgcggtttcggcggtttcgttgaggtcgggggttaggggtcgtttcgggttgcggggtgcgggacgagggattgcgagtgcgaggttttttttggtgcgtgtttcg

SEQ ID NO: 11189 - DNA, 616 bp, synthetic construct
  misc_feature 1..616: note = Description of Artificial Sequence: Synthetic polynucleotide
  source 1..616: mol_type = other DNA
acggtagttttcgattgaattaattcgatagtatttgtggaagtcgttggttttgtgtcggggttagatcgcgtaattaggagcgggggttttttacgtggcggaggtttttcggtttgggggttacgggttcggaggaatttgtttggaagttttttattacggtagagttttttggagttcgtttcgtgttcgataaggggagttttagatttgatttttttagtagtttcgcggggcggggtcgagaaggggcgggcgggcggaggacgttggcgggagaatgtgcggaatgtgttaggcgtttttatttattttaggaggggtagaggaaggggtcggtcgaggggaggggcgaggggcgaggtttcgggcggtcggagaaaatttgtttgtttttttgcgggcggagtttagttcgcgttttttcgtttttttgcgcgtttttcgttgtgtatcgcgtttcgcgtttcgcgtttgttttttcggttcggttcggttcggtcgggtgtcgtttattcgagggagttcgcgttttgcgattgttcgattttttattcgttttacgagtcgggtatcggtgttaggtagggttgtcgagtcgttattggatgcg

SEQ ID NO: 11190 - DNA, 206 bp, synthetic construct
  misc_feature 1..206: note = Description of Artificial Sequence: Synthetic polynucleotide
  source 1..206: mol_type = other DNA
gcggcgggcggttggggaagtagttttgtggtttttcggcgggtgaggtcgagatagagattaatttttaggcggcgttttggcgttgagttcgcgttgaataagattttttcgtagttttgcgtttcgcgtcgggtgaaggggcgtgtttttgtaggcgttcggggttcggtttggagttggcggtcggtacgtcgtttttggcg

SEQ ID NO: 11191 - DNA, 1141 bp, synthetic construct
  misc_feature 1..1141: note = Description of Artificial Sequence: Synthetic polynucleotide
  source 1..1141: mol_type = other DNA
tcgtagtttgggagcgcgcggtttcggggatggggagggggtcgggaggaggcgtgcggttttgggggcgcgtattgcgggagcgcgcggtggcgaggatagggcgggtcggggttcgcggggcgaaggcgcgcggtgttcgggggagggcgggtcggggcgcgcgggtcggggcgggggcgcgcgggtcggggcgggggcgcgcggggtcggtcggcgcgcgggggcggcgggcgcggcgttgttaatcgtagataaaggtcgttttagtgaattatgtggtgtcgggggaggaagtgcggtttgtttttttttttttagtttcggggttgtaggttgagcgcgatgcgcggagattttcgcgggggcggcggcggtcgtgagtttcgatgaggttcgagcgttttcggtcgcgcggtagcgttttcggttcgatggagatttcgtcgtgggatttagttcgtaacgattcgttgtcgtttacgttgatttcggtcgtgtttttttacgtgaagtttggttttatcgtcgtttatatcgtgttttacgcgttgtttttcgtgtttatttacgtgtagttttggttggtgttgcgttatcgttataagcggtttagttattagagcgtttttttttttttttgttttttttgggtttttttgcggatcgtttttttttttttttattttaaagatttcgtggcggttaattcgtttagttttttcgttttttggttgttttattgtttttttgtgtgtttgtagttttttatttttacgttgatgaatttgtattttacgtaggtgagttttagagaggtttttggaggcgtttatttggcggggtggttttcgcggggcgttcgaggtaggggcgatggtagtcgcgggggcgggttcggttttagggttgagagtgtagggagaaggcgtcggttttggggtcgttcgaattttgttttgtttgcgggtatttgttataggaaattttttgttatttttaaaaggggtaaggagaaggtaggggagggttggaggtcgtcgtttattcgttgtttttggtttcgtatcgtgcggtggattcggggcgttttttcgtgcgtagcgcgaagtagtagcgtttgtatacgttagttagtacg

SEQ ID NO: 11192 - DNA, 1819 bp, synthetic construct
  misc_feature 1..1819: note = Description of Artificial Sequence: Synthetic polynucleotide
  source 1..1819: mol_type = other DNA
gcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcg

SEQ ID NO: 11193 - DNA, 1813 bp, synthetic construct
  misc_feature 1..1813: note = Description of Artificial Sequence: Synthetic polynucleotide
  source 1..1813: mol_type = other DNA
gcgtttagtttcgagagtttattatagtttacgtttgggcgcgtagtattttttcgatattgtttttgttgtgttagatagtggtagtgttgagtttaggaatacgcgcggagttcgcggcgattttcgcggtcgtttagttttcgcggcggatttcggcgcgtaggagttattgggtcgtaagggcgtcggggagcgggaggggcgttgggggcggtaaggggttttagattttaggttacgaattgtttttttttttttcgggtaagagtttcgttttttttaattgatagaaatttattggggtaggggggcgagtggggagagaggtcgtttagggttcgttattggttgcgtttttttcggttttggtttgggaagcggttttgggtttttcgggcgagtagtttgggcgtcggcgttttttgcgaggaagatcgcggggtgacggtcggtattcgttcggttgggtcgcgttgtcgtttcgatttatttttttttcgcgttcgcgtttttttttttttttttattaggagttcgggattcggagagggcgcgggaggtaggtatacgggttcgattttattttagcgtttatcggggacgcgggcgggcggcgacgggacgcggcgggggcgcggggcgggcgcggttatggagtagtagcggcggcggcggcggcggcggcggtaatattagcgatcgcgggcggacgagcgggcgggtagggtcgtcgggtttagcggatcgaattgtatagtttagtaaaagcgttttcgtttttcgcgcgtcgttttttgcgagtttaaatttattaatattttttaacgttttaatttattttttgaagaaaagtaaaaaaaaaaaaaaaaaaaaaaaaaaaagtaaaaaaagaaaaagtattgatcggagagacggggatatatatatatatatatatatatatatatatataaaattttttttggtttttgttaaaattagtagggttcgtcgcgcgtttgtgtgttagtgtgtgcgagtgtgtgtgcgtgcgggcgtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcgatggtggaagttttgggttggagggttgggagtttattgagtttcgtttaatttgatttatttttttttcgtttttcgttttttgtattttttttcggttttgtagtcggttggcggggttggcgggtttggcgttggtggagtggattcg

SEQ ID NO: 11194 - DNA, 1872 bp, synthetic construct
  misc_feature 1..1872: note = Description of Artificial Sequence: Synthetic polynucleotide
  source 1..1872: mol_type = other DNA
gcgttttgttagttaagtcgggtagttagggatttacggagtaaagatttaagcgggtatggtttcgataaagagtgaggttcgttttttttttgttgtttcgttagttattaaagatgagtgaggcggaaatacgacggtggggagcgcggggaatggaaaagttagaaggtttcgtaataattcggtgttatttgaatgtttgtaaaacgtgtcggtaaaggtagttatgtttttatttcgattttggtttagttgttcgggatacgcgttacgcggcggtcgttaatatttaggggatagataatagttatattgtattgatagtacgtagataatatcggcgaggtgtatatttatatatttaacgataggtttcgttattgcgaggcggttgttaatttggagggaatagggaaagttagtcgggttttagtttttttttttcgaagtacgtttatttaaacgtcgtagtttgcgtttaggttgttttcgttttattttaaagattatgttaacgtaggaattgtgggtgcgcgcgggcggttcggcggggagtttttttttttgggtttcgtcggttttattttgggagcgggagggggaggagggagggttggaggaggggaggggaattttaaattaaaataatttttagttatgaggacgttcggtggtatcggatatttatattagtaatagttatattatattcgttttcgttagatggcggcgggtttaatttttcgggatttcgtaaatttaggttgtgcgttcgagcgcgcgtcggagtgtgggtacgcgggcgggttggggattgcgggagcggcgcggcgcggcgcgagttcggggcgagaacgggggcgtggggttggggggcgtcgggtttatcggtttcggacgaggaggttttcgttttcggggagcggtatcgggtagtttcggtttagggtgacggtttcgcggaagttggggtttagtcgggttattattagtttttgtatggtttggggaatggcggagttttggaagtttaggaagtggcgggcgtacgatatgtttacgatggttcgggtttcggtgggtattagtcgtagtatggtttgcgttttcgttcgttttttgcgtcgacgttggtcggggtcggttttcgttcgggtcgttcggttcggttgtgttttgttcggttagggcgggcgggttcgtttttttttcggtcggcgttttttttttggtttttttttttttcgcgtcgttcgttttcgtttttttcgttttttcggcgtcggcgtagttttcgtgaattcgggcgtattatttcgggtgtttcggtttggggatcgttgtcgtttcggtcgttgtttttttaatttttttgttttggtttgaatttgttcggcgtagattggttaaggatttttttcgtttttttttttttttttggcgcgggagaggtatcggatatttttatttttttcgagttttaaaagtcggatttgatttttttcgggtaagggtggcgggggggacggcgggtaaggggggacgggggattcgcgcgtttcgcggtcgtttgcggtttcgagtcggcggtagtttcgggcgttttcggagttgcgcggcggtcggcgtaggcgtttttttttttcgtgcgaagcgtttatttttttgtaaggtggtacgaattaatttcgagcgcggttcgggcggcggggtacgatcggggatttcgggtagggcggggagtttttgtcgtcgttgtcgtacgcgtattcgtatcgatcgcggggcggggaaatgtttagtgtttttcgttttttaggttggtggttttttgttttcggaattttttgcgcgtgttttttgtttacg

SEQ ID NO: 11195 - DNA, 652 bp, synthetic construct
  misc_feature 1..652: note = Description of Artificial Sequence: Synthetic polynucleotide
  source 1..652: mol_type = other DNA
tcgtagatcgtgtatttttgtagggggtttcggatgcgatggagttgcgcgagttgacgttttgggttgggcggtttttaggttcgcgtcgtcgggcggggtttcggcggcggcgcgcgcgtgcgcggttgggggcgcggttttgcgggttgcgcgagttggaggtgcgcgtgagcgagttgggtttgggttacgcgttcgacgagacggtgttgtttcgttattgcgtaggcgtttgcgaggttgtcgcgcgcgtttacgatttcgggttgcgacgattgcgttagcggcggcgtttgcggcgggagcgggtgcgcgcgtagttttgttgtcgttcgacggtttacgaggacgaggtgttttttttggacgcgtatagtcgttattatacggtgtacgagttgtcggcgcgcgagtgcgtttgcgtgtgattttattttattcggtcggcgcggcggttatttttttcgtttcgacggtattattggtcggtttcgcgaaagattgcgcgtgcgtagagtacgtcggcgcggtttcgggattttcgcgataattgtattgagataaagtgtggtaattcgagttggttggtgatttattttcggcgaggggttcgcgtgtgggttacgtcgtcgtttttatcgggaaagcg

SEQ ID NO: 11196 - DNA, 722 bp, synthetic construct
  misc_feature 1..722: note = Description of Artificial Sequence: Synthetic polynucleotide
  source 1..722: mol_type = other DNA
gcgtttatttacggcgcgtgtagggttttaggtttagggagcgagcggggcgttatgggggtcggagtttgggtttaggtcgttttttttttaattttttttgggtttttttatttcgcggtttttttcggagcgtggtttatcgggcgtgaagagcgcgatggttttgaggtagttatattcggtcgagtcgatttgtaggcggtttagtttgtttatttgtttttggaaggcgcgtatttggtttatgaaagttacggcgcgttcggcggttataggcgcggcgtggaggtcggcggcggttagtagcggcgtcgtgtgtaggggtagcgtcgtttgcgtcgcgtttagtacgaagagttcgttttagtttaggcgtagtagcgttatttggtcggttatcggtagttcggggaagaagggcgcgtggcgcgtttattttacggtgttgaagagtagtcgcgtcgttagttcgtatacgttgtcgatgtttagtatcgcgttcgtcgcgtcgttttttgcgtcgaagcgttcggtcgtcgtagggtagggtttagcgcgtagtagttgcgcgattagttcggatatcggttgtttcgggaagaggttttcgtcgttcgttattgtcgttagcgtcgagttcggggggttgttcgaggaggcggttacggtattaggtagcgagtgcgggatgcggtcgcgttgtatcgttgcgggaggcg

SEQ ID NO: 11197 - DNA, 858 bp, synthetic construct
  misc_feature 1..858: note = Description of Artificial Sequence: Synthetic polynucleotide
  source 1..858: mol_type = other DNA
acgattacgttatcgtagattagggttatacgatagatttcgtttttatttatcgttttgagttcgattaaatagtatttacggtatatattagggttttcgttttttatatatatatattataatgacgtcgtaaataatagtattaattattatcgttcgtagttttcgcgtatagaggttttaggttttcggttttacgtggatcgatttcgttcggtagcgcggggttattttatcgcgagtttttttcgtagttcggttcgggttatttcgattcgttaggtttaatttaataattataatatcggaaaaggaagtaaaggtcgaagtttattcgcggttttgaggtttgtgggaaacgtagtttaataacgaaagagttttgaagtttaagcggagttcgttggtcgtaggggtcgtattacgttttagattttggagttttcgggtgcgtagatttttgttattagtagaggttgtcgttgcgcgttttttaggcgcggaagaggcggttggtggtttttgacggtaaggtgaagtcgaggtagtaatcgggaatttaggttgggaggatagaatggggaataggaagttggggcgagggtggttttgggggaggtggggggtcgcggaattttaggtggtttttgttttatttttggaaagaatcggaagttcgggtcggggagggtgaagggagtcgcggattcggttgtttagtcgaggaggaaattcggattttaggttgagggaggtcgaagaaggaattggagggtcgggttgggaaggtttgaagcgggtatagtttttaggttggggagggtcgaggggagaattcggagtttgagtcgggcg

SEQ ID NO: 11198 - DNA, 598 bp, synthetic construct
  misc_feature 1..598: note = Description of Artificial Sequence: Synthetic polynucleotide
  source 1..598: mol_type = other DNA
tcgaggtttcggcgggttttcgtatcggttttagtttttttttcgtatttgtttggtcggcgggttttatttttttttttgttaggggtagattttgggattatttagttcgttttcgtaggttttgagcgtttgacgtttgcgtattgagcgcgggcgggcgggtatttttagaaattttcggggcgttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgttaaggtaggagtgttcgggatgtcggagcggatacgcgcggagaaagcgtcgttggggttattcgtgtggtcgtgttttcg

SEQ ID NO: 11199 - DNA, 1281 bp, synthetic construct
  misc_feature 1..1281: note = Description of Artificial Sequence: Synthetic polynucleotide
  source 1..1281: mol_type = other DNA
tcgaaagtttaaagtttcgggtttatcggttagttttttatttcgttgttgggtcggataggtgtaggggaggcggattcgtttcgtagtcgatttatttagttttagggtttggtcgtatttgagtagcgcggttttcggttgttgttggcgttgtaggtttcgcgtttggtttgttagtttgcgtagtcggtattcggtcgggaagtatttttttagtaggtcgtttagtattacgtttacgcgtcgtatttgcggtcgcgcgggttttggttttacgtagcgtttgtagattgtgagttcgtagggtagcgttatcggtttatgtagtagtcgtcggtagcgcgggtagtcgagtaggtcgcggggcgcgcggggtttcggggtcggttttttttcgtcgggcgtttcgggttcgtcgttcgggtttttcgcggatagcggtcggtcgcgtaggtttacggcgcgtattaggtcgttcgttagtttttttagttttttcggtcgtagcgtttcgagtcgcgcggcgtcgcggaacgcgtttagggtttcggggaggcggtcggcgcgggttagcgcgttttttagttttaggtataggtcgcggttcggttgcgttagttcggttagtatggagcgaaagagttcggttgttatttcgtagtcgttcgcgcggaaggtttcgtcgtttttttttaagcgttgggcgatcggtttcgcgcggtcgtagttaggatattggggcggcggcggcggcgggatcggttcggggtttattatcgcggggttgcgacgacgcgggttcggagcgaaggcgcggagtagggaggatgcgttgttgttgggaattggtcggcgggagcgcggttttagttttcgttagtagttacgcgcgtttgggggcggcgcgttgcgagcggttgagatcgcgggcgggggcgggcgtttggtttgggtagcgtttttagcgcggtgtgggcggcgagtttcgtagggttgtaatcgtttcggggtgggggtcgggataggtatcgcgggcgtaatttgagtttttgtttacgcgtagcggttttttagtttcgtcggtttaggtaatttaggtcgttgcggtaacgtagtgatcgcgttttaggttcgcgttttttgcgatgttttttttattcgtttgagggtttttgcgcgattgcgcgcgcgttttttgtttgtcgttttttcgtagaggtgtcggggttttgggagtaggtggttttggtcgcgggttgttggcgcgtcggtatcgcg

SEQ ID NO: 11200 - DNA, 1788 bp, synthetic construct
  misc_feature 1..1788: note = Description of Artificial Sequence: Synthetic polynucleotide
  source 1..1788: mol_type = other DNA
tcggttaggttcgtcggtcgttttagtttagtattagggcgttcgcgcggttgttaaatattttcgggagttttgttcgtaaagggattacgaggtagttgttggcgcgttttgcgcgtattcgtttagaggtttttcggtttgtttttcgcgggtttgtttcgaaattgacgtgaaatcgatttggtgtaatgcgaatgagttttcgttcgttttcgtttttattttagtcgtcgtcgtcgttcgtcgttataataatcggtttttattttttttattttacgttttgtttttcgggtttttcgggttataggttatagcgcgggaaggcgtttcgttttcggcgtttcgtattcggtcgtcgcgtattttcgttcgttcggcgttttcgagttacgtagaggcgttttttttcgtcggagacgggaaagtttcggcgtttttagattgggtttcgtttttagttttcggaggggttggggttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaagattttcgagtttaaagagattttcggaacgtaagtggggatcggggaggcgagggtggaggtggtcgcggtaggggttgtacgggtagttttagttgtcgtcgtcgttattatcgcggtagaaatttagtttgttatcgcgtttttattgtttcgttttcggcgttgcggagttttttcgagcgcgttcgacgcgtgggtttgcgattttcgggtgggcgtcgttttcgggagggggagggggtagcgtcgggttgttagggagtagtttacgcgggcgcgcgattttttattttttttgttatcgtcgtttttttcgttgttttttttttacgcgtgattgtgggttgagtatggtggggatggttgtttatcggttgtgtgcgtttattcgtcgtgtgtatgggcgtatcgcgttggcgagacgtggttacgagaagattagtttttagtcgtttttatttttgtttttatattatgtatttttatggaattggtatttgtacgtacgaggtgtaggtaagattttgggtggttacgcgaggatggaagggaagggtttcgtagtgtttagggttatacgtgggtagagttttatcggagggtttgtgtattttacgcgggttcggtcgtacgcgtcggggagcgcgtttttaagggagggtttgtgcgcgtcgttgcgcgggcggtgtttttttcgggttgtatcg

SEQ ID NO: 11201 - DNA, 626 bp, synthetic construct
  misc_feature 1..626: note = Description of Artificial Sequence: Synthetic polynucleotide
  source 1..626: mol_type = other DNA
tcgttcggtttttcgcgtagtcgtgggatttcgaggagggcgtttattaggtcgcgtgtgattatgtaaggtaaatagggggtttatgaagttattgaggattaatggggagttcggagtagagtttggggcggggtttggttttggcggcgggcgcggattggtacgttgcggatttttttgttgttttataaggcggtgcgaggcgagttatttttagagggttatataagggggttgaggcggtcgttcggcggtcgggtagcgcgagcgtaagggatagggagggtcgtggcgatattcgcgttagttttcgggacggttgggttcgggttggtcgtcgattttcgattttttattagatgtttggtagagttcggcgcgttcggagttcgcgttttttagagggaaggggtcgcgcgtcgtcgcggcggttttgaggttgacggtcgggaggtgaaaggtcggagtgcggggttaggacgttttttggagggggcgcggcgtagggggtcgcggggaagtcgtcgagggcgcggagcgggaaggaaggatagtggttatttcgttttcgtttgggtacggggtagggattcgcgcgaggcggtgtcggggaggtttttacg

SEQ ID NO: 11202 - DNA, 1037 bp, synthetic construct
  misc_feature 1..1037: note = Description of Artificial Sequence: Synthetic polynucleotide
  source 1..1037: mol_type = other DNA
acgaagttttcgcgaattgaattgagagtagataaaagtacgcgtttttttttatcgttacgtcggttttatttaaattcgcgagttattcgtatttttttttaggagttatagttaggttagaagagtgcggagggacggggttcgggaagagtagggaatttttagagttcgtagttaacgcggaggtgggcgagcgggcgtgcgcgtatttatttgtcggcgcgagggagtgtcgggggggaagggagtggtttttaaaagggggaggggagaaggtagggggcggggagaagtcggttttttaggattcggttgcggcggcgagggaggaggaagaagcggaggaggcggttttcgcgttcgtagggtcgtgttatttgttcgttcgttcgttcgttcgttcgttcgttgcgtcgcgttgtcgatcgttagtatgttgtcgagagtgggttgtttcgcgttgtcgttgtcgtcgtcgtcgttgttgtcgttgttgttgttgttattgggcgcgagtggcggcggcggcggggcgcgcgcggaggtgttgtttcgttgttcgttttgtatattcgagcgtttggtcgtttgcgggttttcgtcggttgcgtcgttcgtcgcggtggtcgtagtggtcggaggcgttcgtatgttatgcgcggagttcgttcgggagtcgggttgcggttgttgttcggtgtgcgttcggttggagggcgaggcgtgcggcgtttatatttcgcgttgcggttaggggttgcgttgttatttttattcgggtttcgagttgtttttgtaggcgttggttatgggcgagggtatttgtgagaagcgtcgggacgtcgagtatggcgttagttcggagtaggttgtaggtaacgcggtttggaataagtagttgggagaaatttggagggtagcggagaagttcgacgggcggttggattttacggacggttttaggggcggtagagtcgagattttggattaaattaagggggattgttgttagcgggacgcggaagttaggttcg

SEQ ID NO: 11203 - DNA, 977 bp, synthetic construct
  misc_feature 1..977: note = Description of Artificial Sequence: Synthetic polynucleotide
  source 1..977: mol_type = other DNA
tcggatttgacggagtaatgtacgtgggtttttgattcgtaatatatttagttaaagtcggtttttattgttaagcgcgttagtagtttatatttattgcggtcgcggtttgatgtggtgatgtttatcgcgcggtttttataatgtagggatttttttgagtggtggtcgttttcgttttagttttcggttattcgtagttttatatcgggttattggtttattatcgagatagttagcgagtttaggcggtttttgtagcgttgggagaggaatgtgcgcgaaattaattagagcgaaattagtcggaggagtcggtcgaggtgtaggtgtaggcgtagtttcgtttagaattttttcgttatatttaagggagttggaagttcgggagggtgttgttttttttttttaggaatagagggttttgaagtgttttttttttagtatatagtcgttttcggggatttggatcgtacggcggtattataaatttggaggaggtatggaggtaagcgttttggcggcgtttttattggtaggtggaggtttttttttttttgtgttgtttttagtttcgggtatttatttttttatagataggattatattttttagcgttcggtttttttgtgtttttaaggtaggagggttagttagcggtcgggagggaggagtggtagtagagtcgattgtttgcggtcggtttgcgaggcgtgtaaggttcgaggtgtttagtaggtgttatcgtagttttagggttgaggtttggggacgataggttttggaggcgcggtaggtgtagagcgtttcggtagttttagggggtgtgttggaggggaatcgtcggtttgtttggatttttcgagtattatcgaggattttcgtcgggatttttttataattttaaatcggtttataatttcgttagagatgatagggttagggaattagaaatcggcggattagcgttagggtcg

SEQ ID NO: 11204 - DNA, 6206 bp, synthetic construct
  misc_feature 1..6206: note = Description of Artificial Sequence: Synthetic polynucleotide
  source 1..6206: mol_type = other DNA
tcgtttttttgcggtaggcgaggcggggtgtaggtgtgagtggggtgggaggaaggggaaaggatcggggtcgtcgtagtttttttggttagtttcgttgggttttgttagtttcgtttgagatcgaggcgtacggattagcggtcgttagtattttataggtggaggatattttttgcgttttaaggttaatgttatttcgatgggtttcgtgtcgttttgattttttttgatttaattttttggttatgatttttttattttttgggtttcgtttttgttagttttcgtcgacgtcgtttttttcgtcgttcgttcgggtttttttattcgtttttttttttttttggttcgacggttttattgaggtaaaaataaatagttttgagggtattttaaggagcgtgtagtggtttcgacggtattttcggggggataaaagaggtggttagttacgtcgtcggttttcggtcgaataatgggcgcgtagtagattgttagggggtatttgaaattcgaggggagggaaatatttgagcgcggttttttttcgcgaggacgtacgacgtagtttcgcggatcgttttttgttcgtttttttttatgtattttttttttgtgtggaattatttaaacgggagatttttggtagttttatgttaatgcgtcgaataaaggtaacggttcgcgggcgggaggttcggaaggtgtttggggtcgggtcgggcggggtggcggttaggcgggttgcgcgtgtttttcgcgtgtttttgggattgatataataattttttatttttgtaaatataaagttttttatcggttcgggtcgggcgtattcggcgtagggaggcgttggttttttcgggcggcgggtattgtagcggtaacgtacggtttttgtcggttgtggttcgggggattgagggtcgggagtgggggtttttgtgaagttagaagagaagtttgtagtagagtggtgatgaggggcgttgatattttatttttaacgtcgacgtttttaaacgcgatattttttgcggggtgagaatgcgggttcgttcggtttttttcgtgaggttagggttttttgtttttttagatattttaaggagttaattttttcgtagaagtttttcgtttttgtttttatttttaagtttcgcgttttttataaattttttgttgttttgattttgatttttagtcgtggtgagggttagagtgaatttcggcgcgtttttcgacggtattttcgtatattaggataggagaaattggagggtttggggtttcgggtttcgtagtcgtcggaggaagaatttatcgcggggttcgtaagggaaagtgaagaggttcgggatttttttaaagcgttggttaggatttcgaaggaaggggaggagttatttgaagtcggggaaggttttttgggtgttttgttttggatttttatgtttattgattttcgcgaagtttttttggaggggggtaaattcgcgttgttttttttaatttaattttacgcggtttatttttcgaatcgcgtgcgttaaggtcggcgtcgggggcgtattgtgatggcgttttgttttttttaggcgaagataaatatttcgattcgatgtttttatgtatgcgggtgtataggttttgagaaaattacgtagaaggcggttgcgatttacggttcgggttgggttatatttgtttggaggtcgttggtgtgtgcgtgcgcgcgtgcgtagtttaattttttttagtttcgggtggtgaaattagtttttaatattagtattttttaagtttttatttattttgattgtattcgtttgaaagtagattttatttacgttagtaagattggaagttataaataaagaaaaagaaacggatttattgaattttagtattttagtagcgtttaatagatttttttggttaaatttagagttttgtttgaatttatttacgtaggagttgttttgttttttttgttggtagaggtgtcggttttttatttttacggtttatttataattatgggtgttgttatttttaaaggatttataaggtgattaattttttgttatttgttgaatggaaggagtgttatatatgtaagatcgaatggggtaggtcgagttttcgttttatgttattttataatttagatgggattcgtgattagaaaataaaattggttaaagttgtttcggaattttttttttatttttaattttattagtattattaattagagtttaaaagagtaaggaaataatattagttatttttagatagaaatatgtttataaattttagataaatttattttaagatttttaatttttggggagattagtatttattatagtatttttaaaattagggtgagattttttaaaatatattttattatatgtatttttttttttttagtgtgtgagttaaaatattataaatataaaattattaaatattttttttttgattaattaatttgattaattttttaattaattaagtttaataattgtttttattataatttatgatttatgtggattttatttttatatgtttaatttttacgttagggtatttttagagggaaaatttaaaataattaaatatttttagtggaattaagcgtaagtaaaatttagtaaaatttgtttggtatataaagttttgtagaaaaatgttttttttttttttaataaagtgatattttttttatagtatatgatattttatgtggtttggttatttgttttttagtgttggacgattagggttattacgtattcgtggggttttttgttttgtttttcgaagattttgttttttgtgttttttcggggttgggttggatagaggatggaggtaggcggtttagtttgggtttaaacggaacggtagtggaggtgggggtgggggtgggggcggggggaattttcgttgttgtttttttttggtggtataggggaggcggtttgttttttcggaggttttagtttgttttagagtatagattgtttttttttttttcgtttagtacgcgttttttttgcgtttagattggtcgcgatcggagtttaatagtaggaggttaattttttttataaaggtgaagggggtacggtttcgtgggggttgcgtttagataggtagtttttttatttcgtagcgttttgattggagtttttgatttagtatttgatgttaatcggtaaataaaatgttcgttcggaatgaaaatgtatgaggtcgcgcggggaggagaaagttaattttattggggcgtacgaggtcgatcgcgcgtttcgggtttcggttaattcgattcggattaatcgagttttggattacgcggaagtttcgggcggtttgggtcgggtttcgttaaagatgttatttttaagtttttaagaatttaaaagtttagaaatttacgtttttttgggaatttagtttagttcgttcgcgttttaatttcgcgttttcgggagattgagaaggtcgtgttaatttttttttaaattcgaaagaaattttttttagtttcgtgggcgcgcggaggttgcgagtataaatatcgttttcggttattgttagaaggtcgggttttttgtttatatttggaatttcggggaatttttttgtttggttttttgggtttagcggtttattcgtttaaggttcgggcggaggtcgttcggattttgttgttttttcggatttttgtttattttttaaatattacgcggagttattgcgttttcgtaacgatttttttcgtatcgtttcggcgcgttttcgtttttatttaattagcgcgtataatttttttttcggtttcggttcgcggattgaatttttttgatatatttggggttattttttttttttgttgttattttgttagcgattcgcgggtaattttcgcgcgggaggggggcgtgtattgtcgcgttgatggacgggtttatttggcggtttcgcgtttttcggaggagagatataaagtttaggtacgtgcgtttttttatagagaagtagtagatcgtgaagggaggcggggtcgggcgtgtgtttggatcgggcggggcggcggcgtcgggcggggcgattaggggcgcgcgcgggggtttcgcgtttttaggtatatttgtcgtatttatcgggcgattttcgagtttcggtttttttttggtcgttttatcgtttttttattttgttaggttgaggagttgcggacgcgttgattggttttaggggaagcgggaggcgagaataatggtttttttttttcgttaaaagggagcggttgtcgggttcggggatagggacgcgcgtgtagggcgtagagttgggtcgagtcgtcgtcggcgttacgcgagtttcgtagtcgtcgcgttcgggtaatgggtcgggggtattgagggtcgtcggggtcgagcgcggaggggggatcgagttagtgtcgtgttttcgggtcgcgttaatatgtttcgcggttttttggtgaagcgtagtaagaagtttacgttcgttttttatcgggttcgcggcggcgaggacggcgatcgcgtattgttgttttcgtttagttgcgggggcgttcgcgtcgagttttcggcgtcgagttcggttttcgggtcgttgtcgtcgtcgtcgttcgcggagcgcgtttatgtagcgttcgtcgtcgcgtttgtttgcgcgtttgggtcgtagttattttcgtagggttcgcgggtcgcgtatttcggtaatttcgaggttgcgtatttcgcgtcgttttatagttttacgcggttcgtgagtcgcgagtacgagaagtataagtatttcgaacgtagttttaatttgggttcgtcggtttcggtcgagtttttttttacgttcgtcgcgttgttcggagggggcggcggcggcggcgcgagcggagttggcggaggcggtatttgcggcggcgattcgttgtttttcgcgttcgtcgagtttaagatgggtacggcgttttcggttggcgtcgaggcggttcgcggttcgggtttcggttttttattgttttttgtcgtcgttttgcggttttcgggaaagcggttttcgttttttatcgtcgcggagtcgttcgttaaggtagttaaggtttcgggcgttaagaagtttaaggttattcgtaagttgtatttcgaggacgaggtgattacgtcgttcgtgttggggtttaagattaaggagggttcggtggaggcgtcgcggggtcgcgcggggggcgcggcgcggtcgttgggcgagtttatttgttagttgtgtaaggaggagtacgtcgattcgttcgcgttggcgtagtataaatgttcgcgtatcgtgcgtgtggagtatcgttgtttcgagtgcgttaaggtttttagttgttcggttaatttggtttcgtatcgtcgttggtataaatcgcggttcgcgttcgtcgtcgttcgcgcgtcggagttagaagtagtagttagggttgaggcgcgggaggtattcggcggcggtagcgatcgggatacgtcgagtttcggcggcgtgttcgagtcgggtttcgaggacgggttttacgagtgttattattgcgttaagaagtttcgtcgttaggtttatttacgtaagtatttgttggcgtattattaggcgttgtaggttaagggcgcgtcgttagcgttttcggtcgaggatttattggttttgtatttcgggttcgacgagaaggcgttttaggaggcggtcggcgacggcgagggggtcggcgtgttgggtttgagtgcgttcgtcgagtgttatttgtgtttagtgtgcggagagtcgttcgttagtaagggcgtttaggagcgttatttgcgtttgttgtacgtcgtttaggtgtttttttgtaagtattgttcggttattttttatagttcgttcggttttacgcggtatattaataagtgttatttattcgaaaatagataggtgatttttttgtaggtgttcgtgcgttcggtttgttagagcgcgttttttatttcggttttcgaattgtgttttcgtttggagatttataaagagagtgcgttttgtatttttcgaattcgagttcgcgttgggggagtttcgttttcgtttttatcgggtgaaagtgtcgttttcgtttttttcggtgtggcgtgacg

SEQ ID NO: 11205 - DNA, 574 bp, synthetic construct
  misc_feature 1..574: note = Description of Artificial Sequence: Synthetic polynucleotide
  source 1..574: mol_type = other DNA
gcgtttttttttttgttcgcgttttcggttttttcgttggtttttgttcgagtttttagtttttttgtattataggtttttggggtttcgtttcggattcggttattttttaggttcggagtagtcgtcgtggaggtcgttttttcgcgtttaggggaagggaaggcggtttcggggttcgttgcggggtggagggattcgcgttttttagtttttcgggttcgggtcgcggggatcgtgcgcgcgtttttttttcgggtaaggtcgggcggcgggcgcgtcgcggtttttggggttttcgtttttttgttcgttatcgtttgcgggagtttttggtttggaggggttcggggcgcgttggcgattgcgggttcggcgataggggcggttggtggcgggaggatagtgggaggaaggtttcgttttacgcgtttttttttcggatgtgattcgtcggggtttttcgtagtcggggcgagcggtttggaagttcggaggaggggtacggaattgttcgatggggatgcgatcgcgggcgttagacgaattgtttttatattcgttggcgttggcg

SEQ ID NO: 11206 - DNA, 3438 bp, synthetic construct
  misc_feature 1..3438: note = Description of Artificial Sequence: Synthetic polynucleotide
  source 1..3438: mol_type = other DNA
tcgttggtggagttcgtttttttgaagtcggagttggcgagtttttcgtatttgattttgtaggcgtttttttcgcgggttagtcgggatattttttgtttaagttgttttatttgttgaatgagttgcgtttttttattttttaggtggtgtttttgttggacgcgtttatatttgtaagattgggcgtagtttcggttttttagggttcgtcgtttttgttttaggcggattatttcgtttttggtgaagtttcgtaggtggcggtttagttcgcgtacggatatggatacgagttggtcgtcggagaagcggttttttacgttgtcgttgtcgttcgtcgtcgtcgtcgaggtcgtcgcgtgcggttcgggttcggggtggttagtgggtagttgttgcgtcgggttagcggcgttggacggcggcggcgacgtttggtgatgatggtgatggtgcgggtgagcgtgcgggtttagttcgtcgtgggttacgtcggcgttcgggtacgtgtggtgcgggtgagggtggtggtgatggtggtggtggtgagcgtcgcgaaagttgtcgaagttttgtagcggttgtggtattgggtgcgagtcgatgagcgtttttatcgcgttttcgggcgttaggttgagcgtttcggggtttatttgttggtagttgttcgttatttagtatagattttcgaggtgtgttttttgttcggtcgggttgaagttgggcgacgagggtacggagttatacggagtgttgagcggtgtggaggatatcgagtcggttggttgtaggcgtgtgtagggtttgttcggacgtttcgcgcgttttagtggttttttttttacgtcgaatttgagtaggtcgaagtcgttgatatattttatggttagcgggttggtgggtagttttggttttatgtttagtttcgcggttatcgttgaagcgaggcgtagtcgtcgttgtcgttcgggaaattttgcggtcggtcggagcgcgtcgagttaagcgcgggggggaagagcggagaagagttggggaggcggggagcgagggcgtagcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtcgcgatcgttcggtttacggtcggaaggtttggacggcgtttcgtatttagttaggttttttttatttggtttaatttaagttagtttagaacgtatattatgtgtgtattagagtttaggataggtttttttcgagcgatgtataggttttcgggtttcgttttcgtatttagtcgcgagtttcgagtcgcgagtttcgttttggtcgtttcgttgaaatttcgtgttttagcgttcgggggtgttcgtcggttgttttttgggtcggaaggttttgggcggaggaaggtcggtagttaaaagtggaagcgttatagtgaagcggtttagggttatcgggtgagaaattttttcggagggtagacggggagatcgaagtatatcgtattaggtatttagattgggtttgggagtcgcgtattttttttatttagatttaggatggttagaattaacgggttttttttgagatttcggtttaggcgtcgaaatcggatagatcgcgaattcgttggattcggagattcgattcgtttttcgcgttatttttttttttttagttttgggcgcgcgtagcgaaaggtaggagaggcgcgtattgggtgagtgagtttcggtcgttgtttgcgttggattagttcgattgatttcgcgcgtaggggtcgcgtgagttatatcggtgtagacgcgtttagattatttttaaatgttagaaggtaaaatatttgtttttaattaatttgaaaattttttatttttttgcgttttcggagaggttggggtacggcgtggtattgggtcgtttatttttaataaaatgagtgtattttaattaaaatttaatttaattttgtggggtggtaaattaaatgttggaagagcgcgtttataatttttttcgagaagcgtgtttttcgtagaaatgagtcggtcgtttggagagagagtttgggcggtgtcgttgcgtagtttttgttagtagttgggggttggggattcgtattttgtaaatgttttcgttttgtttgaacgtagtgagagtatattcgtttttagattattcgggatcgggtgtttcggatttgtgtagattatgtatggtttcggttttaggcggttagggcgggataagtacg

SEQ ID NO: 11207 - DNA, 4088 bp, synthetic construct
  misc_feature 1..4088: note = Description of Artificial Sequence: Synthetic polynucleotide
  source 1..4088: mol_type = other DNA
acgtttcgagtatcgattttatagttacggttatcgtttttcggttttcgtgatatcggcgcgtttgttgtttcgagtaggggaggttttgtatttttatcgtatttttttcgttcgaagatacgaaatttcgttcgggcgtcgtaaataattcgaattcggttttttgatatttatttcggcgggcgcgcgtcgttgggagggcggggtgggtggttggaggtaaggaggcgtatagtaggggtaagcgtcgtcgtcgtatattttgtacgtcgtttagggttatattatttatcgaaaattgggaggtaggtttgggaggcggggttgagcgtttatcgttttgggcgcgttcgcgtttttcgttatcgcggttttcgcgttttcggtttacgttcgcgcggtttcggtatcggtttgtatttttagggtgcgcggcggtttatttgggtgcgttttcggtgggtcgatttttcgcgtttttttttcggtttataggggtcgttgttatgggtcggttttttgaagaggttggggcgttatcggggtcggttagaagttttgtttttcggcggggatatttagtcgcgtcggtatcgcggagcgggttgcgttaggtggttggtcggcgcggcgtttttttgttttttggtttcgggttgcggcgcggcggttggagcgagtttttgtttcggcgcggggcggcggcgggcggtcggtaggcgttgttttgcgtgtgagtgtattttatttatatgtaagtcggggagcgtcggggtttttcgcggaagtgcgagtcgttcggcgtaggtaagagtcgtcgggttcgggataaggtaggggcgttcgggcgtcgttgttttgtttcggggcgttttcgggtattttttaattttttttttttttttttttttattggcgtgtttaagagttaaattaaggagcgtttgagggtaaatagatttttgttattcgcgtttttgtatttttttttttgagttgatattttttggtgttttttggtttttcgttgttgttgggtgttttttggtttgtttttgtttttttttcgtttgtttattttttttggcgttaatttttaggtagttagtttagtagttcgaagttcgggtagtcgcgtttcgcggtttcggggtagcgcggcgggaatcgtagttaagtttttcgatacggggcgtacgggggtcgggtagttcgaggtcgggggtaagtagggagttcgggttaggcgcgagtcgagtttttcgaggtggtcgggttattatgttgaagatggttatgaagtttaaagttcgggcggcggagagcgagaagaagacggtcgcggcggttgtcgaggtggttgtcgaagttgcggcggcggttgcggcgttggtcgagtcgagagagtcgttcgcgtcgcggaagagcggggatttcgagaagttcgcgaagaattttaagaattcggcgcgggaggcgtttttcgaaaagtttttaatagataaggagcgtaagaagttcgagaagaagttgttggagtagaggcgaaaggaggagaagaagaaggagaaggagaggaagaagatggagaagatgttgaagaagaagaagaagaaggtgttagaagtttaggaggaggttcgatgtttcgaggtcgtcgtcgtcgcggtcgtcgtcgacgacgatgagggcgtcgaggagggcgtcgtcgggggcgtcgaggagggcgtcgtcgtcgggggtacgagtagggtttgggttgattgggatacggattcgagcgacgaggacgacgtttattacgcggcgtcgcgcgttgggggtatcgtgtggcggttcgggtcgtttaaggttggcgcgttgagcgtttatttgtttttcgtggtgtttttggttttttcggtgcgtagtttttcgtgggtgtttaattttttgttgtagaagcgtacggagtagggtcgcggttgcggtttcgtgttcggggcgatttgttgttttcgagtgtttttgggttgcgttttttttttttatttgggcggtcgcgttaagcgtagaggtcgcgggcgtttcggggttagaggcgttttcggttcgggttatggcgttcggcgtcgggggcgcgaggagcggtttatttagttagattttttatttcgttatcgttattagatattattatcgttgtgtagtgtgggtttttattcgtgttcgtgtgtgtgtgtggatatattttttttttcggttgttttgttttttggttcgtgttcgtttcgttttttttatatttttgttttttggttttttgtgtttttcgttttttcgaaaatttttttaagttcgggcgcgcgtttttttttttttcgtttattttagtttttcggcggcgttcgcgggagggggaggaggtttcgggggcgtcgggcgacgcggttcggggggtggagcgttggcgtcgtgcgaggggtcgttattggcgcggagacgtttttttttttttttcggtttagtcgggttgttgttcgagttcggggggtggggggcgttttttcggttcgtttcgttttcggtcgggcgcgggcggagggatttttttttcgggttttcggggggtcgttttttttcgtcggttttcgtttttttagtcgtcgtcgtcgtcgcggtcgtttttcggtttttttttttttttttttttttttatttttttcgtcgtcgtcgttttttttttttttcgttttttttcgttcgtcgcggcgtttttggttcggggcggcggcgggggttcggtcgaggtaataagagcggcggcggcggtagcggcggtagtagttttcgtagtttttgttttggttcgtttcggttcggcggcggttattagttttttcggtttcggttcgaggggcggggagttgcgcgcgtttttcggttcgatcgatattttttttttttcgttcgttcgcgcgtttcgcggttcgcggttcgtagttcgtttcgcgcgttttttgtcgaggagtcgagttcgcgttcggttcgttcgttcggcgttgtttcggttttttcggtttgcgtgaggtcgttcgcgttcgtcgtcgtcgtagttcggtcgcgtttcgtcgtcgtcgtcgtcgttatgggttgtttcgggaatagtaagatcgaggattagcgtaacgaggagaaggcgtagcgtgaggttaataaaaagatcgagaagtagttgtagaaggataagtaggtttatcgggttacgtatcgtttgttgttgttgggtaagggcgggcggggggcgtcggtttcggttcgggggttttcgaagggcgtttcgtaggtcgcgcgcgtcgagttcgtttttcgtttcgggcgcgcgttttcgagtttttcgttcgttcgcgggttttgtttgtggggggcgaggtcggaagggggatttaggggcgcggattcggtcgggcgggggtttaaaaacggggcggggggtcgtggcgacgcgggcgcgggtttttttttttcggtttgttcgtttagtgttttttttttgttttcgttttcgtttttttttttttttttttttttttttttttttcgcgaggtttatacgacgttaggggtttgggtgcgtgttggggagggggagggggagtttatggggtttcggagattgcgataaaaagagggtttcggggataggaaatcgggtggcgggtagagggagggggattcgttttcgtggggtgtgagatttgttgggagagggaaagaggggaagaaaggggcgaggagaggagggggtgacgttggggggcgtcgtggtggcggagggggtttcgttaaagggaggttttggcggggagaagtggtcgaggagagtgggggggttggtgatattagtttttcggaaaggatcggagcggtaaaggtggtgtagtgggggggagggggcgtaagggagtcgtggcgtcggagtcgggaggggggcggcgaggggaggagggagggcggttgtcgttgggcgcgatttggtgcgtttcgggtaggatcgattgattgtgtgtgcgcggagtagacgtgtttcgggttaggtcgggtcg

SEQ ID NO: 11208 - DNA, 522 bp, synthetic construct
  misc_feature 1..522: note = Description of Artificial Sequence: Synthetic polynucleotide
  source 1..522: mol_type = other DNA
tcggttttatttcgtttaaagtcggatttcgtttagtttcgtgaaagcgaaggagtattagcgttttttgatttcgtatagttttttcggtagagacggttcgttttttttaagaatcggaagtcggatagcgttaggacgttttattttttttatttgggatttagagaggtagcggttaaggatagggttttcgtcgaggttatcgggtagcgtttaggtttcggtttttgggaggggagtagcgggggaggggtacggggaggggcgagggcggggcgcgtttgggtttcggcgttgggttttttttttgttcgtttcgggggatatttataggatttttgtagatttttgtcgaggtaggatggaggtttgtagggatgtatcgcgggttcgcgattcgggcggtcggaatatagttttttttggtcggagatcggttcggtcgtgagtcgtgtttgtgttaggttttttacgttgtgttttagggttttagtgttcggcgcgtcgggggttgtatcg

SEQ ID NO: 11209 - DNA, 2260 bp, synthetic construct
  misc_feature 1..2260: note = Description of Artificial Sequence: Synthetic polynucleotide
  source 1..2260: mol_type = other DNA
acgttttcggaaagttttttttaatgggaagcgatttcgtcgttgagttaagcgttcgaattttttttttcgcggtagggatatcggttcgggttaggtttgcggaggacgttttcgggcgcgtatatatagttcgaggacgcgttttgtattttaagacgtagggtcggattttatttcgaaatttggtttttatagttttaggtcgaattgtgtttggtttttagttttcgagttcgagttttacgtcgtaaagagatggggttttattgtgtttagttggttttttagtacggacgtgtatttttttttggtttgttttttgttaaaaatcggtagtgcgtttcgtttttttgtttagtcgtagtttgtcgttttttagataaaaagcggcgatcgcggttcggttattcgagtttcgtcgcgttgcgtttttgttgggcggtttatagatggtgtttagtacggggtcgcgtcgagggcgggggcgggaggtcgcgaagagggtcgggcgggaggggaggagacggcggagtagttaattcgcgcgcggtttattagttgatcgtttttgtttatattaggtgtacgtcggttgcggggagtataaagcggggcgtatcgcgggcgtcggtaacgagtcggtgaacgaggcgaggttcgtgcgttcgcggttgtaagcgttcgtttggcggggagaggggtcgacggcgttagttcgggcggcggtatttttaggcgtttggggcgttttttttcggatttggtcgttcgttgtttcgttttttgtattttattttttcgatttttttttttagttttgtttttttttgttttggtttttgagagtcgattgagtttagtttcgtgtagtagcggttgtttgtgtcgtcgtttagttttcggttttggtgttttttcgggggtgttttaaggagttagtgcgcgttgcgggttgggaaggaggcgtcgtttagttagttttttttttttttttcgttttttttttttttttgttgttgttgtcgtcgtcgtcgtcgtgggtgtcgggttcgcgcgtattttaatatttttattagttgggtttcggggtaagtttttggtcggtcgcgtcgcggtaggaggtgtgggaggtagcgaggggaagtcgaggtaaatttggtggcgtgggagattttacggggtttggggaattttagggtaagatcgcgggtttgagggggacgagggggcgcggtttacggagttggggaaaatgacgaagtcgggaaacgagaatatagtgtttcgttttttttcgttttttttgttaaaaaaaaaaaaaaaaaggtgtgggagagcgatagttgggaaggtaggttagatagaaataggtaaaaaaaggtagtgatcggagtcgagtttgttggattttaggggtcgattaggggagggaggtgttcggggacggggagggaggagggttgtcgggatgtgaatcggggaaggtagttggggttggagagtagcgcggaaagggggtttagggagttggaaagagggttaagaggagggtaaggaaggtggcgggcgacggggagaggaaagaaaaagggtgttttggcggtggttttggtaagagaaaggggtaaggggtataattgataaggtattgaaagtattgaagttagagttttgggaaggatttatcgaattttcggcggtttacgcggggatagattttagttcgtgagttttgagttttacgcggggatagattttagttcgtgagttttgagttttacgcggggatagattttagttcgtgagttttgagttttacgcggggatagattttagttcgtgagttttgagttttacgcggggatagattttagttcgtgagttttgagttttacgcggggatagattttagttcgtgagttttgagtttagaaggagtggtagttttaggacgtttgttaggtggtttggaatgtgagggaagttttagtttcgttaggaatagagttggcgttgagttttcggttcggttcgggttagaagcgaggaaagtttgtcggcgagtgttttttgtgttgcgtggagaggggtgtgggcggtcgtcgattcggcgttttttcgtcgttcgtttagggagtttttgtttggtaagttggggttcggggaaaagtttagtagcgagagggtcgcgtgtttcgggacggttttaggggagttcgcgcggaaacgcggattaggcgtttcggttcggatgtcg

SEQ ID NO: 11210 - DNA, 1502 bp, synthetic construct
  misc_feature 1..1502: note = Description of Artificial Sequence: Synthetic polynucleotide
  source 1..1502: mol_type = other DNA
tcgcgggacggagatagggagttgggaggaaacgtaacgcgttttttaggtaatagatttcgagtttcggttcggaaacgtttcgaggtagaagtaagggtttttaagggtttcgttttttagttttgggtttttattattattttttttttagattcggtgagtttaggttgatggatcgtgtagtttagtttgagttagtttagtagtttttaatcgggcgggtagggaagaaggttttttattgtcgggaagaggttagcgcgttttaagtttttcgtaaatttcgtttttttcgtttggtacggtttttttgtatcgttgtgtttcgtttttaggtttttgttcgttaagaatgtttgtttcgggggcgcgttcgttggttaggaatttgtcggtagttttcgggaatttttgaggatgcggaggtgggttcgagagttgcggtttcgatgtcggggtgggagttaggtaggtcgcgcgtcgtcgtagttttgtcgtagcgcgtgttttggttttttcggatcgaaaaggtcgaagtcgtttttcgcgatcgatttcgcgtaattggttcgggtttgtatttagatggttgtgggttttatagggatggtcgggcgggttcgttcggtcgttattttagggtcgttagttttcgcgcgcggtcgtttttcgttaggaagggtggcgggttcggaaggttagagatgttttagtgtttttcgcgtcgttacgtatttagttgttcgcgggttttatatggttgcggtcggagggttcgtattaggatcgtcgtcgtttggggaagcgtttttttgtgggtagggcgcggcgggtagtgcggaagttcgaaagttatcggagttcggggtaggggcggcgcgatgtagaggcggcgttcgggggtttttagttgtttgcggttcggttatttagtcgcgattagagggggcgggggacgtaggaatttcggcgttcgggcggtgtgtagtcgtagatttattttaagtttttacgtagttgcgagagtttaaaaattgttacgtgtacgtcgttgttgagtgggaggaggtgtttgttatcgcgtttaaaaggggcgtttcggtgtttttcgttatgtaagtaaatggtatggttttcggtcgtttttgaataaacgagtgtttcgaattttttattaggagggattaggcgtataattattttcgatatttttcgggtatgcgagaattcggttttttttagtggggtttattaatgttgttcgggaggtaaagaaagtgatcggttaacggttttagcgtgggttttttttttttttcgtttttttttttaataaaggacgtacggagaataagttttttagtttttatagatgaggagtttaggagtcgggcgaatattaagtatttattgtgtgtttgtttttttattttggggaggttgggggttcgggagtgaagggggtagcgagatcgcgggttgttttacgtttatcgtcg

SEQ ID NO: 11211 - DNA, 510 bp, synthetic construct
  misc_feature 1..510: note = Description of Artificial Sequence: Synthetic polynucleotide
  source 1..510: mol_type = other DNA
gcggtcggttttggaagaggtgggggcgaggggtcgggggtttatacgttttgcgatttttttttatgagaatgggcgggggtagtttcgggaagggtggcggatggagtcgttttttttttaggattataggggcgttttttagtgaaggcgtcgtaggaaacgttagtttgtgtcgtagtgtacgtagaggcgttatgagttcgagttttttacgtttagggataaattgggagtcgtgattgttaggtcgcgcggaggttgttttggtcgtttttgcggttaggtgaaggcgtagaggtagggaggtcgggcgagcgtaggcgggcggagagtagattacgcggaagaggtcgagagagaaagcggggtattcggtcgggggggttatttataagggacgttgggtacgaaggaggttggggcgaagatgagtttaggggttgggttgagagcgttgcgtagtcgggttgagaagagaagttgacgagtgattttcgataagggacg

SEQ ID NO: 11212 - DNA, 940 bp, synthetic construct
  misc_feature 1..940: note = Description of Artificial Sequence: Synthetic polynucleotide
  source 1..940: mol_type = other DNA
tcggggcgtaggtaggaggtattggaagcggaagcgagtggggagttcgggtagagggagtcgtttatttgatcggtttcgtttttttcggggtttgttgtagttgagggtttcggattagcgattttagaagtcggttcggggtcgggtagtttaatagtttttcgcggattttttttcgttggcgcgtagtagcggcgcgtggattcgcgcgcgggttcgggacggcgcgagttcgggtagcgcgagtttttgcgcggtagggagtggcgtatgcgcgggcgttttgcgagttcgttggggcgagtcgagtcgcggcggcgtcgggagtcgggcggcggagttgtgaagaagtaagcggcggtacgggagtagcggcgacggataggtggcgagttttcgttcgcgtcgttaggggttgttgggttattcgcggagtttcgcggtttagacgtggcgggggtggcggcggtatttcggacggtttgtgagggatgcgtcgtttattgtttcgcgtcgtttgatcgttttcgtttcgattcgcggtgcgttatagtcgggttcgcggtcgttttcgtcgcgttgtcgttcggtcgtcgcgttcgcggggtcgcgttcggtacggttatgtggatttttacggaggaggagaaatacggcgtaggtaggtgaggtttaggtttggtcgtggcgggggttttgggggacgcgtttagttttcggtttcgtttggattcgtattttcgtgttttcgttattgttcgtaggttgcgcggtttcggcgtggggcgagcgcggggtgggggtaggtgcgggtgcgggtgcgggtgcgggggtgggcgcgggtttttgtgtagagagggcggtagggggcgttggcggtgcggttttggtaggtgcggttcgcgggaggggtgggtaaggttcgggtagttgttcg

SEQ ID NO: 11213 - DNA, 2718 bp, synthetic construct
  misc_feature 1..2718: note = Description of Artificial Sequence: Synthetic polynucleotide
  source 1..2718: mol_type = other DNA
tcgtcgttagttatgatttatgttttagtagcgttgggaagtgggtcgagggaattgaggtcggggtgggtgcggaggtggttttgacggggagcgtcgatttaggatttggttcggattttgagttcggtaggatttgtgcgtacgtaggtagcgtcgcgtttttttttaggttgcgagaggttgttttgttattaggttatggatttcgagtcgttcgtgttgcgcgcgcgcgtgtgcgcgttttcgtttgcgtttatgtttgcgtcgggggaggcgaaggaggttttagttttagaaagagtagtttttggaatttattatttaggtcggtcgtcgttcggtttcgtttcgtaggttgtaggcggttttggagggggcgttttcgtcgagcgcgcgtttcgcgtcgtcgtttcggattttttttcggcgtcgcgcgggtaggttcgattaggcggtcgcgggtttcggttttcggttagttttttagggttcgcggttcgtttcgtttcgcgcgttcgtttcgttgcgtaattcgatttaagttggaagtcgatcgtaggcggtcgtattcgcgtttagcgtagggcggcggcggcggcggcggcgtagtttcggcgagcgaggcggcggtcgtacggttaagcgtggatcgcggggggcgttcgcgttcgggagtagtcggaggattcgcggcggcgtcggcgtttcgttcgggaaagtaaagttggagacggagggagcgcgcgggcgcgggggttcggaggagcggcggtcggcgtttcggcgcgtcgagttttagtcggtcggatgggaggcggagcgttcgggtcgtcgtcgtttgtcgtttgcgtttcggttgggtttcgggatcgcggggtcgtttaggtacgttcgttcgggcgtcgcgtcgtcgtgggttcgacgtcggggcgtttttcgtgagtcgggtcgagggcggggtcgcgcgaggatttcgggatttgttttttttttttcgtagtcgcgtcgtcgttcgtttcgggcgttttttgttttgtatttatacgttcggtagttgcggggagttcggtagttacgtttttcggcgcgtcgttcgcggagttattacggtcgagggtcggttgttgggcgtcgcggttttcggcgggcgcgttcgagtagtaggcggcgatgcgggcgtcgatttcggttggggggcgttcgagttgtcgcggttgcgtttcggttttaggagggacggcgtagttcgcgggaggattatggcgttttcggcgttggcggcggcgttggcggtggcggtagcggcgggttttaatgcgagcggcgcgggcgagaggggtagcggcggggttgttaatgtttcgggggttttttgggggtcgtcgcgcggttagtattcggcgggcgcggtggtagggttggttgtcgtggtgggtttttttatcgtttttatcgtggtgggtaacgtgttggtggtgatcgtcgtgttgattagtcgggcgttgcgcgcgttatagaatttttttttggtgtcgttggtttcggtcgatattttggtggttacgttggttatgtttttttcgttggttaacgagtttatggtttattggtatttcgggtaggtgtggtgcggcgtgtatttggcgttcgatgtgttgttttgtatttcgtcgatcgtgtatttgtgtgttattagtttggatcgttattggtcggtgacgtaggtcgtcgagtataatttgaagcgtatattacgtcgcgttaaggttattatcgtggtcgtgtggtttatttcggtcgttatttttttttcgtcgttggtttcgttttatcgttagttcgacggcgtcgtttattcgtagtgcggttttaacgacgagatttggtatattttgtttttttgtatcggtttttttttcgcgttttgttttattatgggtttggtttacgcgcgtatttatcgagtggttaagttgcgtacgcgtacgtttagcgagaagcgcgttttcgtgggtttcgacggtgcgttttcgattatcgaaaacgggttgggcgcggcggtaggcgtaggcgagaacgggtattgcgcgttttcgttcgtcgacgtggagtcggacgagagtagcgtagcggtcgagaggcggcggcgtcggggcgcgttgcggtggggcgggcggcggcgagcgggcgcggaggggggcgcgggcggtgcggacgggtagggggcggggtcgggggcggttgagtcgggggcgttgatcgtttttaggttttcggggttcggtggtcgtttgtcgcgcgttagttcgcgtttcgtcgagttttttttgtcgcgtcggcgtcgggcgcgtagtagcgtgtgtcgtcgtaaggtggtttaggcgcgcgagaagcgttttatttttgtgttggttgtggttatgggcgtgttcgtgttttgttggtttttttttttttttagttatagtttgtacggtatttgtcgcgaggtttgttaggtgttcggttcgttttttaagttttttttttggatcggttattgtaatagttcgtttaattcggttatttatacggtttttaattaggattttcggcgattttttaagtatattttttttcgacggaggagaaggggttttaggtagtgattcgtattcgtttgggaattttggatagtttcgcgttcggggttgggtagaaggggcggttcggacg

SEQ ID NO: 11214 - DNA, 2661 bp, synthetic construct
  misc_feature 1..2661: note = Description of Artificial Sequence: Synthetic polynucleotide
  source 1..2661: mol_type = other DNA
gcgcggttttgtttcgcgttttttttagttagtatttacgtgtttttatttattttatttaggttattagttttatcgttcgtagcgggttagaagattcgataaagcgttttttattttgtaggattagtgttcggttttcgttgttttttcgttttttttttgcgtagatttaaggtttgattcggttttaaattttaaataaaagttgtgggtttgtttttaagtgatggcggttggagaaaattagagttgggggcggtatagttagggtgtatttttgcggtgggtcggttcggcgtatttatagtttttagttgttagtttaggcgttggggtcgtagggattgaatttcgtatcgttttcgtagttcgggtgcgcgttttatcggtcggtttgtttttcgcggttcggtttatcggtggtagggacggtttcgtttgttttagtttacgttcgttttttttttttttcgtttgtggttttgttcgtttttatttaagtttttggtggtttaacgtatttttgtagagatatttattaagagatagcgtgtgtattttgtttttcgttttacggaagaatttattagtagcgttatttagttttattcgttttaaagtacggtattttttagtttaataaaaagatcgaaggcgaaatattgtgggtttttgttcgcgaattaatcgtttagttatcgaattttttaaattgatttatttggaataagttattttgtttttttattttttattttatatatatatatatatatatatatatatatatatatatatatattgcggatcgggggtttagttacgtatatattttaaaataaacgagggatttattcgggatttttagtcgggcggtcgggcgttttcgttttttttttttttttttgagttttttagggattcgttacgtttttcggaattggggtagcggttcgtttatttcgtgttcgttgttggtcgggatgattttagattcgtttattaaggaagatttgatgttagttaaatcgttttttttttcgggatgattgatttcggcgaagattttttttttttgaggatcgttttcgtttttgaaggggattatttcgttcgtggcgtagagtttcgggtttttttcgtcgtcgttatttttttcggagagttggggtatttcggcggttttgtaattttcgtttcgttgtgggagtattcgcgtaatagtaggaaagatagaggggtaatttaagggtgggggaggaaaggagagttggaagggttcgtgtagtaggatagcgggcggaagcggggcgggcgagcgcggggtcgtcggtcggtagtcggagtagttgtcgcggcgttcgaatttcggcggtcgtcgcgttttttcgtttcgcggagatcgacgtaggcgttcgttttcgaggtcgaagggtattgggcggcgagggttgcggtagttggcgatttcgggggcgtttgcgcggcgcgcgttagacgaggttgtttcggcggttatttcgcgatttcgcgtcgtcgggatttgcgcgcggagaacgtcggttttggagggagtacgtttttttaaagtgtagaggagggttcggcggcgcgttttcgcggaaattttttttattgtagttatttcggatgtcgatttagtagtttgtttttcgagaaaagagaggggatttgggtagaagggtttcgtttgttttaaaagaaggtgtaaggattagaagataacgaaacgtttattttttgaagggtgggaaaaaaagaaaaagaaaaaggagttatttacgttggagatgttcgttttagatttttttatttttttttttttcgtttcggttttttttttcgaggtttatttaatttgttagagaaggaggaggagtagaagatgggggtcgaggaggaggggaagagaaagagaagtttgttaagaataaagtttttgtcggtaagcgcggggatttcgtagtggagggtattgcggagtttcggggagttatagcgggggtttcgggtttaaatgtttttgttcggagttcgagtcgatatatatatttagttcgatttttttttgttttcggttcgagttttttagtttggttcgtcggttcgtcgttttgtacgttttcgtcggttagttttgttaaagtaaagagttgcgttttttgagttcgttcggtcgaggggaggggacgtttcgagtttggtcgcgtgcgaggtttcgggcgcgttttggtttttcggttcgagagcgcgtagttcgggtttttttttcgcgttttgtttcgtaggtgagcggttgcgtttttttattgtttttttttttttcgcgtttcgtcggcgttgaaaagttatttatttgcgtcgtttttttttttttttttttttttcgtttttagttttttttggttgttcgttggaggggaggcggggggtgagggggagtcggcgagaaggaggtggtgattgagggtttttttttttttttttttttttagattttgtaggacgagttttggttttggggtgtgtgagtgtggtgtgtgcgcgcgcgtttggagggaaggattaggtaatttggcgagagaaggaaggatcgggcgttgtttataatttatcgaaaggtacgttttgttcgcg

SEQ ID NO: 11215 - DNA, 801 bp, synthetic construct
  misc_feature 1..801: note = Description of Artificial Sequence: Synthetic polynucleotide
  source 1..801: mol_type = other DNA
gcgaggaaaattgacgttttattttttcggattttgttcgagaagttgggggattcgggttcggtgtcgaggtgtggttcgagtttggtattatttacgtcggtcgggtgatttcggttttttggggttttcgcgtttcgttagtaggcgacgttgggaggttggggtaggtttagagcgaggacgggttcggattgggtagtggggatgtattagggtcgggtgcggcgggagacggttcgggaggcggaaggtcgcggatttgttcgatagaagagtagatgaggggagatcgaggacgttcgggttcggggagtttacgaggaggttaggatcgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcgttcgggttttttaagttgttagtcgcgttcgttttcgggtttttcgttttttttttcgcgcgtttttttttttagcggtcgtcggatttttttagtttattttttttagttaacgcgtttttcggacgttgttagtttgagcgtataggtattgggcggggtttacgggggagtcgtttaataatcg

SEQ ID NO: 11216 - DNA, 311 bp, synthetic construct
  misc_feature 1..311: note = Description of Artificial Sequence: Synthetic polynucleotide
  source 1..311: mol_type = other DNA
tcggttttcgtttcggtggttttaggtttcgggttttgtttggcggttttgtttttaatgcggagttggcggttttgtagtaacgtttttgttagtagcgtttattgagcggttttttagttgttgtatcgtttttagcgtttaacggaacgtttttcgtacgcggagtttataagttgtttgtgtcgttattttttcggttttggtatcgttagtattttttaggaattttttaaattcgttttacggtgtagaacggtaattgtatcgagtttttgtgttaattagtattttcgtaatatcgttagtcg

SEQ ID NO: 11217 - DNA, 1048 bp, synthetic construct
  misc_feature 1..1048: note = Description of Artificial Sequence: Synthetic polynucleotide
  source 1..1048: mol_type = other DNA
acgggagtaggtcgggttgtttacgacggaagtttcgattttggttggggttgtcggtcgggtagcgcgggagagttagggttagagtcggggtcgggaattttagtttcgtcgtttacgcgggatgtagcgattatcgttcgtcgttttcgggtcggtatttattttcgtggaggggtagcggcgttagtatttggtcgcggatttcggttttgggggagttaagttcgtagcgttcgcggtcgatgcgaaacgtgagcggggcgtcgcggtcgggtttttgtatcgttacgttgatgagcgtcgtgtagtatttttggttcgcgttgtttgttcgtgtcggttataggttgtaggttagtagggcgagcgcggcgagtcgggtagggttcgttcgtttcgcgtagtttatcgttttttcggtagtcgtcgttgttcgcggatcgggtttcggggtcggcgtttagaggcggggcgggcgcggttcgggcggcggcgggagcgcgcgcgcgcggtttgcgcggggtcgagttcgagcgcggtttttttggacgtcgcggtttcgtcgttcgtcgtttttacgtttattgttcgtttgtggggacgcgtttatgggttttcggcgagggcggcgttttaggtcgtacgcgggcgttttttcggggttttaggagggttgtagaagcgtgttttttttattttttcgggtcggttttatcgaatgggaggcgtttcgtaaggacgcggcgggggaggggaagggcggtacgggaggaagcgtttcgaggagggttagcggaatataaagtttttttcgcgcggttgtcgtttgaggcgcgtgttcgtcgtcgtttcgttttttcgttggtttagcggtaacgcgtaggtttaaggcgtagtttcgtttcgagcgtatgcgtgttagggtttgttcgttttcgttcgtttgtacgagggttcgggtagtcgggttagtcgttggtgttggttgtttttttgttaggcgtgatagtcgtagggcgtggagttcgggagatttgcgaggacg

SEQ ID NO: 11218 - DNA, 301 bp, synthetic construct
  misc_feature 1..301: note = Description of Artificial Sequence: Synthetic polynucleotide
  source 1..301: mol_type = other DNA
gcgaaattcgttttcgtttcgaagaagggttttaagaaggtcgtgattaaggcgtagaagaaggacggtaagaagcgtaagcgtagtcgtaaggagagttatttcgtatacgtgtataaggtgttgaaataggtttatttcgatatcggtattttttttaaagttatggggattatgaatttttttgttaacgatattttcgagcgtatcgtcggcgaggtttttcgtttggcgtattataataagcgttcgattattatttttagggagatttagacggtcgtgcgtttgttgtttttcg

SEQ ID NO: 11219 - DNA, 1395 bp, synthetic construct
  misc_feature 1..1395: note = Description of Artificial Sequence: Synthetic polynucleotide
  source 1..1395: mol_type = other DNA
gcgaatcgatttgtatttttttgtttattaggaagcggtcgtcgtcgtcgtaattgttggcgttgatcgcgtacgattggaaagttgtaattttatggttcgaggggtaggttcgggttgagtaggttttcgagtcgttattgttaagtatggggtattttaggaaggagtttatttttgtattgtttatttgttattgagtgatttggttttgcgaagttcggcgtgattgtgttaatttttttattttttttatggggtcggagaagaaaaatgatatgaatgtatagtgcgtaagagggggggcgggagggcggaggacgttggaggaggggtacgtgacggtgttagttaatggttgagttttttgtaaaagtttgtcggttttcgtagtgatggattatcgttttagtggtatttaaattttcggcgtttcgtcgtttaggtgacgcgtagtcgtttttttaggtagtttaggcggcggtagttgttgcggcgattgtaaaggtcgatttggagtgttggagcgaagaagagtaaaagttgcgttttgcgcgcgttcgatttcgttgttcgtttcgttaggttttcgggaggtgggggttgggaggcgtttttcgttttcgttttttttttatcgtttaatgaaagatgaattggcgagaggtgagaagggaagagggttttcggttttttcggggcgggaattagtgggttagagttcgtcgggtggtcgtaagtacgtcggtttagttcgtagcgcgtttagtcggaaggcggggaattcggttgatatcgcgtttcgggtttttaggttattttttttgttttgaggttgggttgggagatcgtggggttgtgaggagcgtatagaatcgtggtggagggcgaggttgggttatcggttttttaagttcggaatggagggggaagagcgtagagggttggttgggaggaattcgggtgggcgtgaaggagacgagggtaagaaaagaaatttttttttttttaggagggttttcgaaattttttttttatagtttttttcgttattagtatggtaatgaggagtttttgtaattcgatttggaggggcggatgagttttggaaatttagagttcgtcggaaaaggtcgggggcggtcgggttttttttttttattttttttttttcgtcgtttttcgttttttttttttttttatttagttttgtatcgggagtttttcgggatgcggagttattcgatcgtcggatttttaggggtaggaggcgggggagagagatgacgttggcggacgtggttagcgcgggggtcgggcggtgcgttgtaggttatttgtcggcgttttgagatttaggagttttcgcgttttcgcgtgggttttatagggtcg

SEQ ID NO: 11220 - DNA, 766 bp, synthetic construct
  misc_feature 1..766: note = Description of Artificial Sequence: Synthetic polynucleotide
  source 1..766: mol_type = other DNA
tcgggtttttttcgttgtggttcgtttgtatttttgagttggtatttgtttttcgggcggttagacgttcgtttggtttttttttcggtttcggtttttttttcgcggcgttttaatggttttcgtttttcgcgtagggttacgattgtttttcggtgttgtttatttatgacgtcgtcgcggggatgttgagtttcggcgggcggttggacgtttttaagtagagttcgtagcgtggtttgacggttcgcgagcgtttttagaatttggataagaaggcgagtttcgagggtggtacggttgcgggcgcgggtttagattcgttgtataagaatagcgttaggtgagagcgggagtcgggtcggcgggtgggcggggtttcggttcgtttagaaatagcgtcgggtgaggaaggggtttggagttttttttttggggtattgtgttgggattttgaggattggggattcggagggagggtaggcgtgtttttaattcgttgcgtcggaacggcgtttgatgagcggcgggttcggatacgaggggacggggtcgatttgtgggcggggttttggcgtcgtattaaaatcgcgtggggcggaggtcggtagaggtcgcgtagcgggtttagggtagggagtggttttgattcgttgcggaataatatcgttagttgtgggcggggtttattttgattttattatagtagtttaggtgttagtggagtttgggagggatacggtgcgatcgatataagacggggtcg

SEQ ID NO: 11221 - DNA, 691 bp, synthetic construct
  misc_feature 1..691: note = Description of Artificial Sequence: Synthetic polynucleotide
  source 1..691: mol_type = other DNA
gcggtaaagaggtcggatacggaatcgttcgttcggtgatcgaagagacggcgaggaggagttcgcgaattcgtttttgtttaggtttcgtttattcgacgtaatttgttcgtttttttttatttttcgaagggtggagtttgaggtttcgtttttaagcggttttttttcggagtgtttggcggttagtagggcggggtaggaggttgggagagggacgggtgcgggggtgggggagaggaagggagcggttacgtgtgaggggcggttcgaggttacgtgacggagcgtcggagcggagggagtcggggttgggagtttttttgagggaagaggagtggagtaggggggacgcggcggcggcgttgataatggtgagtgcgcggcggttagcgcgttcgtttttcgttttcgtttcggagcgcgcggcgggtcggttaatcgcgggtcgggcgtcgtcggaggaggggacgggggagtagggcggggagcggggttaggtttgtcgggttatttttgggtttgggaaaagttggcggcgttattttttttcggtttcggcgaggttcgagtatttacgggcggcggcgtgtttttttggttatgtcggagtttttgttcgcgtttttcgattgtttgttggggttttggttggggattcggatttcgtttttgcgggggttggtcgtcg

SEQ ID NO: 11222 - DNA, 1024 bp, synthetic construct
  misc_feature 1..1024: note = Description of Artificial Sequence: Synthetic polynucleotide
  source 1..1024: mol_type = other DNA
tcgggagggcgtagcgttcgggtggggagttcgagttagtttaggtcggttttggttttttgatttagatagcgtagggcgcgagggatcgcgcggtcgagttcgggtcgcgtcgtttttagtatcggggtcgttagttaagagttcgaggttttttcgattcggatgtgatgaaaaagagtaatagagggagaagtgttttaggattgtaggagtggaagaggggaaagagaggtagagagggggaaggttttttcgtaggggagtcggttggagtgagttggttggaaagagggggcggagtgcgcggagttagagtcgttatcgttgtcgtagttgtcgttattgcggcgtttgggttgagtcggagggaggcgggaggacgcgtaggggcggtcgtcgtcgtcgttaggttatcggggcgaaaatgcggtcgttgtcggaggttcgttaatttttcggggtggaagaggaggaggaggaggaggaaggggtttggagcgattacggggggatgcggaggtaggtagtggttttcgggcggggaagaggaggggtttgatttttattttcggggtttttttaaattcgatttttttttttagttttttttcgttgggtttatttcggatttttgggatttcgtcgttgttaatttgcgttgtaatagtttttttcgtaagttttaaattaaaattttttcggggtggagtttgagggagggaagtggagggggagggaacgtttcgtaggggtggtgtgtttttttttaaaaatatttttttttttaattttgtatattttttcgttagaagtagttagttttttgtatttagtattttatagtttttttttcgtgcgttttgtcgggcggcgagttaggcggtagcggcgcggcgcgggttcggcggagcggtttatgttcggcgcgggcgaagttttcgttttcgggttcgtggggtcgtagcgcgtggtcgaggcgggcggcggttagttgggttttatagtttagggtgagtgcgcg

SEQ ID NO: 11223 - DNA, 1339 bp, synthetic construct
  misc_feature 1..1339: note = Description of Artificial Sequence: Synthetic polynucleotide
  source 1..1339: mol_type = other DNA
tcgtttttagcgtttttaggtttatttttcgtagatttttttcgggtcgtttttttttgttttattttaggcgttttttttttttcgtagttatatcgtggttgtattcgtcgttttttttttcggtcgttattatttcggttttttagaattttagtttttcgcgttcgtagtcgcgtttttgttttttcgattttcgtatttttatttggttcggttttttcgtttttttttcggtttttttttttaggatatttgtgtcgttttattttttttattatatacgtattttttattttaattttttcgtttttttgttttttttttttcgtcggtttttttttttcgttgttgtttcgagagttcgatgtgggagggaaggcgcgggggaggggaggtcgcgaagggggttgttttttttcgggtttttcgtgttgcggaattgtagggttttttagcgttttttgtttttttcgtcggcggcgcggaagtcggggtttttcggacgttttcgatgagggtatttatttttttgtcggggatattttgtagacggttttaatattggtaaatattatagagaattgatttcgttcggtcgtcgtcggtttttatttttcgggtttttcgtttttcgttttcgttcgttttcgttcgttttttcggcgttttcgtcgcgttttttcgcgttcgcgtcgcgcgttttcgtttgcgtagtcgttttcgcgttttagtacgttcggtcggcgcgcgcgttcggtatcggttttatttttatttcgtttttcgttggttcgcgattaagcgcggttattgttcgcgacgtagttttcgttttttggcggttgtcgggttttagtagttgtaggttttgcggggttagcggcggcgagttgggtttttgggcgagggttattttcggggggtttgggtacgcgggcgagcgattgcgtaaggagcgcgttcggttcgtagttttttcgttttcggcgcgatttttcgttttttcgtttgttaagggtgggtttggggtagttttttttatatttgtaattcggtaattttttttttcgttcgattgatcgtttgttttttttggttcgtattttgtgttttgatttttcgttcgtattttttttaggtttttcggttgtttttttgtgttgtgtaggggacgcgcgattatttcgcgtttgtttcggtcgtcgttgtgtaacgtacggtttagcggattttgtatttttttagacgggggagggggcggggaggaggttgttttatcgtttcgtttagtaaatattagggattcgtgattatttgttcgttaagattcgcggcg

SEQ ID NO: 11224 - DNA, 2273 bp, synthetic construct
  misc_feature 1..2273: note = Description of Artificial Sequence: Synthetic polynucleotide
  source 1..2273: mol_type = other DNA
acgcggtggtattggtggttgtcggtagttgtcgtttgtagagtgggtgagatcgagtgtggtagatggtttggttcgcggtgttggaggggattggcggagtagaagcgttttggcgtcgggtttttgtttttttggagttggggtttggggaatggggtcggttattgtagggatagaggagagggtagggtaatgggtgcgtaggggttttttttaaaggttgcgggtggttaggggtgtgcgggggcgttgaggtgcggtcgtcgagagattttggtttttagggtggtcgggtttggtatggattttaggggatggtgtatatatcggatcggacgggttttttttttattttcggatttttcggttgggtagcggttagggagaggggcgatttacgggggcgggtgtggggacgtcggattacgcgttaggagttttagatgggtttagatttttatttttcgtttcgggtcgtagtgacgttagggttcggacgttttcggaacggttttttgggggcgttttagttttacggattcgtagggagttttcgtcgtaatttgtatggggtttatttgtatgatttcgtttcgcgcgggagtcgggggcgtcggcgattggaggagttattgttaatttttaggggaaagtgggcgaggcgatttttgggtcgtttattttattttattttttagttcgcgtcgtatttggggtttttttttatttacgtttcgttagggcggggtcgcgggcgtagatattcgcgggtatacgtacgacgacgcgtatacgcggtcgtacgcggtttttcgagttttttgcggcgatttcgatttattttcgcgggtgcggggcgcggattcgttcggtttagtttttgttttttaggcgtttttttttttcgcgatttgtttcggtcgtattcgttttcgttttagtacgcgacgttgttcggcgcgatttttgttttttcggtttagttttatcgttgttttcgatttaattttagttgaacgttcgtagttttagttttattttcggtttagttttagcgtttttagttttattttcggttttagttttagttttagcgtttttaggtttagttttagttttatttttagttttaatatttttaggtttattttcggttttagttttagttattttagttttagtttcggtttagttttagttttagcgttttcggtttcgggtttagttttagttttagttttagttgagtattttcggtttcgtttgttcggcgtttttttttgtgcggcgttttttcgttcgtattcgttcgattttttggaatttttcgcggacgtcggggtttttggaggcggttttttttgtttttgttttcgtttttttttcgcggcgttttcgttttttatttatttttttagtttcgcggggacgaggggagttggagggagttcgggattcggcgcggttttcgtaggcggcgtttttttttcgttttcgacgcggtcgttttttttgtttgttcgtttttatcgtcgttttcgtttttgtcggggacggggatagtagattttcggcgttcggttttcgcgtatttgtcgcgcgtatcgttttttcggtttgcgcggtttcgggggtttcgggaagatcgagcgttggcggttagttcggggaggttgtgggtagtaggggtggttgcgggtttttagtttttttttcgtttatttcggagtttatatttgggatttttatttcgggagaattttgttttttttttacgatgagtttggaggattggagtcgggatttggtatttttagggttgtgattgggtgaattttgagggtatagttgttgttcgtcgttttaggggttttaggatggggcgagtagttttgaagaggtttaagggtatttcgtgaggagtttttacgttttgagagtggggcgtagagtcggagtttcgggttatgttttcgttgtcgttggcgcgggatattcggtagtcgtttggcgtttttttgttggtgcgaggttttatggtgttttgtaacgtttgtttgattttgttggttatcgttacgttcggtttcgcggtgttgttgttttttaataattgtaggtggtcgcgggcggggcgtcgtattggttaagttttaatttcgaggtttttgtatatagaggttggaggtcgcggcgggttcgcggggttttcggtagtttttcggggatgggatgggttattttgcggatttttcggtttttggaggtcg

SEQ ID NO: 11225 - DNA, 5586 bp, synthetic construct
  misc_feature 1..5586: note = Description of Artificial Sequence: Synthetic polynucleotide
  source 1..5586: mol_type = other DNA
gcgtcggttgttggggttgttaggtgttaggagacgtttttttcgggtttgtttcggcgttcgtttttatcggcgtttgttttgtcgtttagttataggtttcgggttttttcggtagcgcggagttgacggtgggcgcggcggtcgtttgttttttggcgttggagggcgtcgacgtgagttatattaattatcgcggtcggagttcgttggatttggtcgtcgagggtcgcgtgtttaaggttttttagggttgcgtttagcgttttcggtgagttcgtggacggcggggatggggttcggcggttttcgggttttttttaagtcgttttttttttttgtagggagcggtaggcgggcgggggcgcggtttcgggttttaggtaaacgttcgggatttttaatatcgtgacgaatttgtacgtgggcgtcgcgtcggggttcgaggtcgttgagtgtttggtgtgtttcgagttggcgttgttggtgttgttttcgtcgtgttagtatcgtatcgtgtgtgagggtgagtggggggtttcggggtggggaggttcggttagtagggtcgtagttaatcgcgttttttttttcgtagagtgcgcgcgtaggatgaagaagtgtattaggtgttaggtggtcgttagtaagaaattgcgtttaggtgggtgaggttttgcgtttttaatacgttttttgtttagttggtggttcgcgggttttcgttttttatttttttttttttatattttcgtttatggtttttttttaggttatatttcgtttttttaaggtttatattcggttttttagtttttagtttttagttttgtttgttttagattatattcggtttatagtttcgttttaaggtaatattttttttttttattatattttagtttcgttggattttacggttttttttagattatattttttttatagttttattttagattatagtttatttagagtatcgtttttttattatatttcggtttagtttatagtttatttgtagttttgattttagttcgtatattattttatgtttgatttttacggtttattttttgttcgtattcgggttttatttttgtttttaaattatttatttcgttagttttttttgtaggttataattcgttttaggtgatatttcgtttttagtttcgttttttcgtagttttttgtttttcgtatttttttattcggttttttagtttatattcgttttttatttcgtagacggttttgaggtggcgagcgtcgttttcgttttcggttcgtcgcgttagttggtggaggagttgtagagtcgttatcggtagatggaggaacgtattatttgttttatttgtatcgatagttatattcgtttcgtgttttagtgcggttacggcgtatgcgttttttgcggtttcgcgtttagcgtttgttttatttgtcgttagtttattcgcgatcgtatttagattttcgtgtgagtcgcgtcgttcgtcgcgttcgagttgttttcgcgtgttttcgttttgtgttttataaaaagaaagattttcggacgttgtttttgttgtttgtttgggggatcgggcgtttttggggtttttttttcgggatacgcgggcgagtttgggggcgaggagggggggtttttttttgggttcgtttcgttcgttttaggttttcgggtttagattttcgttcggattgcggttttcgggttaggatattttttaggcgcgggtacggtcgtttttcgttttttaggttcgggttcgacggggcggggatttttgtgtttgttttcgggtttttttcgttttttcgttttgggggcggtcgcggggattcgcgttttgatttaaggggttcgatattttttagggttgtggggtttcgttttagtagggagttagttggggggcgttttaggtagggtttgggggtcgggcgtacgtaggcggggtgacgagttgggggggcggggggcggtgtcggagtaaatacggcggttaggtttagtttttcgcgttttttaagaatcgttcgcggtcgtcgttagttgtttggcgttgatttcgttggtcgggttgtcgttattttgggttcgacgtcggcgcggaaaacggggagggacgagatagatataggtcggtttggttcggaattttttgtttttttgtttaattttttattttcgtttcgcgggacgtcggtgttcggtttcggttttagtttagagtcgttcgcgtttggacgtcggtcgtttcgtcgaatttttgggttttcgagtttttcgttttcgtttttaattaggatcggtttagatttttaggttcggcgtttagtttcgtttttcgtttttttcgttttttttttttttttgttggggtttagtcggggatttaggagttatatattttttattttacgcgttattttttacggggtttttcgtagttagggttcgttttttttcggtttttcgggagattttggtaagtttttttttttcgtttcgtaatttggtatttttcgcggtttttgtttatttacgtatttttttttcgtttttttttttatcgttttatatttattgttacgtttttattcggttatttttttttagttttcggggatattgttaggcgagcgacgcgttttttgcggtttagtttagttgtttgggttaggatggagatttcgtttatgtggggtttaggggttttttgaggattttatttgggaaaaaagttattagattatttattgtttagtagtgggggtttggggatttttattgttatttttttttaagcgggagttttggcgttgtttttttcgggttgtttggggtttttttcgttttttttttcgaggatttcgtttagtaggttatgtttaggtttttgtttttggtttacgggacgcgggtttttatgttttcggttggagatagtaggtagttcggttaacggacgggttagttggttttttttaggggtagttttgttttttttttcgtttcgttttttttttttttattatatcgggttgtaattcgagtcgtcgagttattgtttttttttcggatttttttcggaggttttgcggttcgggttttcgcgttttgttgttttatgtagttttgagttttatagtaagtttgttatgggtcgcggggttcgtgttttttcggaggtttcgggggtaggcgtcgagcgtcgttggtttggagtcgcgttggtcgttttgtgtttttttttcgcgttggtgttgttggttcggttgggggtttcggcggtgtcggtttggagcgtagcgtaggtgagcggcgggggggaggttaggtgtcgggttgggggggtttttacgtttgtgggtttggtttatcggggggttcgtaggacgtgtgcggggtgtgcggggtgtttgagggttcggatgtgcgtttcgaggtcggagggttggacgtttttgtgtttagttgttgggaggggtgggaggtttcgttttgttgtttagtttttttttttttattgggtcgcgtttttagggacgtgtaatagggcgtttaggttaggagattcgaaattataggtagataggattcgttacgttcgtttttagttttgggtatttttattttcgtttttttttagtttatttttcgcggtagtttttggttttggggatcgttatcgatgttttttacgtacgtttttttttttgaagggagacgtcgttgcgttgggtttttcggcggttttttttattcgggtttcgggtttattggtttttcgtagacgtcgttatacgttgattttagttaggttgcgttgggattattttaattttatttataggtgcgttttggttgggtttcgggggagggggcgcggtcggcgttcgttgagtttattttttttgtaggattttttttttttcgcggaatttgttgagttcgcgggagacgcggcgggttttagttgtcgtttttcgtatgtggagcgacgtgtttttttttagttttcgcgaggtggttttcgagtagtttagcgattttcggataggtgggcgttcgttttcgtttcggttcggttttgcgcgttcggttttttagtttcgtgttttttttaggtttttattcgattaattatacggattgtttggttttcgcgttgtattattgtttcgacggttttacgggggagttggtttacgttttttttttttcgtacggcggtatttatttcgacgatagcgagtattgggttttgggttttacgcgttatagttggaagaaaggtgatcgtttaggttggttttttggaggttttttttttgtagtatagtgggttgtcgcggtcgggttttggggtagacggtaggagggatttttcggggtggtggttgttattggagtttagtaggtaaggaggggagttcgtgggagtttttatttcggtagttttgaatttttttttttatttttttgcgtttttggagcgggagttggagttgtatttttgggggtcgagtttatcgtttgggtttagaatatttttattttttcgtggttgcggtcgagggcggtttcgcggttgcgttttagtagatatatcgggtttcggggagttggtttacgggcggcggggttgggttcggggtttttaggcgttgattttcggggttcgtaggcgtgtggtttacggatttggtgtacgtggcggtttacgagatcggttacgcgttgggtttgatgtatttataatacggtcgggcgtttatgtatttgaacgttacgttgcgcggttggaaggcgttgttttaggacgagttgtgggggttgtatcggttttacggtgagtttttttgtcgggcgggagggcggggatcgggcggttttgagttaggtcgtgttttttacgttttcgataggatgtttcgataggttgttcgtgtgcgcgttttgggcgcggaggggtttttgcgacgttcgtcggcggtttatgaagaggttttgttttagtagttgcgatttttgttacggtgatgtttacggggtcgggatagggttgcgtgggagttgggttttggttatggtcggggttgagggggtattgacggggtttttttttttattcggagtagaattttttttttttacggtggttattattttatcgttttttaggattaaaattaggttggtgttcgagggtaggaacgtgatttttcgttgcggttagaagattttttataagaaagggaaagtgtagtgagtgagcgtttcgggcggttttcggggtgggtagttcgcgggcggttttggggtaggggtgcggggtaggtagcggggggggttgtgtttgtaggagacgtttcgtttttttgtagttggtataaggattaggagtttttggagtttttttatttcggttatttggttttgggcgaggcgtatttgagtattatcgttaacgtcgttaatgagggtatttatatttgcgtggtgcgtcgttagtagcgcgtgttgattatttatttttggcgagttcgtgtgcggggttgagttcg

SEQ ID NO: 11226 - DNA, 1264 bp, synthetic construct
  misc_feature 1..1264: note = Description of Artificial Sequence: Synthetic polynucleotide
  source 1..1264: mol_type = other DNA
gcgcggttcgggcgtagtttcggcgtagttttcgcgtcgagcggtttcgcgtttcgtattagtttttgttcggtttcgggtgacgtcgtatttttcgattggattacgcggtttggggggcggggtttggttcggtgagtttatcgtcgcgtttcgttattggttcgggcggcgtattcgggtagtggcggggagatcgcggtattcggagtttcgcgagtcgttttagttgcggcgagtggagttgagcgggcgcggggtcgggttgggtcgggtcgggcggggtcgggcggggcgcgggagttagtgagcggcggttcggcgtaagtttgacgagtaggagtcgagtttagtaggttcgggtaggtgcgcggcggcgcggggttaggcggagggcgcgtgcggtcgagggcggcggttggcgggggcgcgcgcggggcgggggcggggtcggggcgtggggatacgcgtgttcgcgggtcgggggcgtggtgcgcggttacgcgtgtttttggcgcgagtgtgcggggttaggtcgggagggcgtgcgcggatcgggcgtgtttacgcgcggtagggaggggttacgagggtgcgcgcgtttttggcgcgagtgggaagtgtggggattcggcgggttcggtgtgaggggcgtgtttttggggcgagagtggggagtgagtgtgaggagtaagggtgaggggttgtagggaggggtgcgtttggtcgaggagtgggtgggagatacgcgtgtttatgtcgcgagggtgtgtcgacgttcgagtttgcgtggggttcggggtcgtgtgtttggagtggtcgagggcgtgaggggcgcgcgtgtttgtgcgaggggcgtgtgcggcgggtgtgagttacgcgtgtttgggtgcgcgcgcgggtcggatgagtttttggagtggtgcgaggacgcgcgcgtgtgtttgtgttggagcgagggcggggacgagcgtgtcgggcgcgcgcgggcggggttggggcggcgtcggggcgcgcgggggttcggttcggtcggcggcgagtgtgttggggcgttcggtttttttttaatacgggtttttgggatttagtgtcgtttttttttcgcggcggggttcgcggagttttcggtttttttgggtagataggtgcgaggcgaggtgcgggtatagttttgcgttttttagcgggtgcgggatcgggcgacgggggattgtttttaattatagattaggggagcggagggacgttcgatttattcgcg

SEQ ID NO: 11227 - DNA, 716 bp, synthetic construct
  misc_feature 1..716: note = Description of Artificial Sequence: Synthetic polynucleotide
  source 1..716: mol_type = other DNA
tcgttttcgcggggcgggaatttcgcgtttttttttttcgagttttattttttatggtaaagcggcgtggggcggcggggcggagggagtcgagggggcggggagggcggacgggcggaggggacgggaggtttagcggtttcgggtttcgttggttcgggcgtcggatcggagtcgtcggggcgcgggcggtttaggtaagcgggtcgggtgggtgggggtcgcgttttttcgtttttgttttcggtgtatataggtgatagcgtcggtagtgttcggtcggagtttgttcggtcgttagtcgggattttcggcgcggcgtttttggaggggtttgcgggtggggggtgcggtttttacgttttttgcgttttagttttttggttttttttttcggagtcggggagtcggtaggttcggggcgagggtttagtgaggtcggcggagggtcgagttttagttcgggagcgggagtcggggattcggcgcgtagggcggaagttttcgtataaaaggtcggagtttcgtatatggatcgaattaaagtttcggcggcgtttagcggtgatttcggcggtcgttttgttcggttgtttgcggagggtttcgcgttttcggagttcgggggcgttttaggtttttttttttagttagggttaggtaaggggagggacgggtttcggggttgtttttttttgggttttacgcgttcgtcg

SEQ ID NO: 11228 - DNA, 619 bp, synthetic construct
  misc_feature 1..619: note = Description of Artificial Sequence: Synthetic polynucleotide
  source 1..619: mol_type = other DNA
tcgttcgggattcggggggaggcgcgttgggtggttcggtagtcgggggcgggcggtagtttgtaggcgtaattggtatgtacgtcgttgtagttgagatcgtttaataaagtattatatattttatcgtttttatattttattattttacgcggagtttgtgagagggttttaatgggagttagttgtgtttttattttttgttgtcggtcgggacgggtttttttgcggattttttgaaatgaaataatgtgatgtacgtcgcgataagggtcggtttgtaatgaggtttaggtcgtcgggcggttgttattgttttaggtgtcgcgtatttgggttgcgaggataaggaggaggagggggcggcgtcggaggatcgggggggagggggaagtcgcgaggggtagggggtgggagaaggcggagggaggaggtagggggtagggggcgggcggaagaggggaggaaggagggggcggcgggtcgcggtaggttaggcgggagaagtcggagatagagagaggacggggatagtggcggtttgtagagttttaggaattcgggtttaaattttgttcgttagcgtgagagagcgtttgttcgtttaggcggtttatcg

SEQ ID NO: 11229 - DNA, 293 bp, synthetic construct
  misc_feature 1..293: note = Description of Artificial Sequence: Synthetic polynucleotide
  source 1..293: mol_type = other DNA
gcggtttcggtaggggttgttgcggcgatttaggttgttgcggttttagttttattagttgttgttgttttttaaggagacgtcgtcgatagcggagtagtggttgttgttgttgcgggggcggtagttagaggttttagcgttttaataatcggagtttaggatgttgtttcggttgttgagaggttcgtaatttttagcgttgcgttagagaaattcgtttagtttagagcgggttcgtttcgttgcggtttttacgcggggttgggtttcggagtttgtttcgtaaagcg

SEQ ID NO: 11230 - DNA, 2748 bp, synthetic construct
  misc_feature 1..2748: note = Description of Artificial Sequence: Synthetic polynucleotide
  source 1..2748: mol_type = other DNA
acggtagggggttttcgtgtttttcgagaatttaagaattcgtttcgtttttacgcggaaagttgggagaaaaattgttttttttttatttttttttattttttatttattcgtttttggagtttcgttcgtagatatttttttttttcgagttagaaatagatatattattttttttttattttttttttcgtgcgtatattcgtttttttttttttgtttgtttttcgtttttttttttttttttttttttgttcggagttgtagtttgtagtttcgattcgggttggttggttggttgagtgcggtcggggcgttgttcggtagtgcggtgtttacgggattgataggtaggtaggtcgcgggttgggattcggatattaaagtaaaagtatcgttgggcgtcggaggagtcgcggggtttttattttttttttgattgatttttaaattttaatttgtatttttttcgtcgtttcgttttttttttttcgatttcgttttatcgtttttcggtttttttgtttttttttttttttcggttttttttttcgcgttttttttttttgcgttttcggtttgttttttttttttttttttcgtttttttttttttttttttttttttttttcggtttttttcgttttttttttttttttttttttttttcgttttttttttttgcgttttcgttttttgtttttttttttcgtgtttgtagacgcgcggatcgtttatgcgtttttcgcgggtagaatgttgggtagtagcgttaagagcgtgtagttcgaggtggagttgagtagcggcggcggcgacgagggcgcggacgaatcgcggggcgtcggtaggaaggcggtagcggcggacggtagaggtatgttgtttaagcgcgttaaggcgttcggcggcggcggcggtatggttaaggttagcgcggttgagttgaaggtttttaagttcggtagcgtggatagtcgtgttttcggcgggtcgttcgtttttaatttgcgtaagtagaagttatttattaatttttttttttttacggatttcgagaaaaagttgtagttttatgagttcgaatggagcgacgatatggttaaggcgtttaaaggtttaggtaaggtggggtttaagggtcgtgaagtttcgttgatgtttaagacgttgtttaagtcggagtattcgtttttttaggttaagggtagttcggcgggcggcgttaagatttttttggtttcgttcgcgtttaatttgggaaagtcgagtcggatttttcgaggattttatgcggaggttaagtcgtttagtaaggcgtttgaagcggtcgtgagcgaagatggtaaatcggacgacgagttgttttttagtaaggttaaggcgtaaaagagttttgggtttgttttttttgttaagggttaggaggagcgcgttttttttaaggtggatttcgagttggtggtgatcgtgttgggagatttggagtagttgttttttagttagatgttgggtaagttttgtcgtttcgtttcgtttcgtttttggtttttttttaattagttgttggggaaggtgtggggaaagcgaagttttttttttttgcgttttttcggagggtttttttgtttacgattaggttgtgatgggtattgcgtttagatgtgttgagttggtttatttttagatgcgtatggtttaagtgtatttttttaaagatattataggcgggaattcgggttcgattttggtttgttcgaggtgaggttggataatgggatggggggtgagggggttataggtttttagaaatagagttagaattttaatatggtaaaatttgggattggtggaaattttcgttgtggtgtggtttgcgtttgataggagtatttcgtattgtaaggggagcgtttagcgagagttcggatttagaggatagatgtgggagagtagatgtgagggttgattggtttcggaatatagttgaggttttattttttttgtggatttcgagtgggagcgtaagtcggattttttcgcggtgtgaggattttggttaaaagaagcgtttagggtcgggggcgggcgggttgttagttgtgcgtatttgggcgtatgttcgatattttagtttcggttttggttttaatttttatattcgtaggttttttagggcgtgtcgaaagttttgggcgttagcgtcgagatttttgtttgatcgggaagtttttgttttgtggttaatggaagtcgagtaggcgggaagggaggaataaagtttgttcgagtggaggaagcgcgtagagttgttttattgtttttcgtgtttgaagagtttatgtaaaaaaattcgaagcgggtttcggaattgtttttttttttttcggagagtttttgtttttagagaggaatagatttgggatgtgtcggacgttaggcggttatgtttcgggaattggtacgggtttttttggggttacggaataaggacggtggggtttggtgtttaggcgagttgttttggttgcgcggatttgttgcggtggttgggttgtgggtttttcggcgtcgagggattcgagttttttgggtattcggtaggttgttcgttcgttgggggttgggaaggggcgtgttaatgcgcgtgtgaaagggcggggtcgagtgacgggtttggcgggtggggaatatgtaagagttcgtcgggcggttttggagaatgcgaagtcggaggagatcggttcg

SEQ ID NO: 11231 - DNA, 433 bp, synthetic construct
  misc_feature 1..433: note = Description of Artificial Sequence: Synthetic polynucleotide
  source 1..433: mol_type = other DNA
tcgtttcggcgtttttatcgtcgtcgtcgtcgtttaatagagtttttggggcggtttttatcgacggtgtagttcgtcgggatcgggaggaagtagttgcggttatcgcgtcgtgcgttcgcgttcggtcgttaggtgttttagtagttcgatcgtcgagatgtttagttcgtcggggtttcgggcgttatggttttgcgtcgcgttgtgcgtttttcggagggtcggcggcgttttttagttcggttcggggtttatcgtttgttcggttttttgttattgttaggaggacggtattatgttgtttgtcgattgttttgagttcgggttgttcgtcgtttcgggggatttggattttttgacggtttatttgtgagtattgttcgtttgttttcgtttggttttgcgggttgttggttagcgtttagtttcg

SEQ ID NO: 11232 - DNA, 1376 bp, synthetic construct
  misc_feature 1..1376: note = Description of Artificial Sequence: Synthetic polynucleotide
  source 1..1376: mol_type = other DNA
tcggtatcggggttgtatttttgggtagacgttgtatgtttgtttttaggcgcggttttgttgttatttttttgggggttcggagcgcgatagtagtttggggacgtttttcgcgtttagtacggtgtatttgggttttgaggttttggtcgaaacgcgttaagttgggggtaggtgtagcgattttatatttttcggttgcgcgttttggcggtaggaggcggggtcgggggcggggcgtgagttggtcggggcggggtttatggaggggcgggatcgcggcgttttataagtattgcggagcgaggcgcgcgttcggttagagagcgagcgcgtaacggcggcgacggcggcgattttatcgcgtattttgttaggttttcggcgtttagcgttttacgcgttttcgcgttttcgcgttttcgcgttttttttttcgcgttttcgtttttcggttcgttaggtttttttgtcggttattcgttaggtttcgcgtcggttcgttcgtcgtttaggatcggttcgcgtttcgtaggtcgttcgtcgttcgcgtcgttatgggagtggagggttgtattaagtgtattaagtatttgtttttcgtttttaatttcgttttttgggtaagggttgcgtcgggggtcggggcgggagggggtaggtatatattttacgttgggtaggtttcgcggtagcgtgttaggtttcgcgggcgtagcgcgggtcgcgaagttgtggggttatttgtgggttttaggagcggggtggggggtcgttcggggttatcgcgtttttcgatattggggttgagggttgcgagtcgagtttcggggtttttgtgttcgggggtttatttttgcggtcgggtcggggtttttgggggtcgtcgggtagttttcgttgtggtggtgatgggtgcggtggtcgcgggtcgggattcgagtattcggtcgttttttagttaaggaggggtttgcgcgggtttttggtcgcggatttcggattgttgtttcgcggggacgaggggggggttcgcgggcgggatttttggcgtttcgtttttatgagtttattaagagtcgtcgtttttggatggtggggcgggggcgtatattttgtcggaggttgggggcgattcgttttattttttttttagtttagtttattttttaatttgcggttattattcgagatttttttgggggtcgcgtttaaaaggagcgtagattttcgtcgggatggtttagaagttggggtgcgcgtattttggtcgtttttgtttgggagtcgatttttttttttttatttagatacgttttagcggaggtttttttttagaagggttttggaggtttcgtaggagtggggatttcgcg

SEQ ID NO: 11233 - DNA, 3393 bp, synthetic construct
  misc_feature 1..3393: note = Description of Artificial Sequence: Synthetic polynucleotide
  source 1..3393: mol_type = other DNA
gcgggtgtatagggagcgttaggattttagcgttttgtcggattagatttatacgttcgaggtgatgtttattattaggtatatgaagtatttgagtatgaagacggcgtagtcgggtttgcgtgtttggtcgggttgtaggtttcgtaggtacgggtagttgtgcgtggttttttagcgcgggcggttgtgttgttcgtagaagaggtaggcgattattatcgcggcgggtacggtgtagagtacggtgaataggtttaggcggattattagtttttttagtttgtgcgttttggtggggtcgttttgttgtttgatgatcgagcggatgcggaagagggatacgaagtcggttagtaggaatatggtgtcgatgaagaggtagatgattagcggcgttagtacgaagtcgcgtaggttgtttaggttttggttgtttacgtagtagatgttcgttatcgggtcgtcgtttatcgagttgagcgttagtatcgcgatggatttgacgttgggtataagttacgcggttaggtggaagtattgcgagtagtcggcgatggtttcgttgttttattttatatcggtcgttaggaattatgtgagcgataagattatttattagatggagttggttatgtcgaagaagtagattagtaagaagattacggtgtatagcgcggggtcggtggtttcgtagcgtacgtgttgttttatcgcgtttagtttttcgtattcgtcgcgttcgttcgggtcgttcgcgttcgcgttcgtcgcgttcgcgttcgtcgtcgcgtcgttcgcgtttttagcgtttttcgcgttcggcgcgttatcgttgtacgttattttttcgtggttcgttattaggcgtattaggtagtttatcgatacgaagaggtagtaggtcgagaggaagataatgggtcgtttcgggtatttgaagcgttttatgtcgataaggaaggtggagacggtggcgaaggtggatacgaagtagagtatcgattataggtcgatttagaagacggtgaaggcgcgttcgttttggttgaaaaaggggttgtggtagggtagcgcgtagttagcgatttggtttgttttgacgcggttgtagagcgggtggcgttcgttggatacgtttattataggcgcgcggtattggtattcgggttcgtagggagtcgcgtcgtcgttagggggtcgcgttttttcgttatcgtcgtcgtcgcgagttgggggcgtcgtcgcgttttcgtcgttatcgtttttgtcgtcgtcgtggtgcgggggtttggttttcggcgggcggtcgtggtcgttgttcgaaggcggttgttcgtcgggcggcggcggcggtaggcggcgcggcgggttgggcgcggcggtggttaggtcggtgcggttgtagtttatgtatagcgtgttagggttgttttgttcgggtagtcggtcgtagcgtatgcggtcgggttaggcgaagtcgtattggcgtatgagcggcgcgtagtcggttttggcgcgttcgtatatcgagcggtagggcggtagcggttttttgtagttttttaggtagatgggcgtgtatatgttgtataggaagaatttgagatcgggcgagtattggatttttattagcggttagaattggtgtatttttaggttcgtttcgttttgcgtgtcgtggttgaattgattgggtatgtaggtgtagttgtagtcgatgtttttatatagcggtacggtgattttttggtatgttagttttttggtcgaggcggtcgtagcgtcgttagagcgttgtagtagcgttaaggcggttagtagcgaggttatttttaataggtaattttattttatgttgtgcgtttcggttcggtgttttcgttttttaggcggcgcgtagaggggtgtcggggggggggtttacgagagagtcgtagacgggtatagcgggtgatttggggttttttttatgtttcgttcgggaggggggtttgtcgataatttaattttttttaggggcgcgttcgtagcggcgcggttcgtagtttgggtagggttttttcgtattttttttcgtcgtttcgggggtttgaaggcggttgtaggcgcgcgttatagttcgtaggttcgttttgttggtttcgggtcgcgtttagttttcgcggcgtagagcggtcgggtttcggtttatcgtttcgcgttcgttcgtttttttttcgcgcgttcgattattttttttcgtcgcgtcgggcggcggtgatttcgtcggatagagagggcggaggcgtcgtaagttttttttggggtcgcggtgcgtagttaagatggttgggtcgggtcgtttgtcgcgtcgggttagttttggcggttattattcggttttcgggggtttatgttcgtttttaaggttaagtcgtcgtcgtcgtcgtcggagttggggattcgtttcggtttaggtcgtcgtttttttttttcggcgttcgtttttcgttcgttcgtcgtcgggatagacggattttcgtcgtttggaaaagttagcgtcgcgtttcggtcgtagtcgggcgaggtgtatatagttttttttttgttggatatttaggagtaaatttagatcggaaggcggagcggatatttgagtggcgcggttcgcgtttagtcgtcgtttttttttcggcgggagtagcgtttttagtttaatttttcggttttagtttcgttcgcgtcgcgttgtcggtttatgaatatttatatagcgcggattcggttttcgtttttagtttcgcgagttaatcgtcgggcggtagggcggagtttacgcgtttttagggtttagttttttttaaggtagttttcgagtgttcgtattgttgtgcgcgttttttgcggatggagagttttggtaattttgggattgatcgtagagatagagtgttggttatggttgtttttatggcgttgagtgcgtcggaggttttggtttttttatttcgagtttgtttttggggatagggacggggtttggtgtagcgcgcgttttttcggcgcgttttaaattagttaagtttttgttgttatttttcgtaaatgtgggtgatttgtaggcggttggggtttcgtgtttttcggggcggtaggaaggtttcgtagtaggcgagcgtcggggaggtttgtcggggttcggcgttgtagaagattcgggaaagggtgttttttttggggtttttagaacgatggtttttgagatttggagatgtggggggtgtggagttattttaaattggggttggattcgggacggttcgggtgagatgtttcggagtttagttttgggcgcgcgaggggcgcgggggataaatgttcgttagagatttttttttcgttttcgttgcg

SEQ ID NO: 11234 - DNA, 1381 bp, synthetic construct
  misc_feature 1..1381: note = Description of Artificial Sequence: Synthetic polynucleotide
  source 1..1381: mol_type = other DNA
tcgcggtagcgttagttgtatttttttttaaaaatcggaggaaggagtttgggggttaggtcggggcggtttgtaggtgtgaatatttcggaagtttttggcgttttggtttttaagagtatatttgcggttgtttacgggttttacgttttgcgatagttatttcgtggtttcgggggttttaagggcggtttttcgtatcggggttttaggtagcggaatttttttttagggtttatttataaagcgtggtgtcgtagagttttttacggaggggttttagtttggagttcgggtatcgtttatttttaattcgtcgttagtttcggattttttcgcgtttgtttcgtattacggagtcgggtttttagagtagtaaggttattaggtggcggtgttggcgtagtaggcggagcgtcgggtgcgcggggtcgcgtttttggttttcgaaggtgatgaagatgggtttgcgggtgagttttagtagtcggtataggttttttttgcggggcgggatcgttaggggggtgggtgttacgttggggtttatttaatttcgcgcgggatttatcggaagttgtggttgtattaggttcggtttaggaaggcgttcgaaagtattacgatgaggcgtcggtagcggtttaggtttattaagaggtcggcggagggttttgcgggagggcgggcgtcggcggcgtaggggcgggggcgggggagggcggggtcggaggtttaggggcggtgtcggacgtagagttttaagggaggggcggggtttgcggggtgggcgggtttttgaggcggggtttcgggtgggcggggatgggggcggagttcgatggtgggggtggggtttcgggtgggacggagtatggggcggggcggggcgggtttttcgggtgggcggggtacggggtggggttcgggatattagcgcgcggtaggaggtcgcggtcgtttaggaagagtttgtagtttcgacgtcgttttagttgcggttttaggatgaagtttacgaatttgcggttttcggggtagtcgttgtaggagacgtaggcgtcgtagagtttttcgtttgcggacggcggttagttatttcgatggttttcgaggttttatattagttttcggggtttttaatatttttaattattttttacgtgtataggggtagattcgtttcggattttaattttagtcgggtcgtatagagtattcgggggttaattttttttcgtcgtacgtttttaaagtcgagtttagtagcgtatttttagggaggtcgtggcgattttttttcgcgtttacgcgggttttacgtatcgtttatttttatttttttatacgcgttttggtattagagtagtacgttgagacg

SEQ ID NO: 11235 - DNA, 493 bp, synthetic construct
  misc_feature 1..493: note = Description of Artificial Sequence: Synthetic polynucleotide
  source 1..493: mol_type = other DNA
tcggattcgggggaaatggggtattaacggttgggttttaggagatattcggaggggttcgcgggttcggttcggttttttcgttggggggttattagtcggtcggtagcgagatatttagaggttcgtttttttatcgcgttgttatagtaacggtttggtcggttgcgtttcgggtcgttcgttttatttcgcgggttcgttttgagttagtgattttagggattatttatcgcggtcggcggattggcgggttttcgataggtgcgtatattcggcgtaggttgtcgttgagttcggaattttgtatcgggagaaattttttagttcgtagagtaatcgtagggtagtggacgggggtcgcgcgaggataaatagcggcggcgggtgtaaagttttttttttaagtcgcggggttggtcgggaggtgtcggttgtataacggcgtttacgtgatttaggtgtagttttaggcgcgtttaagggtagttcg

SEQ ID NO: 11236 - DNA, 922 bp, synthetic construct
  misc_feature 1..922: note = Description of Artificial Sequence: Synthetic polynucleotide
  source 1..922: mol_type = other DNA
tcgcgggcgttttgtagggatggagattgagagaggttagggattcggtttttttgggaaaacgcgcgggcgttttagtttttcgttttgcggtattttatttgttttcgaggattatcgttaagaagaggtttcgtcgtgttattgatattttatttcgttttttttcgcgaggtgttttcgagttttcgaggacgcggaacgtcggggtttttcgtcgggtaagtattagtatttagatttcgtacgtagttttgtatttttacgttttttagggaacgtcggttcgttcgttttcgggatttttcgttttttaagttaaggttttttaagtttagtgttcgcgcgttattttttttttcgattttgcggcgggatttttattttcgtattttttcgcggggttggttaagtttttagattttttgcgttgtagtcggttcggaaagttatttttaggttattttttcgcgcgcgcgcggcggcggttacggtggcggcggttgcgattcgaacgggtttttttatgtatcgcgtagggtagaggagggagcggcgtttcgtacgtcggggttggggcgttgggtagggcgggcgggcgtggggtttcgggttttttcgtatttagtcgcgcgagtcgggttttcgggtttaggggaggggagttgaggggcggagttatcggggcgcgttttcgcggttgcgttttttttcgtcggggagcgcgggtacgtaattcggagggtgttgggtcggttcggagtacgcgagtagcgggaggagggatcggggaatgattgacggaggcgggtcgtagaggtcgttgtgtttcgtcggttcgtattcggtcggagtgtgcgcgcgtagtttgttagattagcggcgggggtacgggtcgtattaagtgacggaggggggtacg

SEQ ID NO: 11237 - DNA, 719 bp, synthetic construct
  misc_feature 1..719: note = Description of Artificial Sequence: Synthetic polynucleotide
  source 1..719: mol_type = other DNA
tcgtttttttggtatttacggcgtttttgtttgtttttgttcgggtttcggaggcgcgaatattattttaagtttgcgatcgcgcggtattattttcgttttttttttttttttatttcgttttttttatttttttcgggagtttttgggagtcgggtcgtcgtgtgcgtaagcgtgtttagtttttttttcgtttttaattcgggttcgggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcgggggtttgcggggcggggcggggcggggagtcgcggggttttcggtcgtttgattttagtcggcgtcgcgtttttcggagggggtcgggttttgtacgtgggcgtagcgcgggtcggggtggggttgttatagttttgcggagttgtttttcggggtttttttttttggattagattttcgcgggaagtcggatttttttcgtttttttggagtgagtaagcgggatagttttgcggaaagttttcgtttttaattttttagttttgcgttcggattgaagcggcggtttttatttttagtattttcgagcg

SEQ ID NO: 11238 - DNA, 958 bp, synthetic construct
  misc_feature 1..958: note = Description of Artificial Sequence: Synthetic polynucleotide
  source 1..958: mol_type = other DNA
tcgcgttgttagtatttcgtatagttcgttcgaaatattagggaaggggttcgtaggtgtgggggtggggtggcgaggttaggtagtttggcgcgagggagagagtcgaggtttgggttaggaaggtttttgggtgtcgtgtgggcgtagagtttaggagagcgtattgttaggttcggattttttcgtttttatttcgggaagaggttcgttcgtcgtagggggaaggcgggattatagtatttcggaggagcggtcggttcgggtatgcgggcggcggggcggggagggaggttttcggaatttcgagagagtattcgtgtttcgcgggtttcgtgtttcgttttcgggtttttttttttttaacgtaggggatttagttcggggtagtgtcgggtattggcgttggcgtttcgtttagttttgcgattttttttcgtttcgttttttttcgtttcgtttcgttttttttcgtttcgttttcgggtcgtttcgtttcgtaggttcgttattttcgggtaggtttcgttttttgttttcgttggcggcggcggcggcggcggtgtcggagcgcgagtagagcggagatttttaggttttgcgggcgcggtgagtgcggttcgggcggcgggcggcgaggcgggtttcgagagcgtgcggagtcgcgcggttttgagtcggcgtcgggcgggttgggtatttttaggtcgagattcgagaagggggagcggtcgggggcgtttacgggaggtagtgtgggtagggcggcggtgggacgagaggacgaggaatagagtaggcgtcgtgcgggaagcgggtcgggaaggggagggtgggtgcggggttcgggtatcgagcgaagtggggttttttaggggatggtttcgaggaagatcgttttagaaagggagtaattcggggtcggtaagggttttcgattgtgtgatttcgtgtatcg

SEQ ID NO: 11239 - DNA, 3843 bp, synthetic construct
  misc_feature 1..3843: note = Description of Artificial Sequence: Synthetic polynucleotide
  source 1..3843: mol_type = other DNA
tcgtaattttgacgagaagggttttttcgttgaaagtttaattgtagagcgttcggagcgcgttgtgagttcgtaggaacgcggtcgggtcggggacgggagaaaggcgcggtcgggattttgtattgtgtcgcgcggcgtttgcggttggaatttggtttggaacgcggttttttcggttttagtttttcgtttaggtttcgtttattcggtcgtttcgttggttcgtatcgttgtttcggttatcgaggagtttaaagttggcggcgtttcgcggatttcggcggagagcgcgagggagtcgcggtcgatttttgtattacgaagataattggaggtcggcgggggaggcgggttacgaggggttggggcgagggagttgggatgcgcgggttcggttcgtcgggaaataggttgtcgcggagtttcgttttttttttttttgcggttttcgtcgcgatttgattttcgttttgttcggggagttaatttagtcgttttcggggcgttttttttttttttggatttttacggttggattagagtttttttggtagtcgggttaaaggtttttttagtaaggttaaggcgcggtcggttggtatttggggatttttttttagtcgagtattggttttttaatcgtattgttaaggattatggtagcggtaggaaattcgaagggttttataggtttgcgggagggaggatttattttatagtaaggaatagatttagatagatcggggattttagtgggaggggacgagaggttttaggacgttggaatgtggtaaaaataaaatattttttatttatgtatattattattttttgattgcgggttggggggaagggagtttagggttaatgtgttttagattttagcgttttttacggttgtgttagggttggggtggtttatttttttatagacgaaaattaagatttaaaagtatatttttattgtggtttttttattaaagtttattaacgtgatatataggttgcggcgttggagggaagcggcgaaacggggagaataaacgtaatagaagtaaattgttgtttgtagaggcgagaggcgaaggaacggaagttatattcgattttagttttatttcgtttttattagcgtcgggttagcgtaggaaattaggaataggtgtaggtaagggtggtagttcggtagagttagcgttttattttttttaatttttcgttagcgtgggtttggatggttgggttgtttgggtatttttaagggggattaggtatcgcgggtaggtttttaaatacgtgaagggtatagggtttgaaagataaggaggggcgtttaggaagggcggaaaagaggggttttggggttttttaggatattaagttagtttttgaaaacggcgttttttggaaggttttttaatattttcgagggaagatttggagttttgaagatttaatgaaattttagttttgattgattttttttttgcgattaatttcggatgtttttatttagtttttgtttcggtaatcggttttttggggatagtagtattagtattcgacgtttatcgtataagtgggcgtcgtggtgcgaggcgtattttagttatttaggtcggggtgggggcgtttcggtatttatattttttaagtaggtaaatttttaggtttgtttttcgagaatcgggagttcgtattatagtttcgggtaattatcgaggtagtttatgtaattgttcgcgatgtcgtttagtagatttttttttttattcggttttagagtttagtatatgggtatttttttttttttattttttatttcggcgattggaatttcgagtttgttttattatcgttttttataaagtagcggggtgatttcgtgtgttataaatattaagttagtatgtaggtttaggtaaaattttggttgtttttttgcgttttttttattgcgtcgatggtttatagataattgtatttttataaattttttttttacggttagggggtgggagggagttagagatcgggtgggggtttggcgcggtattgttgagggttttgtatttaattgagtagtaatatatttatttatatggacgcgggtgtataaatcgttttaatattttgttttgaaagcggagttaatttttaaagttaaggattacgtagttgaatttttagtattttttaatttcgtttaggcgggggtaggtagagaaggggcgggtagcgggtagttaattcgttcgattttttcgttaagaaggatttattaggtgaatttttcgttttttatttaagtagttggttgtgtatttttcggttgcgtgtgtgtgtttatatatatatatatatatatatatatatgtcgttttattattttttagtttgtttttttaatgtaacgatcgtatttaaaaatggtaattaaaatgattgaggagttcggtgattatattttaatttagagtatatttttcgaagttgggggtgagagtagttatatagttatatttatattcgggagttttttaagcgtttatttggcggttgtagttttagttggtttttagacgaatattaatatcgcggtcgggcgttcggtgaggagaggcgggcgtttcgcgggttgtagagggcgaggagttggggtcgtatttttaggatttgagttttaattatcgttcgtgcggggttgttgtagtcggtatttgtttcgtagggtaggttgtagtcgttgaagttcggcgtcgtttcgcgggtttttttagcgttcgacgggggtttggggcgagttagtttgtagaggggttgtaggcgatcgggtcggggcggggaacgggattcgggagaggtagacgaatttggggcgcgtcgttttttttttattcgttttttatttttttgtttttttttaatttttgtttttaggttttagttcgcggcgggtttcgggggttgcggcggttttaggttttagaatagtttgttttttcggttattcgcgttttagtttttttttttttgggttaggggagtaagtaaatatttttcggagttttcggtagtcgcgtgagttattcgaattttgttcgggttagtagtgtagagggcgatggagttggcgaggcgtcgtcgcggtttttaaggcgttttttcgtagagcggattacgtcgttttatcgtggttgtaggttgttatcgtcggggaagcggcgaggacggcggtagggaggtaaggcgtcgcgtcggtggtttttttttttttcggcggcgcggtttttttgtttcgcgagtcgtagcggggcgtttaggaaggagtaggttcgggttttgcgtttagttttagcgagattaataatagttttcgcggggagcggagttttagcgagtttttagtcgcgcgcgtacgatcggttttcgttttcggtcgttttcggtcggcgtttttgttagtattgttgttttatatgaaatagttgtaatttcgaggtttttggggggttggggcgggtgtgtgcgcgcgcgtgtgtgagtgtgtgtgtgtgtgtgtgtgtttaatagtttttttttttttttttttttttttgtttgttcgtttgtttgttttcgttttttattttcgtttttttatatatagaaagagagggcgagcgagagagagatatatatatatacgtatacgtatacgtaggttatatgaatgggaggcggtagttaattttacgaggtcggcgagtcgcgcggcgtattggcgttgggagtagggtcgtatttcggcgcgggggggcgttacgtaggtgatgggcgttttttcgggggttacgcgcg

SEQ ID NO: 11240 - DNA, 384 bp, synthetic construct
  misc_feature 1..384: note = Description of Artificial Sequence: Synthetic polynucleotide
  source 1..384: mol_type = other DNA
tcggaagtcggggggcgggtttttatagttattgttcgttattagttcgttattgtgtttatatagggtgatttgatttcgaggcggtggaggagggaataattttagagagtatattttgtcggttcgtaggacgtttgtagtcggtaaatttttggtcggaacggtatagatcgtattttcgtaattcggttttcgggttagattcgtatgcggacgggtatcgtaagggataaacggcgaggcggaatttaacggaagtgaagaaaagattaacgggaaagaaggacgagtacgcggtttcgggatagatttttaaagtttttttttgcgttttttggcggtcggagggggagtagcgcggatacgtttttcggttaatcg

SEQ ID NO: 11241 - DNA, 1432 bp, synthetic construct
  misc_feature 1..1432: note = Description of Artificial Sequence: Synthetic polynucleotide
  source 1..1432: mol_type = other DNA
acgttttgcgtttttagtcggggtttttttattcggcgtcggcgcgtagtatgtcgggagttgtagttttcgcgaggtaagtttcgtttcgtttttgtttgggggaggaggttggagagtcgttttgtcggtttttgaattttgtcgcgaaaagcgcgcgtggcggttttcggtttcgtttttcgtaggacgcggtgtcgcgttattttggtaatcgttttttagtcgtcgttgattgggttgggtcgcggggggcgggcgggggacgagacgcgggggttgttgtcggcgttcgcgtttgttagtcgggttagagcggagtagcgggtaggattgtttggtcggttgtttcgcggagaggttgcgcgcgtcggtcgggggaggcggatagtcgggttcggcgtttgtggggcgcggcgcgcggtattcgggtttgagattaggcgaggcgtcggcgcgcgttagacggcgcgaggttgcggtttcgggagttttcgcgcgtcgttcggggttatgggcgcgtgagagtttagcgcgcgcggtttttgttgcggtttgcgagttcgtatattcggtgtatagtttttcgggtcgttttcgtgttcgttttgcgttattgggatcggttgttttttagcgtcgaggttttcgaggttgtattcgagtttgcgtcgttcgttgtcgtcgtcgtcgtcgttgtcgtcgtcgttgttcgtcggttttttttttttttatattcggggtttagagtaggaggaggaggggtcggtgtattttcgtcgttgttttttgtaatttgtaggggtcggtgtatgttcggcgaggagtcggggtcgttgcgggtgcgtgtaattttcgaaggagataatttttttatttcggggcgaattcgggggttgtaagtcgcgggcgggcgggcgagcgagaggaagtaataaagataggttgtagttggggttggcgaaaggggtcgcggtcgtcgggtttttagcgcgggcggagagggcgttttgggagcggcgcgggtcgagttgtagttttgagcggggtttcgaggggaggcgtagcgtcgttcgtcggacgtggcgattacgggtttcggcgaagatgcgtcgtttgagcgttcgcgcggttttcgttcggggcgggcgtgatttttgttgaacggagattttttttttttttcgatttcggacggcgtaggtcggcgttaggatagtttttatcgatagcgtttttttttattcggagagaggtatcgatttttaaggagggtttcgttaggtagtttttgttatttttgtatggttgcgattcgtcgagcggagcgtcgtggtagttgagatttggtgtttttcgacggtttggttgattcggtgagttgtgcggggcggggttttgcgttggagttgggggtattttttggcgttcg

SEQ ID NO: 11242 - DNA, 325 bp, synthetic construct
  misc_feature 1..325: note = Description of Artificial Sequence: Synthetic polynucleotide
  source 1..325: mol_type = other DNA
acgttagcgaaggtcgtttcggcgtattttagataatgagcgtagtgtgtaggagcgaggggttggtagaggttaggaagtttttggggttaggcgcggttttttatttttacgttagataaagagcgcggggtttggggagttggcggttttttcgttatttggggcgtttggggggttttggggcgggggaggcgggggttttgtttaatttcgttattgttattatcggttaggtcgcggtttggtaattcgtgaataggaggtagggttgtagggcgtgagggatgatgataaggaagtcggaggagtagcggcggtagcg

SEQ ID NO: 11243 - DNA, 1242 bp, synthetic construct
  misc_feature 1..1242: note = Description of Artificial Sequence: Synthetic polynucleotide
  source 1..1242: mol_type = other DNA
tcggttttggtttcgtttcgtacgcgttggtgttatagttgtggtgtagacgttttttcgttgcgagggtgcggtcgtttcggggcgagtgtttttcggtttgtaggaggcgaattcgggttttttcgggaggcgttcgtgggaacgcgtatttgcgagtttttgtcggttgaggagtcgaggtttgcgatttttgtcgatttgagtttaggcgtagtagcgtagatttggtcgtcgtattttttttggttgggatgcgggtttacgcgggaaaggttgaaaggtggggaatatttcggcggaaaggaattttttttttttgttttgaaggaaagttttttaatatagttatgtttttggtggttttcggttttttatttttaagtttttagttagttttatatttattcgttttagtagtcgcggagtgggggtttttaaagaatttagttgtagagtaagttcggttgacgtagtgtgcgttgggggcggggttttggacgggggcggagttacggcgagagtcgcggtgagggcggggttcgggtgggcggtgttttgagcggggtttttagtgggcggggttttggggtggcggtcgttgtcgggttacgggagagcgcggagttttgcgttgggaggtgtacggtgtgtacgttggattggatttttatgtaatttcgcgttttgcgttttaattaggattgtttcgcgcgtttttgagtttcgggtttcggttcggatttgtagttttttaggtggttgggaaggtaggtgcgtcgttgttttcggcgcgcggcgtttcgcgaggtttttagttttcgttttggtggattttcgttgggtgggagtcgggagtggaggcggtcgttttagggagggaggagcgtaggcgggggttgtttacgggcggagtattgcgcggcgaagggaattttcgaaggggttgatcgggtttcggggtcgtgataggcggcgaggcggtgggaggggagcgtgtgaatttacgtcgggttttcgcgggcgacgcgagcgacgcgatttggatttttattcgggatattgtaaatagatttgtttgtgaggtttacgattgggagtttgttattttgtttaagttcgattcggtttcggcgttcgttcgcgttttgcggaggttttttgagttagcgcgcggttgtaggggtttcggggtcgtatttcggattagcgttagcggcgggagagcgttgtttgtgagcg

SEQ ID NO: 11244 - DNA, 1460 bp, synthetic construct
  misc_feature 1..1460: note = Description of Artificial Sequence: Synthetic polynucleotide
  source 1..1460: mol_type = other DNA
tcggggtagtcgagttatttttttaaagtcgattttcgggagagatttttagttggacgtttttcgttttttaggagcgatggttgtaattatttcgttcgtttttacggggcgtttttttaatttttcggttggttttttttttcgtagggtttttttcggtttatcgttttttttttgcggttttttcggttttttaggtcggatcgaggttagcgtttgatttttttggtttttagtttgtttttttagtgtttaagagcgagaatatcgttttcgtttatatgtaaaggtcgggcgtagtaaatgaagtgggaaaagagaaaaatagataaatcgttgtggtataaaagatttttttttcgttcgttttgttttgtagttcgggtttagtaggagagggttggggagaattggataaacgttttggaatttataaaggtcggtggtgtcgggggtcgtaaagggagtgaagaattgaagtagtgagttggataaattcggggtaaagtattaaataatatggatattttggtaacgcgtgcgcgtgtgggtgggcggataaaaggatttattattcgtatgattgttttaattttttattttttttgtgtacgtgtgtggacgttgttttaggttcgagttcgtttttcgtttaggacgtatagtttcgggtcgtggttttcgcgcgttcggttgtgcgtttcgggtttttggttcgcgcggtagttatagtttggcggggtttgcgcggaggaggtcggttaggcgtaggttgtcgattttttttatttcgtttagagtagtgcgtagtttttgcgcggacgggtagagtagtcggcgcgttagttcgcgcggtatcgtcgttcggtcgttgaagcgcgcggcgagtacgaaggggaaatcgaagcgcgcgcggtattgcgcgttgagttcggttagtcgtagtcgttcgttcgcgtttaggttttttaggtttgcgtcgttttgttttcgttgcgattcggtcgtgagcgtgtttcgttgtagttcgttgttcgttaggttcgggtggtagcgtaggatgtttttttggtttgcggagaagtatagatatcggcgggagcgcgttaatcgcgttcgtttcgtatcgcgtattcgagggggcgcgtaggtcgcgttcggtttttttgtttcgtttcgtttcgttcggttttaaagaaggttgcgggagggtgaagtagagtatttaggcggtgatgttttggcggaataggggcgtttttggcgcgtttttttaataagttttggattttgcgtttttcggtttttattatattcggtcgggattaggatttaggggcggggcgggaagtgatacgtttgttttttgagattttgggttaagaagagcggaggagagagagggcggtcgttgaggttcggaatttacgattaggtcgggagggagtagagacgcg

SEQ ID NO: 11245 - DNA, 1064 bp, synthetic construct
  misc_feature 1..1064: note = Description of Artificial Sequence: Synthetic polynucleotide
  source 1..1064: mol_type = other DNA
tcgcgcgattgaggcgttagcggcggagttggacggtttgggaaggtttcggtttttcggttgcggttttagttcggacggcgtcgcgtaattttgttatttttttggtttagtttcggttataggaggatttcgcgggtaacgcgcggagtttttggtatttttcggcggtgttttttgttgtttgttcggggatcgatttcgtatgtttttaggttgatttgtttaagttcgaatatcgggattatgtatttagtcgggattttcgggttattttcgcgtcggataggtaattttattagtttttaattaggatcgttatcgtcgtttcggttgttgttgttgttgttgttttttttgttattggtaagtcgcgtttcggtatagttcgttgttttcggtagggcgttgttgttttttggtttcgcgggggttgtaggggtttttgttgaggaggttatagtgttggcgaatcgcggatttcgggtgtttttcggtcgtgaagtttggttggattttttgtatgatttggtgttgtaggtgtagttcggggatcgttgcgcggtttcggtattagataacgacgtattggtttagcgatcgggtcgtttgagttttaagcgtttttcgtgcgattttggttttggcgaggtgcgttatttttatttgggcgcgcgtagttcgtttcgggatcgcgttcggttgtagttgcgttatgacgcgttcggaggggtagtagtgttattattggtattggaggtggaggtggtttttatttagttggaggttgtgattcggaatttgtttttggtcgtggaagagttgttggggattagtaatgttttggacgcgcggagtttggagttcgttttttagttcgagatagaggagtgtcgcgtgggtattttgttcggtttgggcgcgttgtttcgttatggagaatttttttattattcgtaggtttttggaggagttagagagggaggcgtttcggagatttttttgatggattgtaaagttttttaggaattaggcgtgcgttatcgttatatagtcgttagtcg

SEQ ID NO: 11246 - DNA, 622 bp, synthetic construct
  misc_feature 1..622: note = Description of Artificial Sequence: Synthetic polynucleotide
  source 1..622: mol_type = other DNA
tcgttagttagacggtgtttttgtcgtttttgtcgttattcgttgggtttcgtttcgttttaagcgtattttcggttcgtagggtgggaatacgaggattatagtgttttacgggcgggcgggttaggatcgtaatttcggcggagtcggcgtttttgggtatttttggttttcgcgtttcggtcgtacggtgattattcgggaggggatttcgggcgtttcgtaatttttcggttttcgtgggttttcgggtcgtttcgtttttcgtcgtcgcgtatttttcgcgtttttcggttttcggtgtcggttttcgtttcgcgtagtttcgagtttttagttcggtcggttttttattcgtcgagcgtatttatggcggcggtttttagggtttttgcgatttgtcggcgggacgtgtttttggtaggtgttattttttcgatttgacgtttaggttcggtttcgttgttttaggtatagttttagttttgcgaggcggggtcgtcggttttattcggggggcggtgttgcggggagtagaggttcgtgttttcgagtcgtcgcgcgtggatattagtttcggtttaggtgcgggtgggtttcgacgggagcgcgtggtaggtcg

SEQ ID NO: 11247 - DNA, 1622 bp, synthetic construct
  misc_feature 1..1622: note = Description of Artificial Sequence: Synthetic polynucleotide
  source 1..1622: mol_type = other DNA
gcgtttttaaaatcgagtttatcgttttttttttttgcgtagtttttatttttttttgtgtttcgtattttaataaacgttttcgttaagtgattttagtttgaaatatgcggtttttcggatttttttttgtgttatcgattttttgcgtttagtttttcggagttgtcggtttaatttcgtaagttttttcggaattcgtgttttttttttgggtagcgttattattacgagcgtttatttgagaggacgtttgtttttatttagtttttattttgtagtcgagtaattttcgtaaaacgaatatttggtttagtttttgttggaaatcgttgaatagtttttattgttttttggaagggtttgggtagttcggcgtggcgtttacggttttattaggtttttgttttttgtaggtttcgttatttcgttattaaagcgttcgtcgcgttcgtatttgttgtgaggttgtgttcgggtcgttttcgtcgagggaacggtttttttaaggttttgcgttttaattttcgttcgtttgttaagaggtagtcgtgtcggggagttagagtttttcggggatttttttttgtttttcgtggttttttgtggaattttcgttttaggatttgtacgtcgtttttagtcgcgcgcgcggtacggagatcgttcgttgtgtttcgcgttgcgtttttttcgtttttttttcgcgtaggtttttttgtgttagtcggttgtcgatttaggttaggaagttcgaggtcggggcgttattttaagggttttttcgtttttttttcgagggtagagaggcgttcgcgttcggacgtattgcgggaatatttggagcgtcggcggagttcggttgttttcgcgggagggagttcgacgcgtatttttgggattcggattcggcgttcgcgtttcgggacggatttttgtttcggttgtaggcgtagcgcgtagatttgagtttgtttcgcggaatcggggttcgagtttcggttcgagcgcggcgtcggggttagcggagaggggcggaagtcgtaagggattttcggcgtttcggtttggtcgcgatgaagttttcgtttttttttaggtgacggatcgtcgttgtcgtttcgggttgtttattatttcggcgcgtgttcgggagtttttatttttttcgggttttgtggtcggttacgcgttttaggtacgcgtcgcgtcgggtcgcgttattaagttcgttgtttttagtttttttcggtagattttttggttatttttattttgcggaggggtcgtttattagatgttagaaaattagggtggggtacgtaggttaggggttttagcggttgggtatcgtgtttttttcgaatttggtgttggaagtgcgttcgttttcgttttttttaggtatttatcggtattgtttagttttgtttggagggtttaggattgaacgtttgttttcggtttttattttggttgtagaggattggtcgggtgatgtcgcgttgttttggttttgggttcgtttggaagattcgtttgtgtcgcgggttttttttttggttttggtttttaaagcgttttcggtatagtttttcggtttttgtagttcggtggggtcg

SEQ ID NO: 11248 - DNA, 324 bp, synthetic construct
  misc_feature 1..324: note = Description of Artificial Sequence: Synthetic polynucleotide
  source 1..324: mol_type = other DNA
acgtgggttcggagtagggggcggcgttcgcgtttgattcggtttgtcggttgtttgtcgttcgcgtaggagttggtcgggcgtcgtttgtaggttgtttcgggtcgagtcggagcgacgttgtcgcgtatttgggtagttttcgggggtcgcgttgtgttacggtcggggtcgttgcgattgcggcgtttgtatttgttacgtgattgagtcgggtatgtttttcgggtttttgtgtgagtgttatgagtgggtgtgcgagatttacgacgggagtatttgtgtaggtaagagggcggcgttgttttttttttcgggaggtcg

SEQ ID NO: 11249 - DNA, 1881 bp, synthetic construct
  misc_feature 1..1881: note = Description of Artificial Sequence: Synthetic polynucleotide
  source 1..1881: mol_type = other DNA
tcggggttttttagtttcgtcggggcgtttgtttttcggttgagttcgttcgtagcgcggttttcggttattggcgaggttgtgcggaattagaaggtcgatcgcgttcgggtatttttcgcgcgtttttgattttagttcggtttttcggaagtcgtttgggcgatttcgcggtttaatattcggttttgcgaaatcgttcgcgttttcggttcggtttggagggtttcgtattattcgcgcgcgcgcgcgttcgtataggattcggttaataggcgtcgggatttttggagttcgttttgttagaaatttgttacgcgcgtcgtcgtatatgcgttttaggttttttcggacgtaggcgttatcgatttcgttttcgtttcgcgtttttcggttgtttcgtcgcgatttcgggtcgcgagcgttgtcgtataggcgttttaggtttttcggggtataggcgtcgtcgatttcgttttcgtttcgcgatttcggtacgttttacgtttttcgtattttagattcgtttttttcgatttttattggatagtcggggaaaatggcgttttaaagcgttcgtatttattttgtcgaaatgcgcggtttagtgtacgggcgtttagttatagaaggagtttttagaggttaggtgggcgtggggtgtttgttgtagtagcgagtagagcgtggttaggttttcgtcgcggtaggcgcggtgtagcgggaaacggagcgagagtagtttttcgttggagaagttcgtttttacgttcgcgttcgttttcgtcgtcgatatggttcgttatcggagagcgcggggttcgttggtttagaggacgcgtcggggaggattcgagaagtcgtcgtcgtagtataaaggaacgagattagcgtcgcggtcgcgttttataggttgtcgagcggagcgcgtatagagggggcggggcggggtttggagcggtcgggttgggggcggggtttggtttagaggacgttttgtgtagtcgggtaggggtcggggtttggagtcgcggatttttggagtcgtcgggtagggggcggggtttgagtcggaggtcgtttggagtagtcgggcggagggcggggtttggagttgcggacgtttggagcggtcggtaggtggcggggtttagtttagaggatgtttggagtagtcgggtagggagcggagtttggattagaggacgttagtagtagtcgattaggaggcggggtatggggttgtcgacgtttggagtagtcgggtattgggtttgggttagaggacgtttggggcggtgggcgtttggagtagttaggtagagggcggggtttggtttgggtttacgtttggggcggtcgggggcggggtttggttggaattgacgcgtggagtttcggtggagggggcggggtttggttgggtcgttgtttatagcggttttcggggtttggaggttacggggttcggaggttacggggttcggaggttacggggttggttgtgtggggggtttaggggcgtagagtggttaagtagcggtttgagcgggtttcggggttttcggcgcggtgggtttcggttgcgtttcgggtgcggattatgatgtttttagtttgggagtcggttcgggcggggaatttcggttgtcgggggcgcgggttgaggttttgcgggttcgcgtttagagcgggtgggagttacgggtttttcggaggtttagtagcgcgcggtgaagttgtttagtaaaaatttatggagcgtttacggggagtagggattttcgttaaaatttgggaattagtaagttttagttttttatagagtaggatagatttttcggttttgttcgagggacgtttttttcggaatcgagtgcg

SEQ ID NO: 11250 - DNA, 944 bp, synthetic construct
  misc_feature 1..944: note = Description of Artificial Sequence: Synthetic polynucleotide
  source 1..944: mol_type = other DNA
tcgcgtggggtttagggaggcgcgggttgcgggggattgcgtaaggtcggggtttttggaggtcgaggtcgcggtgtttttcgcgaggttattatgagttgagtgtttttggtaggcgtttagggatttttcgttttttttttttcgcggtttcggcgggcgtcggttagatcgtttcgttttttcgttagttcggaacgttttgtattttttttttcggttgttcggcgttcgttagcggttagaaattttcgtttcgttttatgtaatcggggatttcgcgttttcgttgtcgtttcgttttcggtttagaggacgggtttggggggagggggcgtgtggcgacgttgttatttattagggtttagtcgtcgttttttcgagttgggtcggtgtttcgcgcggttttgtagttttgtagcgttcggggcggtgtaggagtttcggggtgtcgcggcgttcgttcggttgtatcgttggtttttcggttcgggttttaggttcggcgttttttatttttaggtcgcgcgcgtttcgttttttcgacgatttttagtttcgggttttcgttatttacgagttttcgttttcggtgagttgttgtttttagggtttcgagtcgcgcggtattttttgcggttcgaggcggattttttgtagttttttgattatttgttcgtatttttcgttttttatggagtttaggtcgttgtcgtggcggtcgtttagtagtcgttttttttttagttcgtcgcgggggttttttatggtttatttttgggggcgttcggtcgtttggaatatggcgcggacgagttgcgggcgttgttgcgggtgcgttgggtcgcgggttgcgcgttgttttttcgttggggcgttggcgggcgggacggcggtacggattgttgtgggttttgtagcgtcgtcgcggcgttttataaacg

SEQ ID NO: 11251 - DNA, 1514 bp, synthetic construct
  misc_feature 1..1514: note = Description of Artificial Sequence: Synthetic polynucleotide
  source 1..1514: mol_type = other DNA
tcggcggcgttttttttatttagcgtgaaatttacgaggcgcggcgtttcgagtggcgggcgggtagggggttgtaggatttacgaagttattttcgtcggggatcgttttttttcggagtggtttttttttcggcgtttcgttttagtaagacgatatttaggttaaatagtcgttttcggttagttcgattcggttttggagggagcgtttcgagggagtttagtcggaggcggagaaggttattcggttagaaggtggggagtcgtcggcgttttttcgtattttcgtttttatagtagggggaaaggttttgatcgtcgtggtttatattatcgcgtttatttgaggttcgtttcgttttttgggtttttagaggggtggcgtatttcgtttttttttgtttttaagtggtcgtattttttcgcgggacgtttggttgggtttagggcggggcgggcgggcgtttttcgtattgtcgcgagtttagcgcgtagttttcgcggttcggttgtcgtcgcggttagttggggcgggtcgggggcggggttttagggggcggggattcgggggggcgggtcgggtcgggaggcgtgggtggggggcggggcggacgcggagcgtttttttggttggcggggttaaggggttgagaggagtggggtaggttcggcgtcggtaggaagagttagaggggtgattagagagtttaacgtttggtgtttaagatttttttcgaggtatgaataagaattaggcgtttgggtttttttcgttcgttttatcgtttagtcgtcgcgtttcggacgttcgttgtgttttttgtcggcggggcggcggcgggattgggtttcgggagggtttttggaagtcgcgagttttagcgaaggtagtgtatcgtttttcgttttttttttcgtttttttttcgtttttttagttttgggtgtcgggtatcggtggtaaggtcgttttttcgtgagtcggaggtcgtttattttgggacgggcggacgaggttttagggtagtcgagttcggtagcgggggaggcgtggagttcggggcggttttagcggcgggggcgggaggttggttttggttgtagattgcgcgtttgggtttcgtgcgcggtttttggttttttgtatcgcggaggttttcggattatagggttttttggcgggtttcggtatttaggtttgtgtcgttgtggttgggcgtcgggattagtattcgagtttcgcgttttcgggggttgcgtcgtgtcgtttgttgtgcgcgcgtagaggtcggatagttcggttgcgggaagggattcgagcgtagggtttgtttcgcgtttcggaaagtgtttagtttgcggagtcggaggttgagttggggtagatcggcgttagacgggggtttgggtgagatacgagttgggggtgcggtttgtagaatttgggtttttggaggagtttacggcgcgttggcggagttttaggcgaataggagtatcggattcggtttcg

SEQ ID NO: 11252 - DNA, 2144 bp, synthetic construct
  misc_feature 1..2144: note = Description of Artificial Sequence: Synthetic polynucleotide
  source 1..2144: mol_type = other DNA
gcgtcgtttttttttcgcgtttttcgaatgttaagtgtattagtttttaattttttttttgggcgggttcggtttggttaattttagttgtagattttagtataaatttaggattttttttcgtttagtcgtttttatataaggattcgtcgaatatattttgaatttcgcgttagagcgtagttcggaattgtagttcgcggcgcgggtttaggtcgggggtcgcgcgtttttagtcggtgatttaaggtcgttcggttcgggggtgggtgtgggtcggtaggatcgattagggtcgcgcgggggtagttgtcgggcgttcggttatttagcggtgggagtcgaggttggttttggttagtcgttatttcgtcgcgggcgtttgtttcgtcgggttttcgggcgcgggaggaaggttcgcgtcgttttttattcggcgcgttttttttttagtgcgtagtggtttggtgggttagtcggcggcggttggagcgcggggtcggttttgcgtacgaatgaatgggcgttcgggggacgcgcgcgttcggggttgaagggtattaggatcgtgaggatcgtttcgcgattttgtttttttttattattttttcgtttttttattttttttttttttttgttttgtaggattgagtagttaggcgcgagcgaaaataaatagttggggttgcgagcgttttcgtttcggtttcgagagtacgtcggtttagttttttatttggggcgttcgtttgtttattatgaggaagattcgcgttaatgttatcgttattttgatcgtagtttggattttgggtattttttattatttatggtaggataatcgagtttacgtagtatttttcggcggtcggggcgcgtagagggtaggtaggaggtcggagtagtttcgcgaggatcgtattatttcgtttattgtgagtacgtttcgagcgtcggtcggtcggttagggagtcgcggcgcgcgtttagattttgcgcggcggtcgagggcgcggggttcggttagggttgagtgttcgttgcgtcgggtcggttttgtatatgttggagtatttttgttcgttgttatggtaatttttgtcgggcggcggggttggggcgtatcgattaagggagggtgatagagggtgggggttgggagaaagtgttgtaagtttggtgggttcggcgtgcgcgcgcggttgggaacgtggcggttttttcggttttgcgttgtcggggtcgggagtttgggggttgcgggagtttcgtgtgtttcggaaggttgtcgggtttagcgcgcggcgagcgggcggtgggaattattcgtagtcgagcgcgtaggtggtagtgcgtagtttttttttagttttttgggggtagaggatatcgggtgggggcgtgggtaggggaaggttttttaggcgttgcgtttggtttcgaatttttttttgagtcgggttaatttgaattcgttttttcggcgcggatatttagttttttcggagttttttgggttgaggagaggtttcgtattgtacgcgttttttatttttaattttagggttcgttattacgggtaggtgggtagtgttagcgttcgaatttggcgatatttttgtatgaagttagtttcgcgatatttaagcgggtagggaaataaaggtagtgtggtatagcgggggcggcggcggggttgcgggggtttttggcgttttggggattcgggcgggggcgtgcggagtcgtagtcgttttgtagggggcgattttgtcgtcgttttcgttcgagttttaggtgatagagttgtgcgtggttaggtaggggtatttgttgaggcgggaggttttggtattcgtcgagagtgcgttcgagcgggcgtatttttttagacgggggcggttggtggacgagagtttcggacgattttcgggaattattagggcggggtagtttggtcggatgaggattaggaagaggagagtcgagtggggcgggggtaaaggagtgaggaagcgtggcgatttcgataaggaaagatttgggtttgggggtggaggggtgaggagattcgcgggggaggtgtaaggttcggagggttgaggtttgtgtggagtcgaattcgagaaacgtatttagacgcg

SEQ ID NO: 11253 - DNA, 379 bp, synthetic construct
  misc_feature 1..379: note = Description of Artificial Sequence: Synthetic polynucleotide
  source 1..379: mol_type = other DNA
tcgttcggcggggcgtttttacgttgtgttttttgcggtgtatcgaggcgtattcggttgttttgttgcgggttttttggttatttgtgggttatagggagagacgcgtttatatattttcgttcgcgtttaggatagttgcgggagtttcgggtcgttttaatttaatgcgtttttcgtaggttgagatgcggttgtttttgttcgtgtcgttgttgttggttttagcgttcgggttttcggtgagtgcggttttgtttcggttttcggaggaatttgtaggggagtcgggggcggggacgcgcgggttcgtaggtaacgtttttaggaaaggggcgatgttagggaagttgggttgggaggaggcgagttcgtatcg

SEQ ID NO: 11254 - DNA, 637 bp, synthetic construct
  misc_feature 1..637: note = Description of Artificial Sequence: Synthetic polynucleotide
  source 1..637: mol_type = other DNA
tcgcggtacgggagtgcgtacgcgcgtcggaggcgaaggaggaatttatcgtatttatagggcggtcgagtgagggagttgttggcgggtgggtttggtaattttttgggaggtcgacgcgggcggatcggcgggtgttgggaatcgagtttcggtttgcggtcggtagttttcgtgggtttgtgaagaggtcggcggtttttgcgggcgttagttaggtaagtttagttcggtgttttttaggaagttcgtttgcgggcgcgggtagggagtcgtatcggttatggtggttgaggagggagaggttgttgttcgtcggtcgttcgattttaggttttttttcgacgggttcgtttcggggagtaggggtgcgcgggggttgtttttgcgcgaacggttcgggcgggggacgtggggcgcgttgggcgtcgttcgtcggtttaggcgcgcgaatttggcgtttttagtgaattattcgcggttcgggcgttcgggttcgggatcggtttttttttttttcgttgagtcgcggtcgagttggttttttgtattttatttagcgtcgtcgggacgcgattatatcgagatggtatcgagttttttttaaaggtttcggtttgttgaaagtggggcggcg

SEQ ID NO: 11255 - DNA, 959 bp, synthetic construct
  misc_feature 1..959: note = Description of Artificial Sequence: Synthetic polynucleotide
  source 1..959: mol_type = other DNA
tcgcgggatcggggggatggtcgatttttagatacgggagggattgagcgatgtttaaggagagtaggagaatattgcgtttggagatttttgagagttaggggcgggtcgttttttaaagggatttcggagtttcgatttttagttttagttttttttgtgatattatttttcggatagagatttaagttttaggttcggtttcgtttagaggttttagggagaagattaggttatcgtttattgttcggcgtcggggaggaaagaggaggagtttttgtgtgtttatatttttggtcgtttagggtagttcggttcggtttcgtaattttagtttattggttcgggagattttaaaggttttatcgttagcgtttttagcgtttattgtgtgcgttttattttagttttgtttgcgcgtcgttttcgttattttcgttttagtttttgggtcggaagtttttttttttttttcgtcgtagtttttttttagttttttttttttcgtcgatgcgggaaatttttttcgtttcgtttcgttttttttttttagttgtattttcgttcggttttttcgtttagtttttaatttaggtttcgtttttttttatttatttttcgttttgggtcgggttttcggttttatcgtttttttttcggtttcgtttcggttttcggaagttttatttcgttttcggtttcgttttttcgaagttttttgggttttcggtagtcggcgggatagaacgcggagagtcgtcgtttggtcgggcgtagacgcggtggtagagttcgcgcggcgttggaagcgagtggcggagcggcgggatttcggcggattcgttatggaggaggaggtgagggcggggttcggcggggcgttgggttggggttttcgagttttttacggggattgcggttttgggtttaggttttcgtttttgttcgttttattttcg

SEQ ID NO: 11256 - DNA, 826 bp, synthetic construct
  misc_feature 1..826: note = Description of Artificial Sequence: Synthetic polynucleotide
  source 1..826: mol_type = other DNA
tcggtcgttagttttgggagtttcggttgggcgacgaagttgcgggttggggtatcggttgtttttacgggtcggttttgatttaggggttcggttcggagttgttttttcggcggcggggttgatttaattttttttgttcgaggagttgtcgcgcgtagttagcgtttcgaattcgcgcgcggttcggcgttttttcggggtttatttttcgggttagtcgtcgcgtttatttgtgttcgcggttcggttttttttcgttcgcgttgttttagtcggggttgaggtatcgggtcgggttttcggcgtttcgagttttcgttttttttttttcgttttttaattcgtttacgttttcggttttttggatggcgacgcggatttgtatcgtcgttttgggttcgggtcgagttttttcgtcggattgggttatggttcgcgggattgcggcgtcgtcggggtttttacgtcgtaaggtttagttagtcggtcggtagcgattgcgacgagggggcgggggcggtgcgagcgcgtttgtcgttcggtttaggggagggataggggtcgcggcgtttcgtttcgcgtcgtcgtcgtcgtcgtcgtcgtcgttattatttcgatcgttagtggagcgttcgcgtaggcggggtttcggaggtggagggcggtttttcggagttttttcgacggaggttcgtttcggaaggattttcgcgattttcgattatttttttcgttttttcgtcgttgtggggttttagttcgagaggaggtgttagggttttttttttttgcgtttttttttacggcgtcgtagggatgggcg

SEQ ID NO: 11257 - DNA, 2156 bp, synthetic construct
  misc_feature 1..2156: note = Description of Artificial Sequence: Synthetic polynucleotide
  source 1..2156: mol_type = other DNA
tcggtcgatttgatttttttttgttcgcgttttacggttttttggttgtcgaatatttttagggagaatttgttgatttcgggttggagtatggtttcgaattggcgttgtatgaagtcggtttggtttaggcgtatttcggttttcgggaggatttggtcgtcggtagtcgcgtttttttttattttgatagcggtgtttatcgagggttgttcgtaggaggcggaggtcggttgcggtggttgttggggcggcggcggcgaggttgcgggttgcgtcgaggcgtcggggcgttcgggttcggtcgttaggtttgggggcgttttgttttcgtcgggggacgcgtcgttttcggcgatgagtcgtcgttttttcgcggagttatgtaggtgttcgtgattgttgtcgtttttcgtgtcgtcgttgtcgtcgtttcggttgtttagcgaggttaggttttcgcggaagcgtttgtagtcgtcgttcgtgttggatttgttcgcgtcgcgggtcggtttttcgttgttcgttgtttcgagggtcgagtttcgggatttcgtgttattcgcggtcgtcgagggggagggcgagggtagtggtcgtagtcggatgtttttgcggttggggttttggcggttttcggttttttttttttcggcgttttttttttcgtttatgatttacgttttggtttttatttgttgcgggaggttgtagagtcgtttgcgtatggacggcggtagtttgtttatggcgttaggggtcggggtcggatcgggtcgggggtaggagcgcggcgtcgcggacgggttttaggttcgttcgtcggttagttcgttcgtggggacgcgttttttgtcgtcggcgtgggggtagttttaggcgtttatgtttgggtaggttgcgcgtcgcggggaggattttagtttcgtttcgagttttcgggttcgtcgcgttatattttttttcgggttcggttgggcgcggggatttcgcgttttttttttgtttttttttttttttttggcgtttaggggcgcggcgcgtcgttcggttttaggcgtttcgttttcgcggggaataatgggcgtcggtcggagaggttttgcggtcgcggcgtttagggaatcgtttcggagtgtagagcgtacggttcgcgcgggtttcgggcgtgcgtttcgcgggagggttggttgttcgtttgtttcgtcgttcgggttttgtggttggttattcgcgagttcgtttcgttttttttgtttcggttcgttcggttcgtttcggggttttcgtcgtaatcgagcggagtttagcgattcgtcgggtttatattagcggtcgtttttttcgaagcgtttttcggtagcgttcgggttttcgcgtttcggaatatttatgaagtcgtcgtagttcgcgggttgttataggagcggttttagtagtcgggtttgtttatttgggttttttaaaggggtagcggcgtacgggtcgggggttggaaaggggcggggggcgggtttggtaaggggtttaggttagattttcgttagattttcggggtcggggtgagaggtatttatattgttgcgtttttaaattttttttttgggttaagttgggagtgcgttttaagtttgaagtttcggttttagttgcgaattttttattttaagattgaagggtggggggtggttttttaatttttttattattaagttttgggttcgtttttttttggtatttttgttttttagttgggttttcgattttttttttgggaggcgatcgggttcgtttggatgtagagtttcggttttttcgtaatttttttggagagggggttttcggaaatgcgtcgcgtcggggaggtttttacggtttttttgtgatatgggtagggtgcgaatttcgcgttagttttttttttgtaaagtttcgtagtagttaggtaaggagggcgtggggaaatagggagatacgtatagggcgcgcgggtgggatttagtttttcgaggtaagatttcgaggaaatgcgtcggtaatagtgacggatgcgagattcgaacgtcgattttcgtacgcgtttttttttcggtagtttcgagaaagggataagtcggttgtagcggggagcggttgggtcggtttttcggacg

SEQ ID NO: 11258 - DNA, 1441 bp, synthetic construct
  misc_feature 1..1441: note = Description of Artificial Sequence: Synthetic polynucleotide
  source 1..1441: mol_type = other DNA
tcggagggaggaattatcgtaagcggagatttcgggcggcggtcggcggaagggttgggcgggaggcgtcgggatgtcggtaggattttgcgttcgagggggtagggggttcgtgtcggggttttaggcgtagattgatggggtttaagtagggaatgtgagggcggggagggcgtataacggaagggattaatttcgcggtttcgagttgggagtaaatttcgttttttattttttttattcgttttttttttttagtgaagacggtttgggggcgggtggggaggcgcgttttcggagcgttttcgcgtttttttttcgtttttcgcgcgcgatttatcgttttttttttttcgaggttagcgatggttcgggtgcgggcgaggagttgggagggcggttttcgacgtaggtgttagattcgttcggtagtgttcggcgcgttggttcggtttttagttttttcggtcgtcgtttttcgttcgtcgcgtcgcggcgttaggagggcggggtcggggcgcgcgtcgttttttagtaagcgggcgggcggcgttcggtttgagggagcggggcggttttcgtcggcgtcgcgcgcgttgtgtgtgagcggggtcgcgcgcgcgcgcggtaggcgagtgagggaacgaggagcggtcgggtgtgagtgtgtgggagtgagagtgtgtgggagtggggtgagggagaagttgacgggacgcgaggttgtgagaaattgggcgagtgtgcgaggacgttcggttagtttgcgggagtcgtagtcggcggaggagaaaggaggcggttttcggtatttcgattttttttttttttttttttttttttatttttagtcgttcggcggttcgcgttttttcgaaggttttagttcggtttagtcggtcgagagcgagggaggagtttttcgatttaggtgagcggtacgatcgttgttgttttcgggtgtagagtagtgaggcgaaggcgcgttttttcgagtgggcgagtttagcggaatggatttttcgattagcgggggttgggtcggggaggggatcggttcgagcgcgttcggggttcggggttagttgaggtcggtggtcgtcgtttcgcggagtcggtggggagcgaggcggggttcggttttcgcgcgtgtgtcgggaggcgtcggttcgtggcgtgtgcgtgcgatcgggcgagtcgtgtcgagggggcggcgatttcgggcgtgtaaggagtatggttttttcgtcggcgagggggtgtggtaatttcgggaacgtcggttggagtcggattcgcgggttgttgatttgttttcgggattgcggcgatatttttttttttttttttttttataaattttatggagcgatcgcgggaggaggattacgtggtgcggtttcgtagttattgtattcgattttacgtttttttttttacg

SEQ ID NO: 11259 - DNA, 734 bp, synthetic construct
  misc_feature 1..734: note = Description of Artificial Sequence: Synthetic polynucleotide
  source 1..734: mol_type = other DNA
tcgattttgggtatatagcggtaaattttgtttcgtaatatcgtgtgggttttcgcgtattttttcgcgtgagcgtttcgagttcggtgtagtttcggttttcgcgcgtttttgtttttcgtatagcgttttcgtttcgaaggtgttttgataatttcgtaggcgttattcggagtcggggtagggtagttggggttggaggcggcgggcgcgggacggagttttatgaaagttggaagaagtgattataaatcgggattcgattttcgtagttttggcgttcgtttttttacgtaggttcgggatgtcggttttagtttttagatgtcgggaagacggcgtcggttagtttaaggaagagtttttaggaggttggggagtaagggtgtcgggttttttatgtcgggttaggttttttaggagtgtcggtttttagggttattaggtttaggtttgcgcgaggagggagcgcgcgtttttttttatttattcggttttcgtttttaattcgtttttcggtttatatttatttgtttggttgtaagcgtcgtttcgggttaggtagttaggtttttatttttagtgcggcgcgtttcgatgtcgttatcgggattttcgttttttaaattagttttttttttattcgtaatttcgttcgtcggggcgttcgggggcggaggcgcgagtcggtcggcgtcgcggagtcggttcgtagatagggcgggcggggttcg

SEQ ID NO: 11260 - DNA, 935 bp, synthetic construct
  misc_feature 1..935: note = Description of Artificial Sequence: Synthetic polynucleotide
  source 1..935: mol_type = other DNA
gcgtgcgattcgcgtttattgtggtttcgttttattgatgatcgtgaatttgtagggtgttgggttagttttttattttaaggttgggtaggttttcggagtttttttcggtttagatagaagtttttttaggagcgggggaggggaagggggcgcgcggttcggttttaggtgtggtcgcggataatgagattttggggatgggggcgtatttgcgttacggcgtttcgtagagggttttttaggagattttttcgggttttcgtcgcgtcgtgggggtggggtagttttgttggttagagtcgggtacgggtcgggcgggcggcggggatcgtgatcgcggttgcgtgcgttcgcgttcgggcgtttttgtgcggggttttggtacgtcggcgggggcgattcgggtgtcggttcgtgcgggcgatacgcgcgtttttgcggggttgcgcggggttcggagcggttgggggttttttgtcgggcgcggttgggcgcggggggcgttttcggtcgggatgagtttatcgtagtcgcgtcggggttgagcgtcgagcggggcggcggcggggcgggcggcggtttttcggcggtttcgcggcgttcgggtcgcgcgtcgttatgttgggtttggacgcgtgcgagttgggggcgtagttgttggagttgtttcggttggcgttgtgcgttcgaggtgagcgggtcgggtaggggcggggggttcggttggttttagtttcgggcggggagtagtttttttttcgcggtaattttgggggcgcgtatggggatttcgcggcgtcgatttttcggttggggtttggtaggggtgggggattttatttaggttttagttttgtggggaagggattaggtgcggacgggtcggtttgggaagcggcggcgttgggattttttttttttggatatcgtcg

SEQ ID NO: 11261 - DNA, 1054 bp, synthetic construct
  misc_feature 1..1054: note = Description of Artificial Sequence: Synthetic polynucleotide
  source 1..1054: mol_type = other DNA
gcgcggttttcggaggtcgatattataacgtttgtaagggtcggttggggtcggtatatgattcgattttacggtcgtttttaggggtggaggggtcgttattttaggtttggggaaggaatacgaggttttgaggagcgaatttgttttaggtgttcggggaggtttggcgcggggttgtttcggtttttttttagagtcggggagaggggatatcgtaggatgtcggcgttcgaggcggtagtattaggtttacgggcgttttagtttaaatatttttcgtgtttttagagcggggattttcgttttttagattcggaagcgtcgtttttttcgttagggacgtttgggttttcgtagatttcgtcggtcggcgcgttattcgcgttagtattatggatagcggtcgttttagtcgcgcgtttagggttaggttcgggttggtttttatcgcggacggttgcggggtcggggtagtttcgtaattttaaatttcggtagttttcgtttagtagggaggggtttcgggggcgaagagtgggggagaagtcgggaaggattcggaggaggcggcgggggcggcgttaggggaggaataatttcggcgtagtgtcgatttaggttgaaaacgtttttagttatgggtttgtacgtggagcgtcggggttgggggaggtattcgcggggtttttttttcgtttcgttcgggagtttacgtttgtcggcgtttatagtttcgtttttatttttaggttttagggtcgagatggagaaattaagtcgtattttgagagtttataggagggaggggataggttgaggagcggtcgtttgggtatgggttcggggtttggttttttttatttatattcgtagcgttgttagaaggcgttgttttgtttgtggttagttttcgattcgtgtgtttggtgggagttgtattttcgtataggtagttttattgttttttaatttcgcgtttacgtttttgtcggttttcgttgttttttatattttcggtttgattgatttagttcgaatattttttatttcg

SEQ ID NO: 11262 - DNA, 1474 bp, synthetic construct
  misc_feature 1..1474: note = Description of Artificial Sequence: Synthetic polynucleotide
  source 1..1474: mol_type = other DNA
tcggacgttgtggtagaggaggttcgcgcgtcgtatatttgttgggatttttagttcgtttaggattggtagggagattttggaagattagcgttcggaggggtgaggtttcgttttgggggtaaggtcgcgaaattacggtttgtagttttacgttaggggtataaagaaaagcgtcgtcgggaatttaatatttgtagacgacgcgtagtcgtagaggaggcggggcgttcgaggtttcgtttcgtatgttaatgaagtatatattatatcgtttcgtttcggcgcgagatcggtttaacgttgcggagatttagaggtcggcggcgttcggaaatattcgcggaggtcgaggtagggcggggtcgggcgtcggggtcgggtcgttgggcgggcggtatagttcgggggaggttaacgggtcggtcgggcgtttcggggacgcgttttttttacggtgcgaagtggtacggttcgtaggggcggggtttaggttatgtgacgcggtcgcggtcgttattttgttttgcggtgttggtatttagagcgtagcggttgacgggtcggatcgttttcgtcgtcgttcgttcgtaaattttcgtgttcggttcgttttcgttttcgttttcgttatcgtttcggtttgtagagtttgttttttttttattcgtagatatgttcgagtttaagagcggtttcgagtatgtttcgtttttcgtcgttatgggcgtttcggtcgttatggtttttagcggtgagcgcggcggcgggagggattcgggggcgggggcgcgcgcgttgtttatgttcgtagttcgtcggggttcggtgtgtgacgttattttgacgtaatttcgagttgtcgggggcgttcgggtttcgtgtgatagcgggcgggggtcggcgtttcgagggttgcggggagtcgtcgggggttcggggcgtagggcgtgcgggtttggtcggggtgtgagtttcgggggttcgggtcggcggttttgttagtcgggtcgtgcggttgcgggggtggggcggcggcgtcgttgttatattagtttcgggagcggcgagagggaggttggggtgggggcgcgaggggggcggcgcgaggggggtcgattttgcgggtaggtgatattatatttcgaaggttttagtgcgcgggcggcggcgcgggttcggtttaggaacgtttagtcggtcgttggagtttttcggttggtggggagtttatgttttttacgggaggtttttagttttcgtttttatggcggtcggtttcgagggttaggtgggttttatttataggtaggtattttcggttggagttggttatagttgtttaatattcgtgtcgttgtgtgggttgtttgggaaagttgggttgagggtttggttcggagagttcgcggagattcgggtgggagtgtgtggaagtggagggagcggggagatagtagtatcggcgttggcg

SEQ ID NO: 11263 - DNA, 357 bp, synthetic construct
  misc_feature 1..357: note = Description of Artificial Sequence: Synthetic polynucleotide
  source 1..357: mol_type = other DNA
tcggagaatttcgtatatatacgtattcgtaaatacgcgggttttttgcgttattaggaagtagtcgttagaatcgtcgggtgttttttaattatttttgggagatttggtttttcgttttcgttcgcgcgcgcggttacggcgtttttttttttttcgggtttttaaggtcggattatcggtttcgttgttatggcgacgtcggtttatttttttttattttcgcgcgtttttacgtttttttttcgtagggagttggggtttttttttttttttttttacgttcgtagggatttataggttgataggagtagggggtcgtttgttgttatcggtcggggatttcggggtttttcg

SEQ ID NO: 11264 - DNA, 814 bp, synthetic construct
  misc_feature 1..814: note = Description of Artificial Sequence: Synthetic polynucleotide
  source 1..814: mol_type = other DNA
tcgtcgggagtttcggggttcggttttagtttcgggttgaataagtagggaggggagaggtatttaggtttcgttttttcgcggttttttttttttagtcggggaggaggagatttaggaagtcgcgttcggtttcggtgggtggagggtttaggtcgcgttttttagtttcgcggttttaggtttcggttcgttcgaggcggagttcgggaggtcggggcggggtttcgggtcggttatttatttgggttgttagttattttagtttcgcgaatagttggtgtcgtcgttgtttagtcgagatttcggggttttgcggtttattatttttttcgatacgatatggttaagcgtcgtcgttcgaatcggtcgtcgtcgatatttcgtttcggttcggggttgaggaggaagtcgagaaggaggaggaggaggcggcggcggagggcgggggaagaggacggtcgtttcgggtttcgtttgagttcgtagggtaggacgagggagcggcgcggtgagagaggcggatgaaggcgaggcgacgttttttttagggtcgtgcgcggtttacgacgttggggtttcggaggacgaggaggacgaggagtaggcggtggcggtagttttttacgtttatacggttattgttttttcgtttttcggtttcgttcgtcgcgtcgtcgttgtcgtacggtaagttgggagcgagaggcggggtcggtttcgtcgggtttggggagagaggcgggttttgtcggcggggcggggtcgatagtaggtagtttcgttttttacggttttaggtttttggacggcg

SEQ ID NO: 11265 - DNA, 847 bp, synthetic construct
  misc_feature 1..847: note = Description of Artificial Sequence: Synthetic polynucleotide
  source 1..847: mol_type = other DNA
acgtaaagcgtttttttttttattttcggagatggtacgtgcgcgtttttacgtagtggcggttgttgcggcgagtacgttttttgcgggatttacgcggggagtgggttggtagtgcgcgtatagcggcggcgagtgggtcgtgtacgcggatgcggggtgggagtgggggcgtacgcgcgggcgtgggcgagcgggtttcggtagtgtatatatacggtaggggcgggcgatagatgtagtgcgtgcgtcggagtttaagcgtataaacggaaagagcgggcgcggtgcgtaggggcgggcgtttagcgggtttggtatgcgcgttttcgttcgaggttataaaagtatcgttatttgttgttattagttaagtcgcgcgtttagttgtttggagaagttcgtttatcgtttttagttgttgtttttttcgatatggattttgagatttgtttttgtttttttggtgagttttcgttttcgttcgtattttgcgtattgcgcgtttttgtatttgtaaagaaatttacgttttgcgttttcgtttaaggatatttgggggaagggtttttgattttttattttttatttcgtgaagggcgggtatgtttgtgtcgcggagaatagggagatttggtattttattttttcgtgataggcgtggggattcgagttcgtttatattaattttttttgtggcgtcgttttttttaggtggtttttgtatttgcgcggatttttgtaagtgcgagggatgtaaatgtattttttgtaagaagagtgagtgcggggattttttttttttgtcgtcgttttttttgttttgcggagtcggtgttttattacg

SEQ ID NO: 11266 - DNA, 589 bp, synthetic construct
  misc_feature 1..589: note = Description of Artificial Sequence: Synthetic polynucleotide
  source 1..589: mol_type = other DNA
acgggggtaggcgtggcgtttttgggattgtcggaaaacgacgtgagggaaaaatttagaggttacgaaaaggcgaatagacggagggtttgttttaggggagttaagtagttcgtttgaagttttttatttggaaatgacgtgtttaattcggcgtttttgtagtttcggtcgtttttttttgtttaatttcgcgtttttttagtttcggtcgtttttttcgtcgtttttttttcgcggtcgtttatttttgagatttttggttttattgagacgtttagttttattcggtaattcgcggatattaagcgttataaatttaaatacgagatttagagacgttgggttttaaacgttttttagagtgaaagatagaggaattaatcgaggttcggttgattttagacgtttaaggcgataggcgttgttaagaaaagggggtgggacgatatttagttgttaagacgacggttttcgggtgggcggtttgaggtggttttcggtcgttaggcgagatttcgcgggaaaattttttgttagagagattaggagatttggggttgcggtcgtttttttcggagtatttacg

SEQ ID NO: 11267 - DNA, 848 bp, synthetic construct
  misc_feature 1..848: note = Description of Artificial Sequence: Synthetic polynucleotide
  source 1..848: mol_type = other DNA
ygyggygtattttttttttygtattatatatatatatatataygatgatatatatttttgtgtttttttygatgtaagtggtttygtttttygttgggttttaggtgtttttgtaggaaatgyggaggygyggggagtttagggaaygggtttggggttttaagttygtgatttttatttttatttygggttttagttttgyggygtyggttygtagyggatttatyggaygatgtygaatatgataagtaygttgtttagtagttttayggygtatayggtygagtagagygyggtgatggygattgttagggygagggaygaggygtttygygygtttggyggtttygaygtattggygttagygttggggtaggygttagggtaggygttygaggygttggygaagagygggggttgtagttyggygtyggyggagggggtyggttttatggttgtyggtyggtttygtygygtttttttttatygtgygttttgggygyggggattygaygygaggggagyggtaaggtagaggtygyggtttygaygtygtyggttgtygygtttyggtygtttygttgtttttgygtttygttygtttgtttygtygttygtatyggtttagttttyggygttygttygtttttttygttyggagygttgtgagttaggagtagtygtaggtttttyggaygygttygtygygygtattaygtggttyggaggyggtygttagtttgygttygygatygggggyggaygttgtattatyggttyggagttgggtaggggaggtttttygttttttttttagggatgtttygtyggttygagtgygatttygt

SEQ ID NO: 11268 - DNA, 1230 bp, synthetic construct
  misc_feature 1..1230: note = Description of Artificial Sequence: Synthetic polynucleotide
  source 1..1230: mol_type = other DNA
ygyggttygtattttttttgtttygygggygttttgygattttttttattgygttyggtttygatagaagtttagggagtagtggttttygygtttygtaygttagaygtggggttaggyggtaggtttttagtttaggaatyggggagttttttyggaagggtgtgttattyggagttagyggttttttaygtatttttttagagtgagaaygtaygyggygtagttatyggttygttttttttatygggggttttyggatttttaatttgtttggggttgtttttgtttttygggygaggggtttttggggatttaggatatttggttayggggaggyggggtatggggggtagaaagttagatggagygggtaggagaaggggggtgttgggaggagttaaggagggagagagggggygtgtatggggygyggagttaagagttatygagtttgggygyggtgtgtaggygagggttayggttttygtagtagyggggaaygyggggagtygaggtatttagygggtyggggaagaaggtgggggatttygyggaygtygaggagagggtattgyggagttagtaggttttgtagggagtyggagaggggttgagtagattttgaaggygggygggggaygtatttttyggyggggtagggtgttttyggatayggygagygygyggtatagttyggtagggtgatagttttttagygtygygtatagttygttygttgggggtttaggggtggyggttgyggtagggggtttyggggtygggatyggagyggygggygygattttygagtygggagttygggyggyggggttyggggtggtygtygttttttttttttgttgtagttttttgagtyggyggagggttatggtttyggygtyggaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygt

SEQ ID NO: 11269 - DNA, 1094 bp, synthetic construct
  misc_feature 1..1094: note = Description of Artificial Sequence: Synthetic polynucleotide
  source 1..1094: mol_type = other DNA
ygygggagtttttygagttttattggttttttttttyggtygtygttaygyggggygtygygtttttaygggtttagaygtttagttaatttttyggttttgtaaaagtttttgggggtgygyggggttgggygggggtgyggygtggttttttttagggtgggttttaaagtttttattttygttyggggygttgatatygtygattygtaagtttatgtygygttyggagygtygyggggttagtaygttygggygggyggttyggaggaggyggyggtayggttggggtattttyggtttygattygygatgaatggggyggttygggtttygtttttygtagtttygttyggaggtttygtttttygagtttttygtttygyggttttygttagtaygttgttygggygttttttaaattgtttayggagtyggatttygygttgttaaygtttygtttygggtaaggttgyggttttygtygggtttyggygttygttgtttygtaygttygggttygggaggaggaggtygggggagtygggtygggygtygygagygttgggagggttyggtttygtyggggagyggttttygagggygtaggagygggagtygggtyggagattttygygtagttyggtgatattttygtttygygttttagttyggggtttttaggtatygygygygtttaggyggygtattygtatttattttygtttygaggttygtttygttygttaygtyggtygtygttaaygagttttyggttygygtygttttagygttttgtagyggaggygtygtttttatttygatygtaggttygttygggtygttygttygtygggtatygagtygttttgtygygygttgygtttyggggyggggtgggaggagagggagtagtygttattttgtttaggtygtygygggttagttttgtagttagttttagttttgggtygggtgttgggaaggtyggaygtyggtyggyggtygyggggtttgtttttyggaggttggggyggtttaggttatagatttygtygttttygtattttttttttagttatttttagygtygt

SEQ ID NO: 11270 - DNA, 1979 bp, synthetic construct
  misc_feature 1..1979: note = Description of Artificial Sequence: Synthetic polynucleotide
  source 1..1979: mol_type = other DNA
ygtttatttttttygygtgttggagaattaattagtaaggtagggaatgyggttygtgggygtttggtttttttaagyggtttaggtttttagagygygaggtttaggggttttggagtygyggtygygaygygttygagggtygtttttttygayggtagagtaagagttatygygygggagtttygagygatygtttygttgtttyggtatttttttttygtagtygtttagagttttttatgtttygtgaygttygttagggtagygyggtyggaggtygggtyggaygtggttygagatgttygggggtaggtagaagattaygggtaygygataggtaatygtygtttyggttttagaggtggaygttttgtttttttgygttttaatattagattttgtttttagaygatatttttgttgttttyggtatttggaaagattaatygttaggttygagaatgtaagatttatttttttttgygayggaggtagttaatttagttgttygttatttttagtgtygtatgygtttttaygtaggattttgtttaatygttatygggaygtttttttagtttygttttyggatygttagagaggttgttaatttygttttttttttttattttattagygtattaatttayggygttgtgaygtgtatagtttttgyggtyggtyggggygggttaatggyggtggyggatayggygggttaatgggygggagygttttatgyggtyggttttygtygtagtygtygttgggttttggagttagaggtygttttgagayggtgygygatggatygagggttttagtyggggaggygtygtygtygagttygyggttagaygttttattagtagygttygtatygggagtygyggttttygttygagtygtgggygygttygaggggygggttygtttttygtygtttttygtagttttgtygggttygagttygygtygtygtygtygtygttttgtygttygggtygygyggttygggaaaygyggtygygggttgtatgggtagygttygygtttygtygttgagtygtygyggagtygygtagttttyggagtayggtgagaggygtygttggtttgggggyggtggtyggggygggtayggggtattygygyggttttgyggtttgtaggtttttttyggygayggagttgygtygygggttttygggygggtttggggggtyggggtygggtgggygggggtttttgggggttyggggygatygtgagggattaataatgggtttyggagygggtttaygggttygggttyggggtagtygggggtttttgggggttyggggtggtygtgaggggtttatagggggtttyggggggggtttgggaggtyggyggagtttgggtyggtygtaaggggyggaygggggtttygggygggtttgggtggtygggggttygyggyggttttgaggggtygattgggggtttyggggygggtttgggggtygtgggggttyggggyggtygtgagaggyggatagggggtttyggggygggtttygggggttyggagyggtygtgaggggyggayggggggtttyggggygggtttgtaggttttggggatttgaggttgtygggaggggttgttagggggygttggtygggygtygggttttgyggagttggggygtygatttttgattygygagaggggygttttygtygtgttggtygtagttgttatttttagygtttttattattatygttgttttgaaatgagagtaggyggttttygggtttygagtyggagggggagggygaattggggatttgggggygtyggggttgtaggaggygygygtaggtygaggaggggtaggaatgygggtagtygtgtggggggtgttagggggagggtaggygggygggtgtggggggtggttgggaggaaagyggtggyggtggygg

SEQ ID NO: 11271 - DNA, 1930 bp, synthetic construct
  misc_feature 1..1930: note = Description of Artificial Sequence: Synthetic polynucleotide
  source 1..1930: mol_type = other DNA
ygyggggagatyggggygygyggtaygyggygtttttatttgtggatgtttatttttygtggagggyggtgggttttgtygtaggagattttggygaagaygtyggttaygatgaygaaggygattatttygtaggtgatgtagayggtgaagttggttttgttttttttygggtygtatttgttttygggtttyggygatattattttggtgttgggygtttgtatttatatygggttttggtagttggtgtattggygttggtttagtttttygtggygttttttgtagtagaagyggtagtagtaggtatygtagtagtataggtagtygttttygttgttgttatattygaattttttgtygtattggtygtttaygtygtagtagttttagtaygtttygtaggtgayggtygygttggtygtygtygttatagtygtygygggttgttttygtyggtttttygttttygggatttygggygttygggyggtgtygtttagttygyggtygtttygtgttagggygttttyggtttttyggttttygayggtagygtygtttgtatttagggttyggttggyggygyggtygygggtttygtggaygttgggtagtaggtttagggattttagygagagtagtagtagtagtaggaggygtygtagygttatggyggggtygggygggagggygyggggaggttttygyggtaggtygttttttyggygggtygggttyggaggattygtygygygggtygggttggaggygttgagyggttagyggtttyggggygatggygttatygaggygygggyggtagtggyggyggyggygygyggtgygtayggatyggttyggygygggttgttygggtttttaggttgygygtyggtttygygttttttttgygggttyggygygttttttgggtagttttatttttygtyggyggtgattgyggtttygygygyggttyggtttaggtaggattygaagygyggtttygggyggyggyggyggyggyggyggygtggtttygttygggygggttttgygggataagayggggagtyggttayggggtggggygattggygtttygggagtaggaggagaatygygggtaggygggyggggagggtgygygtagttttygaggagagagattyggagtygggaggggygtagagttygtttttaagayggggtttygyggttttgygygtttggaatygagagygtaygggtygtttttttaggygtagttyggtygttygggttttttagtygttyggtttygtagygygttttygtygtaggttggttttttgggayggagtyggttgaggttggggttyggyggygagtygggagagygygyggyggttggattttatttatttattatgttyggttgygattgtagaggyggyggyggyggyggyggyggyggyggyggggygaggygggaaygtagttgtyggagygagygagyggagagtygtyggttygtygtttgtattagtgtyggaaygtgtgygagagtgagygagggagatataygtatttatatattygtatataygggagygtygygaggggaggggggataggggaggggagggtagtygtttttygttatttaygtttgtaygttygggygtttagggtgyggggygggggggattttttttygtttttttyggatygtagtagttgaagtttygygttaygaaagtttyggatagtagttattygatayggygaattyggygggygaagagggggtygggagtagggyggaaygttygttttgtagtyggttygyggtagggattgattttttttgttattgttttttttagttttygygattagtttttattttatyggagttyggggtagygygttgtttgagygg

SEQ ID NO: 11272 - DNA, 3177 bp, synthetic construct
  misc_feature 1..3177: note = Description of Artificial Sequence: Synthetic polynucleotide
  source 1..3177: mol_type = other DNA
ygtaggtggggtaagttygggttatygaygagatttgttygygttttygtttttattttggtgtttttttttttttttggtagttttttttttattygtttatttttygggtttatttygatttatttggyggtgggtttttttttttttygattttyggyggtgyggttygttttttttttgatttygygtttggtygtygtgtttygaaggatatgggttatagatygtgyggagatattagtttygygggyggttgttttggtttaagtagaagaaaattatyggggttagygtygggtayggtagttttttygtttyggagttygygttgttygggtttttttttgttgatttyggtttyggtyggttttyggttttygataggtygttgagtygtatgaagtttyggggttgtttygatttttyggygttygttttattttttttttygtttattttttggttagtyggggtttygggygattyggagaggggtaagyggygttttttagaggaggtgtttttaygtaattygggggtttyggygggggtatatttggtgggttttagggygtaagttgagttttygggagggttagtttagtttagttttttttgttygtaggggtatgttgttygyggggygtyggggygtagggaaatttygttyggygygagtttygttttttttgygtttttggggtttttygggttagtyggtyggtttttttttattttgtttyggttttttygtttygygtttaggtttyggttgtyggattyggygttattttyggygaagtygtttygagagggygaaygaaaaggggggtagyggyggagggygggggttyggggaggggygtttttttttttygyggygtagttggagtyggatttaaggggttagtatygtttyggtttygygttaggyggygggggaggggaggagggatttttttaggggtgggtttggagggggtgggggyggttttttttttygtttygtygygggtttattgttygggaggggyggggagatagtggggggtagtttygggygggagtggaggyggagatgtygtygtygtagtygtygyggtggttgtygttgtygtagttgtygtyggygttatagttttttttttyggtygagaygyggagygagygagygaaagyggyggygaggagtttygygtatattatagttggattttttattttaattttaagtttyggtttygtttttagatagtttygtagttaatygtyggaygtygtyggtttygagtygygygtttattggtygttygtygtggtagtgygggygggagygtagggagagaattatagttggaattygatttttattttaaaatttaggatygttttttttttttttttttgtttttgggttygttttygaaggttggagttaattagattgttgtttagatygaatttatttttttattggttattggggtttttgggatttttttggagggagttygaagaattagagtattyggygyggggttttggygtagggtygtaggttttaggtattttttgtttaygatttttgatttgggtagtagtyggaggayggagtttagttttgggygggtttggggaagaaaggagataggyggtaygggggtgagggttgttattagggggttttagagygaaattttaggtttttatttggttaattttttattttggagttgagtttggttgygggattgggggagggaaggagyggagttggatgttttgggggtggggttttaggttggaggggtttagttttggagaaaygggyggagttygagaaaggttagggtaggtatggtttgggygtggtttttataaattttttgggtttattggttatattttygagttaattttgagatttygattttgatttygtaattttaattygttggatttgattttatattgaygtttttgggttttatttttttgtttttagggattttttgaagggygtggattttaygtaggggtttygtgtttgaataygtggttttaggtaggtygygttggatygtagagttyggatttttaggaggggttgyggagtagagygaggatttttaagaaggaatttgtgggggtttygagtgtgtgggagggggyggaagtatagagttgggttttatygattygatttttaaagtttttattatygttattttttaatttygtgttttagttttttttaagtttttatgtggtttagggaaagagtgttygyggaattggaatttygygggtttgtygtttttatttatttattttaattttatyggtagygggttttygtgggtttgtgttttttaygygtgtataygtaygygtagatttyggtttttgtttygtttattttttygagttttggggtttagtyggttttagtttttttttgtygtyggygttattttagaaagttgtgggtattygggagyggagygtygygggtgtgttgggygtyggtggaggggggaatagygaggattagaygtygggaagtatttttttaatatttgygagaggtagatayggyggaatttagtgggttagttagtttttttttyggagattttggggygtttgygttattgyggagaggyggygggatgggtyggatgatttttattattattttttattttgttgaggttattatttttgggygttgtttatttttttaaggttgtattatttaygtagttttygygtatttttygttatygtagagggttggggtygttttagttttygtttyggtygatggggggaggggatgggggaagtggtagagtggttgttgygtygtygtttttttggttgttttttygtygaatttatgtatagagttgtgtaaatgaggtygggygggtttatttgtattttatgttaatgagtagattttttaagtgttttttttttttggygggagtttttgtttttattttgagtatgyggygtttgagttttgaatttygtgtygttttttgggaaaggggggttatttatggttgtttygygygtttgatatttttttttttttygagaggtygtagtttgtygggtyggtttgtttttttygttaggatagaggtttyggggttggygyga

SEQ ID NO: 11273 - DNA, 2195 bp, synthetic construct
  misc_feature 1..2195: note = Description of Artificial Sequence: Synthetic polynucleotide
  source 1..2195: mol_type = other DNA
yggtagagaggaygttatttaygagagagagtgatygyggatttttatygagaggtaggyggtggaggggttttttttggagatttygattatggagtggttttttttttttttagttygagtygtagygtygggtttttttatttttttagtttttagtyggttygggtttgaaaatttttagygatygagyggagttggygyggygtttttagttygtaggatgtttagttttttygtttttgttttygtttatttttygtygtttygattygattttttygggyggyggagygggaaggtagtagtttttatttgggattygtygtyggtttygttttagygtagygtttggggttaattttagttttaggyggggggygggygggggtgggagggaygyggygyggggygttgggttaggttyggttttggttgggatggyggggttygggtygggaygtagggtttgtttttttttgggatygaggttgagttaggygygttgggttgttygttttygygygggtttgtttttaggtagggttttttgttttyggygagggtgggttggagtttgtattatygttatattatttttatttagggygttaatygggygttygtygygttttaggtaygtgygtttygtttatataggaataaagtttgttyggtttttttygtttygatttatttttaggttgagtygattygtatttttyggttggtgagggagatgggagtttttggttttgtyggygtgtgggttgttgttgttgattgttaygttttygtatgygggygygygtatatttaygygtatttattttttgggttyggttttygtyggggtaattggtgtgagggtgtagttttgygtattttttatygygttttttagagagygygtttayggataygygyggggttattttggygygttttygtgggggatatttagtttttgttattttygttttggttttttygtgagatatattttaggtatagttygttgggagygggtyggagygaggygtatatttaagatagagttygtttttgttaygttttttgygtttttttttttttttagtttgtataygtggatatatygtatatygaggttygttttttgtaygtayggtttttttttgggatttttattagttattaagygtaygtgggatygttattaagygttttttttaygygtgggtygagtttagattattttggatygtgggtaaaggtttttttyggttygattatttygygttygggttttttgtgatygttttaggttttgtttaattyggagygygtttttttttttyggygttttygttttttgtttygatttgttttaattagtttttayggttttgtttttygaggtatagtgtttagygygattttttgggtttttgygtttygggataygttggttttgatttygagttygttttttttaggaggttaggtttttattagttttattttttattttttgtttyggggtggatttgtgggttgttattttttttttttyggttttaggaatttgttgaagttggatygtagaaattgggaagygaatttaggttggtatttatttagttygataaataagagatttttyggtygttttttttyggggttgttggtttygyggggggtggggtgygtagttttgggggttygtagygaggtttagttagttygygttagaggttygtaggggttgaggygtatagaggagggagaggttgttgggtttggttagggttttggagaygyggagggagggtagggygtygagtttyggggtgtyggtttttatgaygtygaattgtttgggggatygttagyggtgygtyggtyggagttagttggtggyggggygggyggttyggagtgtttgtttaattttgagygttygygagggggaggggaggtagttggttaygggttagggggtagtaaggtggaggagygggggttgggaaaggggagggtatttttygggttgtttgtttgygtgtttgtygyggtttaygataatygggagtttaaattttatgaattattyggagttgttggagygataaattttaggttggttttttttttygtatatyggtttttyggatttttggagggaatgtttgtttagyggtyggagttggygg

SEQ ID NO: 11274 - DNA, 2063 bp, synthetic construct
  misc_feature 1..2063: note = Description of Artificial Sequence: Synthetic polynucleotide
  source 1..2063: mol_type = other DNA
ygtttaaagtagaggyggtaattaggygttygggttaygttatttgataataggatagatgttgtayggttygttttttttataygtattatttygtagttygtagtatygttagaaaatttatttgattttagagtygtagagygtttaggggttttttttygtttattygtagtaygtttygggtttttttttttttttaaataayggtatygggtttttgtattaaaatayggygggttygygtttgttattattagtgtaaaatttgyggggggttgttyggaaaggatygaattttatygttgtatgagttttaaaagggagggggtatatttatttttagttttttattttattttygtttgattgtgatgtatatygggygtttgtatagtttygttttatattagtatataygygtttyggtttyggtygtttttygtygttttttttaaattyggtyggttyggggtttggygtygtaygygggtygttaggggttagygttygtttyggttyggttyggtygaataaagggttygygaatttttyggtaaagttgyggttgyggygaggagygggyggattgtygygtttatttgggtttygttttyggyggyggyggyggtttygyggggtttyggtggygygggtttggyggyggyggyggtaygaataatygttygagggtttygggagtgygygggyggygggggttygtttagygtyggygttayggatttaggtttyggygygggyggyggyggyggttgyggyggyggygygggygagtgggyggyggygygtttyggtaggtttaggttyggtttyggtaaygtygygaygygtttttttttttaygttyggygggatgyggtttyggyggggttygggttttaggyggyggyggyggyggyggtggtagttgyggayggttgggygyggggtygtttygtttttttygttttyggttygggygggtttgyggttattgygayggtgayggyggygggagygyggygggygttgggattgttttgttagggggyggttygggyggygtttaagattgygyggyggyggggtyggyggyggyggttayggttttyggggtygtygygttgaggtgyggagttgttatygyggttattttgttgttttaattgataagaattttttttttttygttttagttagayggggygttygygttttttttttygtttygygttggtttttaataggaagtygtttyggtttttagtaygtgatttttatygtatttgtatatyggagggygaattggttaatyggtattttgtatttgagtttttttttygygygtttttttyggtttattggtttttyggttaggttaygtttttttttttttttttaatattygttygygttgtggttttttgtatygygyggggagygygtyggggtgygagyggtgygygtttygagtggtygggaygygygttagttttgggagtttgtattgttygggggggttaygtggagatttgygtggtgttttttatygtygtygtttgtttttyggtttttgggygttgtggtttygygttagggtgttggygggaggggtgtygattyggttttgygygttyggtgggtttttygggttagygtttygyggygttygggttttatgttgtaattgygttyggyggygttyggygttygtatyggygygygtttygttygtgtygtgtataygttttgtatygttttattttgtataygtataygtataygagtttttggggttttggagtatygtgttygtttygygtttttyggttygtttttgygtttagtygttttttagggagygtttagttgygagtaaaataagtttygttgygaaatagtttttyggggagatagtttttttttyggagtatagatattatatttttatygygtaagttttyggttygggtygaattygggygtttyggygtttaygtattttaygattttttttyggtgtttygtaygtygtygtgattttttattttayggtttttyga

SEQ ID NO: 11275 - DNA, 816 bp, synthetic construct
  misc_feature 1..816: note = Description of Artificial Sequence: Synthetic polynucleotide
  source 1..816: mol_type = other DNA
ygtagtaaagagtttygggygttttgggggagagyggttttaagtttyggaaagtgggtagagtttttttttttagggttgagayggtaggygyggggtttttttyggattygtttygttaaggggatagtgtaggtygtgtygygatttagattygaygttttygygggtttygyggygttygggttgttttygtyggttgggagygttygagtggttttygggaatttatygtgaagtaggagggtygggaataggtatttgagtaggaggyggygyggttaggatatttttagttttgttttggggtttttygtaygtygygtttygatttggtgttygggtaattgggygygygttttgtttttygttttyggtygggtgyggtygggttaggtyggggttttaggyggttgtygygygttttatgttyggygggttaggygyggggttgyggggygygygttttttgggygtygtygggyggttgtgggygtttyggttyggttygygtttyggtttttttgtygttygtttygattttttygygttyggtttygygtttygtttyggtygtygtgtgygtygttttgagttgtagtggtygttatygttatygtagttgtagygtttttttatatttttagygygtygtyggtygggtagtttggtygyggtayggaggaggggttttggagggggyggtygggggaggygaygtygagttatygttttygggtagtygtygtygggggggagygyggagatttgaaagggygygtygggtaaygttttttttttttttatttygggygt

SEQ ID NO: 11276 - DNA, 368 bp, synthetic construct
  misc_feature 1..368: note = Description of Artificial Sequence: Synthetic polynucleotide
  source 1..368: mol_type = other DNA
ygtgtygtttgygttygtgggttatatatattttttttttttttattgttttttgggyggtgtggattagttgtagagtgtgatttgyggttagggagtgttttttyggagttttygtttttagatttttggtgttaaagaygttttgtgagygggtggggtygggygttttagttayggyggtygtygtttttttttttygtaggaygggatagygtttttgtggatygygttttagatgggttatagygaggtggtgygggtgatgttgttgygyggagtygatygygaygttgygyggaaygtgagtgttygagtygygyggttaaagagygaagtttttyggygygtttgtgtggagaaaaygg

SEQ ID NO: 11277 - DNA, 1411 bp, synthetic construct
  misc_feature 1..1411: note = Description of Artificial Sequence: Synthetic polynucleotide
  source 1..1411: mol_type = other DNA
ygtttttygygtttttttygygygyggtttttggagtttttgaggygygyggttagtttagttygggttygtagtatygggagtagttygtyggttaagygagygygggtyggggtyggggtyggggtttgggggygtygttttygggagtttttttgyggtttttgaggagygagggygayggygaggttgatyggggtygaaattatgaatygaagtttttataagttttagattttgygattttaygattgtagygtagtggaagttaagagtaaggtaagtttttygttygtttyggyggttttgygtttagttttttggttaatgaatggggygtttygyggagggggattggggyggygtggaggygataggygtyggygataattttttagttygggygtygygygtygtttygygggaygygtattggggatttyggtygtttttttygtttttygygyggatataaagttyggtagtygyggygtttagagggtygagggttatyggatagttygggtagattttggattygtttygygggagttgtttttttgttttaygagtgagaggygatyggggygygttatatattggaggggagggyggttttttyggggygagttgagggttaggggttgttyggattyggggtygtgggggggttttgggggttygggtygtgggatggttttggttaaggygtttttaaggttgtaaaggaggtttgttatttgttaggaggagatttgtygtyggtttygagttyggygttttttattygttyggtattaaatatttaggtattaggygygttttttygygtagatttagagtaygtattyggttttttttyggtttagatttagattaygttttttygggygygttttygggttagatattttattttatttttaygggygygtttttattttagatttttttattttyggaygygttttygttttagatttagtttattttttygggygygttttyggtttagatttagatttttttygagygygttttyggattagattygtatttagattatttttaygggygtgttyggtttttttygttgtttgygttygggyggagygtgttygaatttgygggtygygatgygygtttgggtaattggttggtaggatttggygtttttgttttttgygggggtggttttttygtygtagatgttattgtttgtgagggtttttttggtggatttygygggttgaggaggtgttgtagttgttyggggttttgygggagggggtttttygagtttttygttggttattttttgggagttgagyggttttttygtttttttttttttygtatttyggtttttagagttgtgggaaaggtttttaayggyggagtgggagttygt

SEQ ID NO: 11278 - DNA, 1487 bp, synthetic construct
  misc_feature 1..1487: note = Description of Artificial Sequence: Synthetic polynucleotide
  source 1..1487: mol_type = other DNA
ygggttttgygattygyggyggaggygtatagtaggygtttaaaygatygtgggtttagggtttygygttagygttttyggggttttttggagagaggtagggtttygtygtttyggttttygtaggaattagttggagaaaggygggyggtttggggttgaattttttttattttttatttttttygtygtttggagtagataygtygtygtygygtttttgggaayggttagggaagtaagtagaagtygggaagtygygaaagaggygagaaagtgygattttttttttagattttyggtttttygtygaaatttttgtyggtyggttaaattttagataatggaagttttaygtttttatttttatttttttttataagttyggtygygggtttttttyggttygggatttyggygttagtttyggagtyggagtttgtaygataygttttttttygtygttttatttttttattyggagatygtttatttttttygttttatttttttatttttygtttggtyggtttygttygattyggaggyggygtttttttttttgttttaggtttaggaaggaggayggyggaggaagtagggggttttggttgygggygtagggatgtgggtyggygatyggygttygagggygtaaaaaggyggttygaggattgygygygggygggtagygygggaagtygggaagaaaggagggygygygggggaggaggttgygggtgyggggttygaggtyggggygtttattttttygygtygttygygttygtygtttagttttygttgtaggttttgygygyggtttttygtttygttygtttgttgttgtagggtttggattttgygttttatygtttttagggagttgaggtyggttatggygyggaggygtagaggygtaygggtagyggyggaygttyggttgggttyggtttyggygagagttgtatagtygygtttyggttttttaagtttttgtttgygygggggtygttttygttttttttygtttttygggtyggttgtygtyggggygatgaggttattyggtyggatygtygaygttagtatygttgggggagggtttgaygtyggtatygttggttatagttgttggaaagtgttttttttygggatttatttggagaaagygttgggaggygtygttttttttttttttttttttttttttttttgyggtttttttygttttttyggtttyggggtttyggtttggtttygtygygggttttygtatttttgtataygtaygtyggaggttttttttttygtgagttttagttttttttgygygttttttaggttttyggaatatttatttagttygttttttgttttttttagttttttttggaggtgygttagttttttttttatttggggaygatagagygaggaaygggttagtttggggggggggttaygttttygaggtgtaggggygg

SEQ ID NO: 11279 - DNA, 602 bp, synthetic construct
  misc_feature 1..602: note = Description of Artificial Sequence: Synthetic polynucleotide
  source 1..602: mol_type = other DNA
ygygtatygttgttgtattttttttaaygtattygtaattttttttaaygtattygtattttttttaaygtatttatattttttttaaggtattygtattttttttaagttattygtattatttttttttttattttatgygaagattgtagtttygtagttttgygattagyggtyggaagtagttaagatgttattgtttttagtatgtttygygaggygygtatagtataggtttttttttaaggttattatttttattttygttgtatgttgggattgtagttyggtygttttgtgattaayggttggaatygtttaagatattattttagttagtatggtyggtaggagygtatygygttgtttttttttagggattygtatygttttataattttgttttgtgttgagattgtagttttgtaggygtataattaataagttgggtgtagataagagattatagtttttygtattttaagtaaaggttttttttttayggagtttttttaygygtttattgyggtttygtygtgttaaggggagtttggttgtttaygggttttatttgttagygagaagatagtttggtygggygg

SEQ ID NO: 11280 - DNA, 628 bp, synthetic construct
  misc_feature 1..628: note = Description of Artificial Sequence: Synthetic polynucleotide
  source 1..628: mol_type = other DNA
ygttttatygagaatagaaagtgygttttaggtattattyggatttygttaaattatattatttagaaggtagtgttataagggayggaagtygattttaagttatagayggaaggygtagaggggygttttygtagyggygtgggygggattttyggygtttagttttygttygtygttaggttgyggttgttgtggttgttaaygttatattgggtagaaygttagataggggttatttttygagatygagtagagayggatagtgaggaggataggatttatttataygtttttatgttagtygygattttatttttataagygtttgtaaaattttttttggggttttggygatagttttgtgtttttayggygygtagaggyggygtygygaattttgtgtgtattttataygayggyggggattgaggtttttygtagtttagagtyggagttyggggtyggtygagttygtaggatyggttttttygtygatttttayggttttatttagttttttgggtttatggyggygtyggygttggtgagtggagggtttygtagttygygygagttygggttatygttygtatgtatttattygttgtaatayggyggatgtygg

SEQ ID NO: 11281 - DNA, 215 bp, synthetic construct
  misc_feature 1..215: note = Description of Artificial Sequence: Synthetic polynucleotide
  source 1..215: mol_type = other DNA
yggttgygtattgatygtatttgttatgttttattttttttaatygaagttgaaggtyggtttygatgtttgttattttttataattttatygtagtygatagttttataaatattatygttygtttagttttygttttttygggtyggttgttatttygygttttyggtttggttttggtttygtyggttgtattgtayggttygttttttygt

SEQ ID NO: 11282 - DNA, 2638 bp, synthetic construct; identical to SEQ ID NO: 6771
  misc_feature 1..2638: note = Description of Artificial Sequence: Synthetic polynucleotide
  source 1..2638: mol_type = other DNA

SEQ ID NO: 11283 - DNA, 2172 bp, synthetic construct
  misc_feature 1..2172: note = Description of Artificial Sequence: Synthetic polynucleotide
  source 1..2172: mol_type = other DNA
ygygtaggttgtgtaygtgtttgtgtgtaygtgtttttyggtgtgtgttttagttttagtgtgttggygygtgttygagtatagatatatygggggtgtttgggtattygtatatggttgygggtggggygtagtggagaggaagtttatatatgygtgtgttgagatatggtygtatttttgtgtttttttagtttagaygtaggggagattagtatygagatattygagttygggagttttttagyggyggtygggyggagtttggttttaygtggggttggagagtaygtaagtttggagtttyggygttygtttttyggttgtygtyggtttttgtagaatygagtggtyggatggtagttygyggggaggttyggttattygttyggttygttyggggyggggagaagaaggagagttggagagagaatyggtygyggyggtyggagaggygagyggagtgtaagagaggygagygtttttgttyggygttygggygygtttttygtttttttygttyggttygtttgttygttggttttttttttttttttttttttttttttttttggttttgtttttttttttgattttyggttggatgattgaggtattttagaygtgggttgaattagagygagygagygagtttaggggttgtagygatttttygataagttatttagaggygattttgtgygygygygttttttagtggttttygttygttttttgattatgttgatatatttataggataggtagtagtatygatgyggygttgygaygttatagttttygatattttttttttataatttagttttattttttagtattygatttgtgaaaattaygtttatgtagtaatataattggttygaaagygttaaagagttaattaagaggttttyggtttttygtagtttatagygtagttygattttttagagtygtygagtagaygttyggtgaattttagaggyggyggagggtggygaggagttttygttttttttygtttttttttttttygatttygttttttttttttttttttttttttttttttttttttttttttttgttttattttttttttttttaaattttttttgttttgygygtttggatatagatttaggaagygaattygtttaygttttaggataaggaagagagagaggtaygggagaagagtttagtaagatttggattgaaatygagatatttttyggaggttyggagtagaggaaggaggaggagggyggygaayggaagttagtttgtaatttaagttttgatagygttggtagaagggggtttaaattagatttttttttttttaaaggagagagatttttttygttttttygttttttgttaaagtygggtttagtatagttgtagaygttattagtgagaaagagggagaggaagatagatagggggygggggaagaagaaaaagaaaggtaaaaagttttttaggagaattttttatatttgtaataaaagatttaggggttggagagagatttttgggaygtagggttggagtgtttatttygagtttagyggtagggttygggygygagtygagattttgttygtttttttygtttttgaaatygaygtttaggagyggttttttaaaaaygtaaggtataaggayggttattygygygattatgtttgttgatttttygttttgttttttttaaaagyggttttttattttttaaaagatatttttttttttttttttgaagtgtattagttgtgatttttgtttttttttttttttttttttttttttgttttgttttttttttttttttgaattatgtgttgttgttaaataataataaaaaaataataaaatatagtagttgyggatttgttttyggttggagtttagygtttygtttggagtggatgagtttttttatgagagattyggttatttttgggataagtatggtttattattygtttttattttatygggygtyggatttygttatgagygyggtgttgggttattagtygtygttttttttygygttgaygttgttttttaayggygyggyggygttttygttgtygggygttttggttaagtygattatggattaattggtgggggyggtygagatyggtatttygt

SEQ ID NO: 11284 - DNA, 2548 bp, synthetic construct
  misc_feature 1..2548: note = Description of Artificial Sequence: Synthetic polynucleotide
  source 1..2548: mol_type = other DNA
yggagttgtagtagaagygttttygatttygtttaggtttttagtttatttttttttgaaggtyggtagggggygttattatygttggttttttygygyggtttyggttttygtttygggaatygagtgtttgtagttygygattttggggaggtatagggttagggtatygtttyggyggagaaagtggttgtgtygygygggtggggtygggttagggttgggttgggttggagggygyggggtatttgagtgaagtygtagttttygggyggggtgtagaggagattttttgagygttggagyggggagagttagggygggggttaggygtygtagtttyggaygaggttygagtagtttttgygygtttygtagtaggtttagtagygtgtgygttagygagygtagttttgyggatyggataggagtyggagyggyggttagaggttggttaggtttttttttttttgtttttygttygggttygggtgaatagaattgatygtatygtygtyggygttgtaggtattgttggtgygttaggygygtataggygttttgggatttygggtataggygggtatagaaggygtagagtygggyggygtttgtttgtagtttttggggggggttttaggttagaagttttttgtagttgggttygyggttggaggaggttgttgygggygggataggggttagtttattttttgtttggggttttagtttttttatttttttttyggaaggagataggttttttygaggtagaagggagttgggaatgggtatgggtygggtggaaaygggtttgttttayggttgttygttggggtattggggayggggtattggaaagagggygtttatygtttatttgtttttggagttagtttttgaatattgttaygygggtgtagatttygggtttttttggtttttygtagtygtttttttaggaggtgatttygaataggatttttttagggygggggttaggtttagaataggttagggggtttttygagttattttgyggggttaagagagaggaygttgtatttatttgttttttatgaygtttgttttaygtttggtaggtgtgagtttgttatttgtgtttattttagggatgaggatagagaggtttagagaagtygagtgatagatagaygtggaaggaaaagaggtygtagtggttttgggaaggtttagtyggtttttttttattagattgggtttatatttggtaygagttaaygtttttygttaggtattyggygtagagtatggtgttggggygtagttygggttttagggtttttyggtaggtgtyggtgttgagtaggggaataygggttttttttattgttttagttttaggttygtttgtagggaaggggtggaaggtttaggtttggagggtaagagtttygttttgagggttttttttttattattttttttgatttttttttttttgaaagagtaggtagtatttttttaaggtaattyggtttttttatattttattatttyggatttttagttttttttattaygygtyggtttatttaygtttagtattttygaagagggygttttagttygygatggygtaggyggtttyggtagggggtttttggggtttttggggtaggtatayggggygygtygattttttygggtttatyggygtttatagttgtattagggttaggtygttgtggaaggttygygggttaaattgaggagggggaggyggygtagggttaaggaagtaygggtgggggtgyggtgtttagttttgggggtttggggattgtttttttattttggggtggggtaggatgyggtttattggtatttttttygtttgtttttttygggatttttttgttagygttatagtttatagaagtttattyggggygttgygggtygagyggtagttgagaygtaggaaggataggggtatatttygtaggtttttyggagattttgttttttygttygtatgtygggttttttttatttgggggtayggagggygggtyggggaggggtttygttttagagggggygaattygttyggtygtgttatttttttygggttggtattttggyggggygggygyggygttttgagatggggaagttyggggtyggtygtygttagggggtagtagagattatttttttygygygtygttygtyggataattyggtaggtgyggggtttagygtyggggattttagttgggtaaggtttgggggttttatttattttataaagtagtgygttgtygtgagtatttaggaggtygttattaggaygtygtygtatagaggttgttygtygagttgtagttttattagttagggttaggtttygggyggygtygygttgttttttaygatgyggtygtgggttygygttatattggtagtgttyggaygtttttygtygtayggttttagaaaggggtaaggggtgttaygagggatatgttttggttattttygttttygaggtttattygg

SEQ ID NO: 11285 - DNA, 919 bp, synthetic construct
  misc_feature 1..919: note = Description of Artificial Sequence: Synthetic polynucleotide
  source 1..919: mol_type = other DNA
yggtggggtgtgaaygggyggaagtttygtttagtgtttgtttaattatttttagtttgtggaggtygagygaatgygggtgtggggttygggtyggggtatatttaygygttgygttggtatygggattggatgtagatgagtaggygtaggtggtttygggggygyggyggtttttttttyggyggtttttygagygttgygggggagggtgggaygtggttaagygggygggyggyggggtgggygatagagygggygatttttttaygtttygggttttatttaygtgtagygtggyggygagagygtagaagttagttaygggygttttgtattggtygttggttaagtttaggttygggtygyggyggaaggtattttyggygtygggttgygaggggtayggatggttatttyggttttygttyggtyggatttattygttttttygygygtyggtatttattaggtagtagaygttaagttygtgtagygygygtygttttattaaygygtttyggygtaggyggtagaggaaagyggtttttaygygyggygttygyggtttyggggttaggggygyggttagtagtgttagtaygttttttattaygtygtygtygtttttttyggyggtggtygagatyggggygaggttygtagygatyggttyggyggggttataygtatagggttygggtttygygygttttygttgtygtatygtatttggtatagagygagyggtggtygygygttagggattttttattygttygtygygtgggtttagttttgaaygataggtgttagygagattaggggtttgtygggygtaggggtggggygagggygaygttttttyggtttgaagggtttyggagtttttgygttttgattttgtagyggttttygt

SEQ ID NO: 11286 - DNA, 2488 bp, synthetic construct
  misc_feature 1..2488: note = Description of Artificial Sequence: Synthetic polynucleotide
  source 1..2488: mol_type = other DNA
ygggtygagttygaggttgttyggaggtttagggtttttatttygygatgttagttttgtttttttttgygtttygggtaagggtttgttygtttgggggatygtatttggaattygygtggttttttttttyggyggtgtygtttttayggatagtgygtgttygggtttgggttggagygaygttttygagattattttattattttataattgtggttygygygtygttaggattyggttyggtgtgggttggyggagtataatgatyggyggyggggygggggygggtaygygggyggygggygttgggggtygygtagatgtttgggtygaataggtgagygtttttyggatattygggtgttygtggggggyggggaggagggyggagggggtgtaaattaagtggtgggaaagagataaaggaagagtgaagagygagayggtgyggatggggaagggggaggggygyggaggggtagtyggtgggtagygygtygaggagttygagtttgaatttgattaagtattgggggttttgtygtgggggtggggygggggtayggtygagagtyggttaygtgtttggtttttttagttyggggtttygtttyggtygttygggggagtygaatttygaggttyggtagtttygttttataagtattygygtttttggggattygaaagaygtatgggggtygaaggttgttygaaggggtttygggygtygagagtttttgagggtgtttgagttattttatttgggttaagttttttttttttggtttgatygtagatagttygtygggtgttttttttttttagtttttatyggatttagagatygtagttttygggagygatgggtaggtatagattttagygtttttttttygggtttagtttygtgtaaggatttttttygaagygttttttttttaagagygygttttttatygaagygtayggyggygygtttagygygtttttatttttttttatttggtttagttttttttttttttttttttttttttttygygttttttttttttttttttttttttttttttttttgggtgtttttttttttttttttttttttttttygtgtttattttttttttttattygttttttygttatttttttttgttgttttttttattttttttgtttgygttttttttgygtttttttttttttygttttygtttygtgttyggtttygttttttttttygttttttygtgttyggtgtttttttttttttttttygggtygyggygtygtygtygttgtygtygttgttygtttgggttttttttttggttattttygttttygggtygggtagtgaygygtygyggtggtgttagttttttttttygggtagtygyggyggtagtagtagtagtagtagttggagttgtggggttgttatygtygttygtttygtttattygyggatttygatygtttattttygtttygtttttagtttaggtayggagttyggttyggatttyggygatygggtygttttyggggttygggtygtygtttttttttttyggttgttgtygtyggtygttgagttgyggttaggggggygaggggttgggggyggttttggggaggggggygtagggggagttttttttgtyggggttgagggagggggygygggggagyggttgygttttgggtygagtgggttggggyggggggygggtgagtgtgttygagagtggagggggggygatgaaggttgtattgtgggggtygyggggygtttaagaggtgtgtttggttttgagygtttagggtygyggggygtattttattttyggggtgygygtygygggttttggggggyggtgattgtgygygtagygtygyggtattgtgttayggtygttyggtgtgtagygggttyggtatygygtttyggygagggaggygttttttggyggyggggygggggtygggttygggttgtygyggtygttaygagaagggaagtggattgtgtttggggatgtgaggaygggaagygttgagtgttagggaggggtttttyggygyggygyggggagttgagaygyggtttgtagagttgagtttattttagtaggttygggtttttttygggaggggayggggtgttttttttaggtgtatygtttgatyggaagtygygggygttggyggtttttggygaaggggttttttttaatgaggggatayggyggggygggggtagtyggtygtttygagggygygygtaggggttaagttggatttatattttygtttttttttttttttttttattttgtttttaaggttggatattttggatagggaggaggggggagtgtaattygtatttttattttagtygttygggagtagaagtgattttgtttttattyggagttgygtttgttygagttyggtygtttttatygggttgygt

SEQ ID NO: 11287 - DNA, 513 bp, synthetic construct
  misc_feature 1..513: note = Description of Artificial Sequence: Synthetic polynucleotide
  source 1..513: mol_type = other DNA
yggtygggtttgttayggggttttgtgtagttttttttattttttyggttgttagygtttygtttygtttttttttagtttttaagggaggaggggagagttgtagagaggaggaggggtyggggaggtyggttttataaaggyggttggaataattttgttygttagatttygtygttyggattttttgagttgttygttattttaygtgatygygtygttttttagttttatygttgagtgagttggggygygtttttatttygtttttagtttttygtygagtygygtggtgtattgaagtyggygtggggaggagagtygatgaaggagaaygttaatatgggggttttaggtagaatttttaatgggagagatttaggatttgagggagtygggagattygggagtttayggtttggtyggttattttttttttttttygggygygaggtttatgagatygtaagttattttttaagaatgygygtgtagtygttgtygtggtaaygt

SEQ ID NO: 11288 - DNA, 1766 bp, synthetic construct
  misc_feature 1..1766: note = Description of Artificial Sequence: Synthetic polynucleotide
  source 1..1766: mol_type = other DNA
ygttttttgtttattygygttaggtyggttttttttyggttttttttgtggygygagggatagyggaaattayggtagatagtatttttttgagtttaattttttttttttyggaggaagtyggttttttttttttatgttattttygggttatttttggataatagttgttatttttatttgagtygaagttaatttttyggggagttttygggygygtataggtagttyggtttgttttgygattgagttgygggtygyggtyggygtyggtttttttaatggtaaatgtgtgtggttggaggygagygygaggttttyggtaaaggtagtygagtgtttgtagatyggggygagttttgtgaaagtagataaaagaaaatatttattaaygtgttattaygaggggagygttyggtyggggttgtygtatttttygyggaatatttggttttttttagtttygagagaggagaagaagaaagyggaaaagaggtagatttaygtygtttttagttaagtggatttgatygatggtttttttgaatttattaygatatttgatttattagygatgttttttggtttgtgtgttaygtatatataygtgtatataaggttttggttygtttttttttttygtttttagtttttgggygaattttatatttgttttaatttttygtygagggygagtaggagygagagtgtgtygagtgagtgtgygtttgtgtgtttyggygagggtgygygttyggygtygggagygyggttagtygagttyggaggtatygggaggtygagagtygtygggattttagttttgygtttattgtttygttyggagttggatttyggggtyggggtyggggtygtgygtyggggataggtagggtygggtygygggtygygygttttttaggtyggaggtaaaagygttagygygyggagggttygaggagggtatygyggttgggtttttygygtttygggttttagtygttygyggttttyggttygaygtttttygtttyggagygygttygttttttttgygtggaggtyggygggtaggygagyggggggyggtagygtygtgttaaggggttggttggggtagygtggtyggtygggttggggygatttaagagyggttygggyggggtgyggagtyggattttggttggggyggygygyggggagggggtygggggyggtggyggyggygttggggggyggggaggaggtaggaggaggagtagtagygttygtygggggatgtagtagyggtagyggyggyggyggyggyggtagyggtagyggyggygyggagttttttgygtttagyggttyggtygggttgyggtagaggyggyggyggygtttygtttygggtgaggttgtyggggtygtgygygttggtgagtggggygtggggggtaggtgggtggttgggggaygyggggttygggygggggttygyggyggtyggagtttttttyggygtgagttyggtygygagygtygtttaggtgagtyggggttggttyggatygttyggttttagttttagygttgtttgyggaggtgggttygggygggygggagggaggtttyggygtyggtygttygtagagggatgatttgtttgatttygttggttggygggygggygaggatttttygtygygtttttgattygyggatayggtatatygagtataggyggtttygggtaggggagygygtttgggtyggttattygt

SEQ ID NO: 11289 - DNA, 6511 bp, synthetic construct
  misc_feature 1..6511: note = Description of Artificial Sequence: Synthetic polynucleotide
  source 1..6511: mol_type = other DNA
ygtagggtgaataggttyggttaggagtygtagygtygtttatttgtatttygtttatttggtgaggtatgtygtggagttttaggttttyggttaggttygyggtatttagggygtgtgygtggggtagtagtaggtyggagyggyggtaggtatttttgygggygtttatygygttygtttttagttyggagaggtggggtagtaggtyggtygggygttygtggtgygagggtagtttygtttttttttggttttggyggtygggttaggtttgttgttggttgtttgtgggygtyggttggtgtagggggttgatggyggyggygtaygttttttttagatgygagtaggggtyggtygattgggagtaggttagttgttggtagggagggggaaagtagggtggyggttgatattyggygattttagtgtgggagaggggtggygyggggttgtagaggtgttgttyggyggaggagaggtgggggattygyggatttttattgttgttttygtygtggygattttggagggaaaaaaaaaaataggagatttygttagtgygaaatttygttattgygaattggtyggtatygtygggttaygtagagggtttygggggattaatygtatttygttyggyggggtttgtttagggtyggaaggtattygggggtaatgygtttygaggatttygttgtaagtaaagagtgyggggagggaggagagtttggtgaaagatttgggggaaygagtttttaaagttyggyggygaaggtttaggygttgtttttaagttygaggygtttggaggygttaagttygaattttgggttttgggttagaaaagttygtggtyggagttyggggygaaggagttagagttyggggygaaggagtyggaygttyggtgtagagttatttygtggagttygtttatgaygtagggattgttggaggtggtagygyggtaggygyggatagagtgygyggygygggaaatgygtatttttttygttttygggatttttttttttaygttttygggataaagattttygagygggyggygttyggaaagtagggttygttattttgygtygttttgggaagtgaagagggagygygygtatagggyggttttttttgttggtygggtttagtygaggggagtaataagtgggggygttttgtattgttaagggtagtgttttygtaygtyggggygtagagggggtatgaagaattttggaaattgggtagttttgttygygtaygttttttygtttttgggyggttygatttagtttttaaaggatgygtttttatttgtttaggggtttyggggygtygggaatttggaggaatatggygttgtygttttttggyggaagygttygggtttgygggtaggggtagttttttagggttyggaggygtagtgaattttygygagttygtagttygagtttygygttttyggygtttttgagttygtttagygttgtttgygtttttttttttttttygttygtygtttttttttttttttttatttttygaaattttagtttaatttgttygataggttggagtattygygagtttttayggttttatttggtttygggtatttttattattattttttagtttttattttttttgaaagttaaatttyggttgttttygtgttttttygaggaggtagyggggtaggtgataagtyggttttggaggagtgttygttaaggtgtygttagtaggtagttttatttgatttttttggatagagatttygtgygtaaaagttaygtttgagggttgtagayggggtattttttygagaaaaygggaagtagggttgtttgtygtttaggaaagygttyggtaagttgtgtgggtgggatttgttattttttttttaggtttygttttygaggggaggttatttaggaaaaggttttatataggaaaggggtttygtagaaatggattaaggggtgttyggagaagtggatttygttttatygagaggttagggtttttatgttttygttttygatttyggtttagtggtttttgtttttyggattgttttyggyggggyggggttgtatttyggagttttagtttatttygtagtttttttygtatttgatattatyggttattttttataatatggygttyggygttttttaaaatagtygttagttaaatttaggatttttttagtttttaagyggtaaatttaaaatyggggttayggtgattaggygtttgtygtygttttygtygygygygggttttgttgttygggttattggataygtatyggyggttttgygagygtagatgttgtygtygygagtgttaagatygtttygyggayggggaaagtygygttygaatagtgtgttttggygatagtygggggattygagygttttaatgagaaggaaattattataattttttttygggggtyggygyggaggtttaggygtygggyggggyggtttttagttagttttagtttagtttygtttygtattygggtttggygtagygtygagttttaygttgtgagggaygaagygyggagttagtgggyggtgtttygttgatagtygaagatttgygaggtttgggtttttygaygygttttttttttgttatttttatygtaaatatatttgagattggtagagttgggggaagggatttaaatattgaaatttatttttttttygtttaaayggtttttattygtttttttaaaagayggatgttatttggagttaagaaattgygtatttggggagygatttaataatyggggtttttttattttttaaaaatatattttattttatttatattttattgaggtttaaggtttgagttgggattatgtagttggagttttagtgygttagagaygtttagtttttttygtgggtatagygyggtttyggttttygggygggaggagagaggaagggatttttggggagtttgttttaagggtygtagaggtagtagayggttttattygtttaggagttgyggatagyggygtttygtygttgtygttygaagtggtatttttygyggttggttgaggttagggggaattygygygtattggattagtttagyggttyggttttgttttgttttgyggaaygtyggttttgtagttgtttttggygggtyggttatttagaagtttttattygttttgggaaagaagygtygggtaggaataaaattygagygttaygggtaaggtgagggtgaggaggtgtaggaagttgggagagagtttgtagagagttttygattggagaggtagatatttaggttttatatgtttagatagaaaaygaaatttttttttatataaaygttgtttttttttttttttyggtatttgttatttaaatttgaaagtaaagtgtaatattaatttttaaaatttaaattaaygaaattttttggtttagttattatgtagtaattgatttttattgtaaggggaatatygttaattttygagggygtatttgttgggaygttttaattggttttttgggttggatttaaatattttgtggggattagaggataagattatttttatttgatattgaataygattttgtaataattaatgtttattagtayggtgttygtatttgtagtagatatgatttttttatttayggaatggyggtatttattgtttygttgttttttttygggttygtttgaattttagtatttatttagatttaggtgggtttaaaagaaaataataataataggygttttttaagggaaattttttttyggttttagatagtagttaaattttaggtgatttttygatyggaygygggaataaaatttggaagttgaaattattgagatttttyggttaagtatatttgtagggttttgtattaaggagaatagtgtataaaaagatatataggattttgatatttyggttttaaaataggtttttgggggtaaaataagttatygtagaagtagygtttttggtattagyggygggggagggggatatttgttagaagtagaaattagatttaggttygtaggtattttagagtataggtttaggaagatgggttttagattygttagaggtgyggygtttttttygggygtttgggattttttgaygggtgtygttgggttgttygatattttgggttttttagttttyggttttattttttgattyggtttgaggtgtagtttgaataagttgttttgtttgtgttggtaagtttattttttgtaygttggggttyggaatgggtaagaaggtgtttattttttattttaggttttggttttttttttttatagtaatattagttaaagttgttyggaggaatygatatgttttttygtttgggagygtttaygtaggaggygaagggagtygatgggtattgagggttygygtagtatygtgtygtgggtttaaaggatttagaggattyggaatygtttggtaaaggttatttatttttaaggagtttttttggatttyggygttgttttttttttaatgggtaagygttygaattggagygtaattttygygttttttgtayggaaggtagttagaataaattttttgttttttyggtaygggagatttttttttaataygtatattttyggtttttgggtyggtatttaggtaygygygygtttttgtgaggaagttttaatttttttttgattttaatttttttgtttagtagagtygggaatygaaggttttagtatttaagatagtttttttttaaygttttygttttttgtttaygtgaagaygyggattgygtggtygygtttaagatagtyggtatyggtagaaggggatttttttggaatttyggaggtttygtagtygtttggagaagaggatggaaggttgtygggggtttttttttatygttttttagggagtttaaatttatttattttttggaagttttggatttaygtttttatgaaatygtaaattaggtttttgtaatagygggagygttttaatagygygttatttttaaagaggygygaggtggtgtttttggaaatagggttttyggttttaggtttgagttattygttatttttgtttttattttagayggaagaaggyggttaggygggtagagtaagattygggtagatttgygattttttttttygttttagggaggggattttygagtagaagatggaggttttygagygttttygtagatttygygttaygygtyggaygtttgtttygtttttygggataaygtgagygtyggtagggattttagtaagtggtagattygttaggattaagtaaggtggaaaggtyggggtttgyggtaaatttaggaggagggggtatttaygttygttatttttttttygyggtattggtatttattggatygatattggygttaaagggtattttgaagtatttatgtttagtaagggtatgttttggggtattatagatattaagttatagttattttaaaataattataaaaatgattatygtaaataatagattgttttaatagggygygaagyggtygtygtatatagaygtttttggttttagttttattagatttagtttattgttygtttttttgygtttygygttaggtygtatgtttttygtttagaattttttgagttttaatttttttttttaaataatttttttttttaaataggtaaagtgaggygaggagttgaggggtttataggtttttaagttttygaggagggttygggtttaygttagtttyggttygttaaaygagatttygtgggtatagtttttaatttgataattatttgttttattttatagtaggtaaaagtgaatttttagtygtttaattatttgaaagttataaaggtgtttagggttgaaggttatttttttagyggttttattagggagttygttagagatatgtttgattttttttttgttttgtttygggggggattttygttygtyggaggttttataygtttggtygtgggatggtagatttttgttatttttttattaatatttyggagtttattygtaygtattttaatygttyggagygtaggttygaggattaaggyggtagtttygtgttttttgaggtttttttygtttygtgttttgggtygttatatatttttyggttaagttyggygtttttaatttagaatttggtygtttttaggygtggagtaggttattgttgttagaygttgygyggattygtttttttgygttagtattgggygataggtagttygggtagtatttaggagttattttgtayggttttaggygttygttttatttagygttatttttygtttttygtagygagttttttygtagttttttttttttgttagttttyggggtygt

SEQ ID NO: 11290 - DNA, 6511 bp, synthetic construct; identical to SEQ ID NO: 11289
  misc_feature 1..6511: note = Description of Artificial Sequence: Synthetic polynucleotide
  source 1..6511: mol_type = other DNA

SEQ ID NO: 11291 - DNA, 338 bp, synthetic construct
  misc_feature 1..338: note = Description of Artificial Sequence: Synthetic polynucleotide
  source 1..338: mol_type = other DNA
yggaaatttttaattygygatttyggygggtgtatygtygagtttttygggaagtgtagttttagygygagygggaygttgggaaatgtagttttgygygtttaygttttygatygggtygtgttygtygyggttttgygaggttygaggggtaagggagygtgtagygggggygggattaygaggyggyggggttgggggyggtttttgtgtttgygtyggggatygyggtgatttygttgyggatyggttygyggtgattttagygygaaygagttggttgtyggttggggygagaaaggtttgyggatyggtttgggygtatgygyggaaggygg

SEQ ID NO: 11292 - DNA, 936 bp, synthetic construct
  misc_feature 1..936: note = Description of Artificial Sequence: Synthetic polynucleotide
  source 1..936: mol_type = other DNA
ygtaggygyggggtgttttgagttttttaatttttagagggaaggagtttatygtgggggatyggttaaagttttattttttgttyggtttagggtaaatyggtttttyggtagtttagttygtttagtttttttygagaggatataggggattyggagttygtaggggttagtattatttttygtttygggtttygttttttatttttygtygtttygagaygtttygatttttagttyggaggtgagggtttttttttatgtaygggygtttgatgggggtaggggtggggaygtaygagagttttaggtttyggttyggatygttyggggttttaaygtttttttttygggtttaggaatagygttttygtaggaagtatttgtttyggagggggttttygggatgtatttygtygtgttygygttygatgttygtttttttagggtttygygatttttggggatttttygtttttyggtttagggggtatttatttygtaygtggagttygggtagygtttttagaygtatttagygggatatyggagaggaygtygaygtagtgtaaygtttyggtygaagygtygaataatatgygygygtygyggaggaggtgyggggygtgttygtttaggtagygggtygtttygaygtggtagaagtttaggaagtygtagttygygaaggataagttttagtygygttttgygtygtatatggyggyggyggyggggygggggygygggttaggatttgggtygggatygggaatyggttygggttttgattygtagtagtttygttyggygttygtaagygttttttattttgttttagtgtttyggttagggtatttttagygygaygttagtttygtttttttyggattatgtaaatgagtyggygggaggtttaatgagygggtaggaygt

SEQ ID NO: 11293 - DNA, 2184 bp, synthetic construct
  misc_feature 1..2184: note = Description of Artificial Sequence: Synthetic polynucleotide
  source 1..2184: mol_type = other DNA
ygttaygayggggattttattaygttgttttttatttaygttattygtttaatttaygyggagggttttgagggttttattaygtagttttgaaggggtagagttggggttatataggtatyggaagtttaygttgtggttttaggagaaggttttggatgtggtttttatgagtgaagggtggatttatagygttgtyggaataaagggaaattataggtaggagggaagygygtttaggattygyggttatyggttttttagattgttttttggggttaggtygygaggagatggaaagygggggtattataggttygtttgaattygygygtttattyggttatatygattttaaatttttgtatgygggtaggatttttggtttttttgygtttattttagttttgttggtygtyggggtatttgagggatggttgyggggggtyggagggtggaaggggygtygggtagtttyggtggggaggggaagaggtttttygtgtattatggattttygtattygggaagggaggygttyggggttggggagggaggaaaaggyggttgtgttyggggagggggtagygagatttygttygggttaygggttgtaggatggagyggaygggaggaaggagttttgaygtygyggattttaygtttgtyggtygttttttttttttttgttttttttttttttttttttttygtagaggtagygyggggattyggtyggggtggggttagggyggtgygtttyggagtttttaatttggattttatttyggaggygtygygatygygttttygtygtttttaggaaggtgttyggatygygtyggygatyggaggattttgygtttygtygttttttattttgtttygtttygygtttgtyggygatttygyggggtyggttttygtttttatttgtagttyggggygyggygtttttgagggaagyggggttttgggatttttyggtttgggygtgggatattttayggttygtaygaattttggtggttygggtttttgtttttttagaatagygtttaggtttyggagaaatttttygaagtygtgggtttagaygttttygggggatttyggtgggaygggtagggygggygtygygggygaggggaygygtattgttttygggygaattagaaatattttatatygggtatttttttaggaatygtttatttatttttattgttttttattaggttttattttattattttttttttaggtatttttttygttgtatygtttttaygygggtatygtttttattygggtatttyggttttgttttgttttggggtggtygtagttygyggggaggaagygyggygaggygtttatatygggaaagtgttttygtgattttgygaggttatatttygggtgygtygttgygggttygtgggttygtgggttgtagtttttygtttttgtygggtggaygagtttygggttygygtggagttgttyggttaaggtyggttygggaggggygyggygtagggygggtaggggyggggttttaggttaaygtttagttttagatttagtttygtygtyggatttatygtgtttttgtttttttatttttgagaaatyggaaygtyggyggtattttttttttygggtyggagtttgygtttttyggattgygygtttttgtttaggyggyggtygggggtgggagygygtagygggttaatttttttaaagggaattgtygggagggygtttagaagggaaagattaggaagygttgggtgttgagttggagtttggtttttttttgggggatyggggagggggttgaaggtggggagaagatygtyggggttgttaggggggtattgagggagygtttagggggagaattttgggtgggygaygtygtaggggagttgtttggtaggggygagggtttyggggaagtggagtttttggtygagagttgtatttgtggtyggggagggaaagggttataagggtagtgygygtygggagggaagtttaggtyggggggaagggattgygyggyggggataggtgygtygggtgttggatagtgagtaggagttygtyggtgtttaggttaygaaggtgttggagtygggggagttggaaygtaagggggttaagggaaygygt

SEQ ID NO: 11294 - DNA, 413 bp, synthetic construct
  misc_feature 1..413: note = Description of Artificial Sequence: Synthetic polynucleotide
  source 1..413: mol_type = other DNA
yggtttgayggyggggtygagtaggggaagtggaaggatggagggagaaagggagagagttttagtygtttyggttgtggtaggaggagttttaagagygtttttygagttygtttygtatttttaggtttagttyggygtaggttttttttttygttttttttattttygttagttgttgaaatttttttatygttttttygygggtaatagtgttygttaggygtygtygygyggtgtttygttttttaygtygttygttyggaaagagttygtagtggttyggggygtygygttttgatygaygtttttggggtttgggagggyggygttgagagttgggagaggygttgagtttttyggtttttaygggaygtygggaaaggagagygagygtaatttttaygtttygg

SEQ ID NO: 11295 - DNA, 403 bp, synthetic construct
  misc_feature 1..403: note = Description of Artificial Sequence: Synthetic polynucleotide
  source 1..403: mol_type = other DNA
yggttygygtygtygtgttttttattyggttatatagygattttaaaagtttagtttttatttygyggagatttygatagttttgggaggttttttttaaaagggaatttggagaaatttgttgttgagtaygattgagttttattttataaaatatttattatttygtygttattttttaagtttaygtttttaaatatgygaattttaaggtttagttygggagtaagttaattttaggattyggtttatyggygygtgttttgaaaagaatgtyggaggttagatttttttttatygtttagaggtttyggtttagygtatatatttggggttygtagggttttygygygtyggaattygatttgygttggattttttttygggygtaggagttaagyga

SEQ ID NO: 11296 - DNA, 675 bp, synthetic construct
  misc_feature 1..675: note = Description of Artificial Sequence: Synthetic polynucleotide
  source 1..675: mol_type = other DNA
ygttttatygtattttagtggagtgtygygaagttgtaattyggttttaaggyggttygtatttttattygtatataaaggtaggtygtagtttygtaygyggggatagggttagtaaggggyggggattttyggggtygtygttttygtagtttygygtgtgggattttggggygggtygttattttgtggtgyggtygtygtttgttaggagatatttagtaatttygtagyggttattttttataagaaattttygttgtaatygttgygttatattatygygttttttagggataggaaagttttttygtgtttggtgaagttttaggggaagtagttattttgtygtygtatayggtaaaattttttattgtygtagtygttyggttgaygtgataagggaggtgtaggttaatayggygatttygygttttttggyggtagtgtyggagtagyggygttgtttttgatttattyggtattyggttttygggatygtttggyggttgtgaatgtagagttggggygaygtggggttygttttttgggattgggtgtgagtttgygtagtgagttatatgggggttatggtttggygtgggggygtggtygggtggggtygttggatttggtgttggaaagttagggaagtagtygtgygtttaagaaygg

SEQ ID NO: 11297 - DNA, 580 bp, synthetic construct
  misc_feature 1..580: note = Description of Artificial Sequence: Synthetic polynucleotide
  source 1..580: mol_type = other DNA
ygaagagttyggttaataaagtaaaygtttygttttyggttttttttttttttgtaggggaaaygaattgaaygtttgaaaygaaggtggygyggtttggataaatttgatttttygatatttttygtttttgygttygttttygttaagyggggaggagygatygttataatggattttttygtaggttttgtgygygttgggaatttagttgtygtygtttygtagagttttttgttttyggagggygtttattttygggtygtttattattygygtagtatyggtagtygttgtttyggtagtttttagtygtttygttygtttgtggttaattggttttagttatttttygaaatgttagtygattttattgggtattggaagatgttggttaaygagaatttygaggagtatttgygygttttyggtaagygttgttygttgygttttgggygtttygtygagtagtttygggtygttttttagagttttttygagaygttgtttgtttgtttttatttyggygagtygyggttyggtgttttyggaygttagaaagggygttttyggttatygt

SEQ ID NO: 11298 - DNA, 858 bp, synthetic construct
  misc_feature 1..858: note = Description of Artificial Sequence: Synthetic polynucleotide
  source 1..858: mol_type = other DNA
ygggaatatygttttttygttagattttyggyggtttttttttttttttttaaatttatttttaaagttaagtgtaggttttttygttttagttagaagygttgygtgagtttttataygtagtygtaggtagttttttaaatagygttygygttgagtaaatagtttagaygtggggtttaggagggygagttgaggygatygtatygggygygtagyggyggygggttagtyggyggttaatagttagggygyggttygtttygtygttttttttyggggagtttataaggttttygtagygtttygggygtttgttgtttygtgtttttatygaygattttatttagttgygttaygygtygtttyggttgtyggtygygygttttgttygtyggttttygttygtaatyggyggtttagggyggattygggtttttgygttttygygagaagygyggygttgyggggtygtgggygtttgagttygygyggttttygagggtygaatatggggggatgtayggtgaagttttagttgttgtttttggygttygttttttatttttggaatttttgtttgggtgyggattyggagaagttttygagtatttttataggtgagtatttygyggttygtygttgtttygygaggttyggtyggygggggggtagtttatttatttattagttttttygyggggttggttaggtgagtagtgggggtttgttttttttttttaggatygtyggggttttttttagaattgyggtygggyggygttggtttttggggaagtgtaggggtattygttttygttgattttttggagttttyggtgaatttagygtgttyga

SEQ ID NO: 11299 - DNA, 5715 bp, synthetic construct
  misc_feature 1..5715: note = Description of Artificial Sequence: Synthetic polynucleotide
  source 1..5715: mol_type = other DNA
ygttygtatygygtatataggtagtggaygttygtttatttgttygtttgttgggygtagggygtttttggggtggggagggygtttttgtggggggaaaaggggygtttttgtttyggagggggaaaggaygtttttgtggaaggaagggggggtttttgaagyggtgtggtgagaggaygttttygaggaaggaagggggtgtttttgtagyggtggggggagaggaygtttttgyggaaggaaggyggygtttttgygggggttggagagaygttygygyggtttttyggtttagggatygttggttygygggttygtttttttttyggygttatggaaatygtatttttttygtttgtygttttygattttttttttttattattttttaaaygygattttaatttttygataagttgataagtgaatggygtagaggaygtttygtaaagygttygygagygggtgggatataggygtttttttygygtttttttgttttttayggaagggygygygtygttttygatttggagygyggtgttygygaattygyggtygygggttttggaattttttygygtttygyggttgyggggggayggagatgyggtygggagayggggaygggaaaygggggayggggatggggygygtttatttygagygygggagyggtygttttygtttaaaatggggatttygygtttygagagtayggttyggttygtygtttatgtttttattgtaaggtygtagttttygtygtygatttygatttttygtttygtttagtygyggtttygttyggygtttttttttyggtggaagtttaagtttaattaattgagttygaggygggagggaagggttttgygygtygtggttygtttygtttttttttygygttttttttttygttttgggtggtatttttttygtyggtatttataataagtygttgattaatgaggtyggggtygttttatttygttyggtygggtyggggttttygygggagggggaggggayggygggaaaygyggttyggggagaaaggggggyggggygggggygygyggttygttttygygagygtygygtygattggtygagygygtygttygtyggggggygyggygttaatgygaggtagyggggyggggyggtygygttgtgtgtgtttgygtaaygtygagttatatgttgttttgttttttttagtttagttattyggtgygygatgtgttatttattgtgyggyggggatygygaygagttygggtygtygttggtagtagtagtagtaatattagtagtagtagtagtttyggyggyggygyggatttygagygttygggygtatttyggtttttyggagygygaygyggyggtagtagtttyggtgyggtygygygygttttaggttyggtttygyggttyggggatttygattttyggtttagygagygygtttttyggygtygttygagagttygaggaggtagyggtygtaggtagtyggggaggggggyggttatygttygygtygggtatttttaggagttttagagygyggagggygyggygtygtygagyggtgttggttttygygggttttttyggattttttttatygtttgggttygagggaygygtgatygggygggyggtygggygtaagggtgggagggagtygttttygttygygtttttttygtttttygttttaatttttgggygtygggttygggtygygyggtttgaagygttygygatggygagttygtygyggtaygggtygttygggtyggygagyggagayggttttaattttaataataataataataataataattatagygtgygtaagtgyggttatttgygtaagtagaagtatggttataagygttttttygtgttgygyggattyggygygggyggygaygaggygayggygggyggggggtyggygtygtaatygtygyggttygagtattaygagagygagaaaaagtggyggagtaaggtaggygygtygaaaygggtgatygttttygattgttgtttgaatattaataagygygtygaygttaagtataagtatttgatygttttttatattaaggaygagtatttygtygtggtygtygagaaygagtaggagtaggagggttggtatygygygtttatygatttggttagygagggtygygyggtygtyggagaygygtttttygtygtygygttygtygygttttgtagygtttttttgttyggygttttgggyggttttgtyggygtygtyggggtygaggatagttaygggttggtggttttygttayggtygtttatygtgaggtgtggtaggtgaatttgaagtttaagggtttgggttagagtaagaatttgaygggggtgtatygtttgtgtttgtttgygygtattatyggtttygtgaagtttaattgygagtagtygtyggtgaygttgtagtttatgaatattygtygttgyggttattyggatagttttttttttatygaggtgggtygttyggtygttataggtttyggygagttgtggatgtaggyggaygattyggtggtggygtagaatatttaygagattattttggaggttatgaaggygtttaaggagtttttygagtttyggtygygtagtaagagttaatygtyggggtygtyggttaygtattttattagygttttyggygygygtygttattattatttggttaatttgttttttagttagaygggtttggtgygtygttygygtatygatagtttggtygttatttygtyggyggttaagtgtagttygtgtygggtgygtatygttagygagggygayggyggygyggyggygggagyggyggtygygggygttaggtyggtgtyggtggttgggagttttttgagtttygggtyggtgygygygtttttgagtygttygtatattttgagyggyggttgyggyggtygygggagtaaggtggygttgttgtyggtagggggygygttgtaatatagtygttttatgtttatgttygtggygtattygtygttygtygttattagtttyggttttttgtygtttagtagyggttayggttygggtttttattygtygtygttyggttygtattygtttttgtygtattygttgtattayggtttyggttagyggttttttagyggtagygttttygtttygggtttttttagygatttyggttttatgtttttggaygagtayggttttagtttaggygatttgygygttttttgtagttatygaagtaataygttygagtttatygyggagaygttttyggttygagayggyggyggyggyggtgagttttaygggtatatgattatggataggtttttgagttattgtggtygtttttatygtygggtttygggggaygyggtttaggatttggatygagggttgygtaagaggatttattttttgattaygttagttyggtagyggtyggtgttttagtttttttttgtttygttggatgaatatattttgatgygggttattttttygggtagygygggtygtttttgttygttttgtttygygtttttttttaaggtggtttattatttttatttagaggattayggagatatygagatyggtttttataggagttttagtagtaatttgggggtagaygayggttatatgtttatgaygttyggygyggttttygygggtagtgggagyggtagttgtaggagygaygattatatgtttatgagtttygttagygtgttygtttttaagtagattttgtagtttagggtygtygtygtygtygtygtygtygtgttttttgyggggtttgyggggttagtatttatttttgyggygggtaggatattttyggygagygggggyggttataaggttagttygttygtygagagttttttygaggatagtgggtatatgygtatgtggtgyggttttaagttgtttatggagtatgtagatggtaagttgttgtttaayggggattattttaaygtgttttttagygaygyggttattaygggtatttygttygatttttttttygtagttttgtatttyggyggggagtygtttaggggygttttyggttgttgttatagttttttgtttygtttttataaggttttttatatttgtggyggggatagygattagtaygtgtttatgagttttttygtggggygtattttggaggaggagygtttggagttttaggttaygttagggtttagttaggyggttagygttttyggggtyggttttaygtagtttttttattttgtagtgttttygttygtgyggtttagyggyggtygttyggagggttttttgggttagygyggtygggyggtgaggtttaygygtttgtttttggaggggttgtttagtttgtttagtatgtaygagtatttattgttatyggagtttaagagtttyggygagtatattaatatygattttggygagttyggggttygtttgtygtygttygygttttttttgttggygtyggyggtttygtttttttygtttttgttygttagtagttyggtttygtygttgggtttaggtatttygggtattagtagygatagtyggtagyggttttygtttttygattatatgaatttygattttagtttttttaagttttttaagtygggygtttygagyggttatttygtgggttttttggayggttttttgtttttygaggtttttttttygtattygtygttgttttygygttygttygygttttygtygtygtttttgtagtygtygttatygtygtyggtttygggggagttgtatygtttgtttttygtttyggtygttgttatygtttagggttygggygtygttttatygttgttttyggatatyggggataatggtgattatatygagatggtttttggtgtggtygttatttygtygtaatttatygyggttttttygaagttagaagttgttygygtggttagttygaygtygggygtgaagaggttgagttttatggagtaggtgtygggagtygaggtttttttgtaggttagttagttttyggatttttatygyggygttaaggttattygygtagattygtaggggggtygtygtygttatagtttygagatttttttttttattaygayggttattttygtgttttygtttttygtttataattttaagygttataattyggttttygtggaaaatgttttttttaggaaaagtagygagggyggygtgggtgtyggttttggagggggygaygagtygtttatttttttaygatagttgtagtyggygttttttttggtatygtagggtyggtygtggatttygggttagttygggggtttggtyggttgttttgggagyggtggatygtttatgygtagagagatttttgtyggtttttagaatggttttaattatatygttatygaygtgagggaggagttygggttgttattttagtygtagtygtygtygtygtygtttttttagtygggagataagagtttttggggtyggattygaagtttygggggttttattagygttgtgggygtyggtagtatyggyggygggtgyggggggtygggtttygg

SEQ ID NO: 11300 - DNA, 858 bp, synthetic construct; identical to SEQ ID NO: 11298
  misc_feature 1..858: note = Description of Artificial Sequence: Synthetic polynucleotide
  source 1..858: mol_type = other DNA

SEQ ID NO: 11301 - DNA, 247 bp, synthetic construct
  misc_feature 1..247: note = Description of Artificial Sequence: Synthetic polynucleotide
  source 1..247: mol_type = other DNA
ygggtattgtttgtygttagtataaygaagaaatttatatttaygaagattttagattttaygtgattatattatttaattattagygttggtttggaggaattygttgttaygtgatygttygtgtttaatgatygaggtttaygttttttagatygttatagtygttgttatagggtttgagtttgggyggygtttygtttyggtygtayggtgygtyggygttaatttttttygaaggtttygg

SEQ ID NO: 11302 - DNA, 224 bp, synthetic construct
  misc_feature 1..224: note = Description of Artificial Sequence: Synthetic polynucleotide
  source 1..224: mol_type = other DNA
ygtygttaagaaggaggaggagyggtaggaggygttgygttaggyggaggaggagygtaaggttaagtaygttaagatggaggyggagygygaggtygtgygttagggtattygagataaggtgygygtygggtyggtttygtttgygggaaggyggttttgagtttagyggggatttagatttygtttgggtggaaggggttgttyggaagaggggygggygt

SEQ ID NO: 11303 - DNA, 1174 bp, synthetic construct
  misc_feature 1..1174: note = Description of Artificial Sequence: Synthetic polynucleotide
  source 1..1174: mol_type = other DNA
ygatgtggyggggtttgggaaatgygttygttggagtatatygtagtttygygggttttygagyggygygygygggtygaggatttttagggtttttygygggtttttygagygtygtygtatygtttttgttygygttygggatygtttygtgggtttttttgttagggtygtttgygtygagaggtagtttaggttttgtyggggaygtaygggttttatttttgattttttagtyggagttttttgaggatttgtaagtatataggttggagtygagaggttaaattaggttttaggggatttttttaataaaattttaaattttatttaggttgttygtaggttaagygattgtaaggattttgagtygaagtagyggtgtygggtygattygaggttygttttttatygtttttttttygggtyggttttgtgtagttggggttttggaattyggtttttttygggttgtyggttttggggtttggtgttygttatttttttttttyggaggtygttattgtttttttattttatttttagttttttygtttttttttaygtttttttttygygtttttttttatttgaattttttttttttttyggttggaagaaaagtyggtaatgagaaattagtttagtgttagtyggaggaggggggtagataattttagagatatayggtaatggagagagaatttattttgtgtaaagagggtttygagttattagggaatttttggattgttttaggttgtygtgtgtgatgtttattaygtygtgygaatattatttgttyggtattgtgtttttagttgttaggttatttgttgtaygtagtaatatttgattgtttggttttaygttygtagygttygtttagaygygyggggygggggtygyggaggggygggygggagttttgattaagttatttgygaggggagggggygygggygtagyggyggtygggtaygaggtygggttgatattattatttgttggggygygggaagaayggtagttgttttgygttgtttyggygagggaygtttggaaaaggttgaagttttgggygtttttaagttygttatttayggggttttygttattttagtttgttygtygtyggtygttttttgtgattttttgttttttggttygtygt

SEQ ID NO: 11304 - DNA, 8657 bp, synthetic construct
  misc_feature 1..8657: note = Description of Artificial Sequence: Synthetic polynucleotide
  source 1..8657: mol_type = other DNA
ygagaygygtygattttttygggaagygygagygygygygtgtttgygtttttgtgyggatttgggtttgtygtgygygtgtgtgtaaaggtgaaayggyggyggagttttaaatattttattttygaattattttttgttgaggaattaaggttgttaggtygttgttgattttgaagagggttttttttaattgygatttttttaaggaattyggttttgtttatttttaaggaatgttttttttttttattttttagaygttgtaggtttttygygttgygtttttttttaggttggagtygtagttggygggaygygtygtttttayggtatgtygggtgagagtygtttaygagyggtttagygtggyggatttyggttttgagtygygyggaygtttggttaygaggggttttygattygggyggggagaggtgygatttggggggagggggyggggygygtaggaaggaggaggagagagaaaagggygaagttagygygagattaggaaggagaggagggtagagayggagtyggygagatgttggagaatttaggattgtgggtattttgagygggagagaaattttaggaagtaygtyggaggyggggtatttgtgggaggaaggtaaattttgtagagygttaaaggatgtygggagggataagttagttatggggagattttttagaaattyggagttgaaaatagggtagttaagtaagtaagagttggttagttgaataygaggtttttagaatgtaaattataaataagaaagaaagaaaygaaagaaaaagaaaagagygygygtagggtttygggtttaggygtttagagtagttygtgygggggttttttyggtttatagtagtygtygtttygygtttttgaagtggygttygygtggttattyggggattttttaggtttygggggtttatttgaaaatttygagaggttttgtatattttgttaggattggagttgyggggattttttagttttttayggatgtttttttgtaygtgttttttaggaaaatatttaggtttyggaagygtttttgagagtttagaaatgtyggttgagygtgaaatttagtttaatttatttatagagtattagatttagaaaygaygtttgaaagagatgtgggttttatgttgatttaaattttgttttatttataataaygtttttgtttttaaagaaaagaaaaattttttagttaaattttttatgttttyggttttttgtttttgtttygttttttttttygataaaygyggggagttttggaaygggagggtyggtgatygygaatayggtagygatgtgatttgatgtattgaaattatttatatttttaatgttattttattaaaggaaatttatataaaagygtttgttttattttaattgttaaaaaagtttgttatattttygaayggtaattgttttttygttagatatygaaagtttataaggaattataatgagaaaggattaggagtygtttaggttttattgaaatgtttygatgtygtttttttttttttttygaattaagtygtygggggaggaggtgggtygygtttatygttgtygggattygggtyggtagataygggttatagygttttttygtygttygygygtaygatttttggtttgygtygttttttttygttttygygatayggaggayggygtygygttyggygagygtttyggtttttttagtyggtygygttttyggggagatttygagttygagttttyggggtyggttgtttttygygttyggtttygtaggaaattttygttygttgaaatttgygtgtttaygtagattygttttaaattttttggttgttgtagggataataaagaaaaatagaaatagtgttaattttttttttattttttagggtatatttaggaaagggggtagggtttattaggaatttgaaattgtttttatygtttgggttattgtgattaggggtygygtttgtaaagtagttattgggttttttttgygtgtttgtttatttttttttttttgttyggayggtaattgaaaagttttagaagttaagtgtygggttttttttagygattttataggtttgagtatttygtttygtttttgagtaaaatattttaggttttttttttygggagtygyggttttgtagttttygtggtttygagayggagtttgggttgagttygttatttttttaggtagtttygtygggatygtygygttaagattttaygttggtagtatgtttttttatgattgattttttttttttttaagaagaagattaagttaattttaatttaagaagaaggaatgtgatttttttttttaatattagagagttttaaagtaaaaygtagtttatatattttaataataatgaygagtgttaagtttttaatgtttttgygtaggtattttaatttgttatagttattattaataaaaayggtatgtagtaagagtygattgtttaatagtgtaaggtagayggtttttattagtaataggtagtagyggtatggaatatatagattttagtggaggagtataattgttaaggggaaaatatatataggaygggaagaggttatttttaaatttttaatattgagttaaagagggggaagggtaggyggygtttttggagatgtattttgggtgaggggatttttttygttattgtaygtgtttggttatatatttaattgatgttagaatygattgtatttagagtagatattttagttttaaattgaggatgtttgtataataattggttgtttttttttttgtttttggtagaggttyggyggggggaggggggtgggttaagggagggggagggaggatgagttttaaatgttaatgaaattatagygggaatygttttttagaaatggaaatattttaggttagtgttttttggtgataaaaattatattygattttttttttatttaaattgatttgatygtaaaggaattttaaaggttgttatttgatttgatagtgtttgtgtttgttatttagygtgtgggttttttatttatttttttttttggaggaatttttttttaggaagygtaaaaatgtygtagattgtygayggtttgtttaattyggttgttttttttttttttttgttttttagttttatagtaattgattaaaaatatttgttttggattgaattaggatgttttatgtggagtygtaataaggttgaaatttttygttgggtygttgtagggggtttagtttgtgggaayggggtgtttgtgggtggagggagaggtggtygtgggtgtgtgtgygtgtgygtgtgttgagatggtttgaagaggatgtgtgtaggatgggggtgtggtttgtaggaagagtggtgggggagtagtgtgggygaaggggtgggtgggataattggtagggggygagtggttyggttygggagtttttggygggaggggtaaygtgtttggatygygtttatygggagtttgtyggtttaggaggagttatttttaagtatagtattgtagtttgtaattggtttttttgtatttggggaaagatagtttgatgtygtgagtgttttttttgygttttggattagattggtaattygggtttygtttttttygygtygttgtagtygtattatagggaggtygtaatatgttttgygttttgagattattaaggttgtttygtaggttgtagggttagtaggggtgtaggagtyggttgtaggtttgagttgaggttygttttaggttattgygtttttttttttttatygtatttattygagayggttttygaggatagaggtatttgttgggtgggtgtttttaataggttagtatagatttgatatttttttatttttttgagygttttttataggtgatttttyggagtgggtagttagaygtttttttyggttattttygagtggaaaagggttggagaagygtgatggggagagggttttaggaagttggggttttaggaattttygttaatygtttygtttttgagtttygtaaggtaatygtttttttattttagtygygygttatttgagttatttgtaatgtttattgtatyggyggygttaatttgagtttttgttygttttygaygtgattgggaggttttaggttttgttagaggyggtttgttaggtaataattatttttttagtgttttgataatataaatttgaaagaggagttaatttagaaaaataaaataaaataaaattttttaggggayggygtttttttagttgaagttttggygttatttttaatagtggaaagtygtaaygtttagggtttygggggttgygttgyggatttgggggtagaaagtttattttagggtttttttggtaattygtaattaaggygtttyggatttaggtttatgttgggyggagtggatygygaggggtaggygattagaygygaggttaygyggggagtttygggttaggaggtagagtaggttygggatygtggaagtgagagtygygygtattgttyggaggaagattygagtygygggygttattattttgatttttttatttttttgygattttyggattggatataggggtygggttttttyggggtgtatagyggggtaggttgtgagttttttaattggattyggtttggtttgatygygggyggtttttgtttagtttgtgagggtggagaagggggtgggggyggggtagtggttggaaggggygggggtygggtaggggygaagayggtggtyggggayggtgggagtyggtyggagtygggtaggggaygtggtttygagtggatgggagtgggaggggtgygygtyggggtaygtagygyggtygggttgggttgtaggttygygagtygygggttggggtyggagttgttagagaggyggttgygttataaaagtttgtyggtttttttygtygttygttttygtygttttygttttttttygtttttttttygtttttttgttttttttttggtygyggttyggaggttgtagygggyggagtaggggaggggygggttttygaatatgtagatgagygygtgatggatagttgygygttttaatgtttttyggaaattygagygttttttttttaattttttattttygattttagatttttttaaatttygatygtyggtttggygygyggttgygtttatyggtttygygttgttgtygtygttatygttatttygtygtygtttyggttygygggtygtttaggttagtattygggtyggtttgttttygtyggtygttygggtgttygtygtygygtygygtttyggtygggygtggatggagggygtygygygttttgttygttgttyggygtgaygygggtttygygtttygygtttattatgttttattygtagggttatttgtattaggygttyggttygttggygttttattygtgttyggtttayggygygtyggttttggyggtttygygtagygaggagttggygygttyggygtygggttyggygtttagtttttattygggttyggyggtttttayggygtaggyggttatyggtttygggagttygttgtagtattyggtygaygtygtygtygtygtygtyggtttttygttttatatggtaatygggygygggygggaygygggatttttgggygtygggatttagayggggtttaggyggagyggggttygggttyggygggygggggtygtygggaatgtggygyggttggygatttaggagtygtyggttyggttggtygtttygtaggttgagtygggtttygggtggggagggtagygyggtaggyggggaygtttttgagttyggtygggattygygygtttttygygygttttttyggttygtyggttgattttttttgagagtttgggaagtgygttttygtyggggtyggggtttggygtygtttgtttttggttttygtatygtagtttggggaggygttyggagygggttgtgtgttygtttgtattggygtggggygygagggttygygttattgyggtttttgagtygayggtygggyggttygtatttattygyggggtttagggyggtgggggttatygagttaggtttaggagtygagtatttagttgyggtttyggagttyggttygaggygtttaggtttyggttttattttgtttagyggattatgtttttaaatatygtgtttgygggygygtgattygttaagggtygtttgagtttttygtggttygagygtagtttttgtttyggygatttgggggyggttygygagtttygaggttattgagttgggttaggttygggtygyggygaagtaygttaygggygattgaggttattayggggttgtygygattgtyggttttyggyggaatttttgggtagygatygagtygttggggttttggygaaggttgtaaatgtttygaatttaaaygttaaaggatgaattaaaatgttaattayggygtatttgaagaattygaaayggtgattggtttttgagttgtaaattggatttgtttagttttagagtagtgaatagtgaattgggggttttggggtgtttttttaattatataagggaggggaagagggagtagggggaggtagtygtattttaagtatttgtagaaatttagatattaaagagttatttgtgggtttgtgtgygygtaygtgtaagggtttgtgtatattgttaygagyggtttyggaatatttaggggaagatgggttattttaggaaagtgaaatagtttagaaattygagaataaaatttyggtattttttgtgattaatagttggtttygaattatattgygttttttttgtttttttgyggygggaagygtagttttagagttagatttayggggggaayggtggtygtgggygggyggaggggtggtattttttggttggttgttygyggggttttygtatattttatttataggtttttgttggttttagggygtattttaygaygygtatattatyggtatgatyggygttattagttattattygtayggtagygyggtttattygtattagtttaaygatttygygtatygtaagaaygttaygygggaygttayggttatttttaaggtttggtttaaygagtatygtaagaatttttattttattaagggygagaagattatgttagttattattattaagatgatttttatttaggtttttatttggttygttaaygygygtyggygttttaagaaggagaataagatgatttgggtttygagaaataaaagygaagatgaggaygaggaygagggygaygttattagaagtaaggaygagagtttygataaggygtaggagggtayggagatttyggtagaggaygaaggtgagygggtagyggtyggygtaaggtttyggggygttttttttttaggyggggygtagagttaaggyggggaggaygttgttygtyggatattttaggttygggtyggagttttagtygtattatattgttttggggtygtygggatttgagygagygatttttygggtttttttyggggaggttaggtttygtttgttaygtggtygggtgggggygaggtgaggggtttygtggggagggtttagtgtygtaggatagggggyggagggggttttaggtgtttgygttgttttttygtgttatttatygtgttygygtttttatagggattagtttgtaygtggattygtttayggattattygtgttyggtygagtyggayggggagaagttttygtgtygygtyggggattttttgtgygaatygggttyggagtgtaaggataagtatgaygatttggaggaygaygaggaygaygaygaggagggygagyggggtttggygtygtttaagttygtgatttygtygtygtttatyggtttggaggygtygttgttgagtttttygttygaggtygygtttygyggtggtygtaagaygttttagggtagtyggaygttttygggygygtygtttttygttagtaagtttaagttgtggtygttggtygagatygttaygtyggattttaagtagtygagtttgggttygggttgygggttatyggggttgttygyggtygtygygtyggttttaatyggggtatygttaggaggttygttttattttgtttygtygttgttgggtygttttttttattataygtygtttttttayggtaattatataaattaygggaatttgaaygyggygttgtagggttagggttttttgyggtataattttgyggtygyggttttyggygaggttttgtatatygygttaaaggyggttagygaygygggtaaggygggygygtattygttygagttttattatyggttttygggyggyggttaygagtttaagaaaggtaggyggttygyggtyggyggygttygggaggggagggagagttagtttyggggaggyggagygttygggagattygagggagggttygg

SEQ ID NO: 11305 - DNA, 1059 bp, synthetic construct
  misc_feature 1..1059: note = Description of Artificial Sequence: Synthetic polynucleotide
  source 1..1059: mol_type = other DNA
yggatygtttttttttattttatttttygggtttttattgtygyggttttgttttattatttttagttgaggggtagttyggagttttatggttttttttttagagyggtygttttttygggtttttttagagttttygaagagtygygtgaggaaayggggatttgttyggggtagtagatttttagyggtgaagaygtagagtatygggttgaygttagaattgaagaaggttaaggtygtagttttygttygygtygtttggtyggtttygtttagtttygttaaggtttttttyggtggagttagygttgygatygtttgtagaaggttgattgygtggtagggggtttagagtaagtygaaggtaagtaygatggygtttattagtyggtttattygygtttygtgtygttyggagttttagygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygtygttagtagtaggaaggttgtgtttgtggttygygaagttttttagtttagtagtgtttygttttttgggggayggtagtagatyga

SEQ ID NO: 11306 - DNA, 1663 bp, synthetic construct
  misc_feature 1..1663: note = Description of Artificial Sequence: Synthetic polynucleotide
  source 1..1663: mol_type = other DNA
ygtaayggggygggggtagaygtttttagttttagaatttygtygggtttatygtttagtgtggaygatyggygtttttaygagatttatygagggtatatagtttttattttagttygttttattygatttagaygatygttagygyggttagyggttagygtatagygagttgtttgggtaattgtggtyggattttagggagtaagttggtttygggttttatttagttttattyggtttttatyggtttttttatttaggagttggaggatggtttyggggygttttagggggattgttggttttyggagtttttagttagaygygttttgttgtgtgagtygygtgygygtttaatttggaggtagtygttttygtygttgataggtgttgtttagagggygtygggtgyggtttttggygtagttggaygygtaygtttyggtgygtgtagtttttygagttyggttagagagaagagggagttagggygyggtttgggggaygttagtggattggagtygyggagtttygagggaaaaattttgtaggygtygyggtygggattyggttayggttttagtttattttagtaggtgygggaggaagaggtagygtyggagtttygaggttagagagtttyggyggyggyggtygtttttttttttygagttggtttgaagtygttgggtattttyggtttttgttgttgygttygtygtygtygtygtygttatygttagygtygtggggattygggaggaggtgtagtygaagagggaggagaagtaggaggaggaggaggaggaggaggggagaggaggagtagggggtggaggatggagtttygggttgtygyggygggygagttagagtygtyggyggygtttttttttttttaggttyggttttggaagaatttgtagttgggggtgggtaggagtaagggyggygggggygggygygttgggggtttagagygtygtattgyggatatttygtygtttttttygttattttyggtgggtatagggaatgtatyggttagggggagtggtgtaggtagtaggtggagyggttttaagaagyggaagtaagtgttggatygagttttttttttttygtagtttaatttgtgttgttygtygtyggagtttttggagttyggyggygtyggtagagtygagtaggggtttaygttaygtygtyggattygygagtatttgtttttygtygtaaaggggttygyggyggtttygggagtagygggagggaygttttttggyggaygttttttygatttagttttttttttttttttygttttattttttttgttttttttgttttagtttttttygaggggggatygygttygagatgagggtgtayggygttagggtttyggggygtatttgtgttattagaagagtttttttttgtygggtatygtttgtttggagtagttgttggagtygtygttttttttygtagagtyggygyggagtttygyggagtttygggtttyggagaygggygaggagtayggtagtagttaggtgagtgtyggtggygyggtyggagataaggtgygygggattaygtttttttttttaggygtttattattyggggagyggggggygggggtygggaggygg

SEQ ID NO: 11307 - DNA, 2065 bp, synthetic construct
  misc_feature 1..2065: note = Description of Artificial Sequence: Synthetic polynucleotide
  source 1..2065: mol_type = other DNA
yggagtaggtygaygagagatttttgagaaggttggtagattatygyggatttttgtttttttaygtggagttatgggygaggygtttaagaatttgttgaaggagttygatttttttaagtttygggttaggttttggagtatgaggtygttagttaggaygtttagaaatgtattggtggtggaattgaggatggtggyggttatttgtayggggygtttggtagtaagattgttatttttattatyggtygtatttggtttygtggtgtttygtaggtttggatygttaagaaggyggygtagygygtaygaggagtygggtygtaggtattggtaggygygaygttygttgtgattaygtaygtgtatttgggtatttagaygtattattagtagtayggtagygttttygtggtygtgtagtgtagttaggtgtagyggygtgtagtygtygtgggagygtgygtttaygtygattggtgygttattgygtygygygatttttattagttgtagygttatttygtygtygtygtttttggyggtttaatgtagggtygtgaagttagatatgaagtygygtttggtygttaagtygyggtygygtagtagtagttygtgtagttggtgggtttagyggttttyggtagttygtaygagttattygtgttyggayggttttaggggtatygyggayggyggyggygyggygggtaatttttyggygttagggtttagtagaygygggtyggygygygataggygttttaggtgyggggagyggttygggtttaggtygaggtttagatyggatttttttatygagagtygttttagtagtagaggggagtttygygggttyggttttttygatagttgtyggygtaggtygggttttttygttyggaggyggagygtggygggggtygggaygtagygtatyggtagtatatagggtttttgttgyggyggttttttygttgtttygggttygggtttygygtttggyggattagagtagggygatgtygttttagaaggggttttaggyggtggggtygygtttgyggagggtttttyggtggtttgggttagtttaagggttggaagyggtgggtyggyggatygtttttygggyggttgagygggttyggaggtyggttttttyggggtgttttgtggttttgttggtagatttaggttttttggyggttttattggtygyggtattyggattaagggyggagttttyggggtagaggygtttygyggtaagatygtygaagtgggtttygayggttgggtygttgttttyggggggtygaagggtgygggttygggtttygggggtyggggttttttttttagtattaygaatttgaygtygtygagtttttttattatygttaygttgttgaygaattgtttgaagyggtttttgygggyggygyggtttygygggtygtyggtatygagtagyggtttgaagyggtttagtagttyggagttgygtattttttygtygtgtttttgtaggaagtttagtatygtygtttggtttatttyggtagtygtagyggyggyggyggyggttagygttatggtggggttttgggtttttggttttyggggygggtgggygtygygtygtygygggaygygygggagyggggtttygggaggygyggtygygtttatttggtgtttttttygyggttagtygggygtgttttygaagttggatttyggtygygttagtgtygttgggtyggggygtttyggggygaagggygtygggggtygyggggagygtttatttttagygtttygtygggtttyggttttyggggtaggtttttgtttttgtattttgtttaatgggygtttgtttttatttttygygtygygttygttttataggtgatagttgttttygygatgtagagggaatyggagtagaaattttygtygtttttygttygttttagaattaaaggygtagygttttagttttggtttyggttgttaggtgggtgtgttttttagggaygtygyggttygt

SEQ ID NO: 11308 - DNA, 3487 bp, synthetic construct
  misc_feature 1..3487: note = Description of Artificial Sequence: Synthetic polynucleotide
  source 1..3487: mol_type = other DNA
ygygygtttttagttygtttttggaggtagttygygggatygtaggttggaggygygtyggygtgatttygatygtyggagtygggaggaggagtyggaggaggttgyggggggtttyggtttaggygaaggaagggtaagaggttgttygatygggggyggygtygggaggtgggtgggtttaatatttaggtygggggaggggtttaagagatatygggaagggtagtygagttttaggggygggtggggtggtagttgtgtgtagtaggggatagggttgggtttttggaagttagagtgaagtttttttggttgtttygtaggtaattttattttttggtagaatagttgygaatygttaagttgatttttttygttttttggtygagaggagaggatgttttaggatttagggatgggygggaagaaattatggggagttataagtttgtatttaggyggggaggaggygggygggygtygtttygtaggygtaggygagtgggtgggaagaagggagggagagggaggaaggaggtgaggtygggaagatgttattgtygggggyggggyggggtyggggattyggtaaagggattgtagtagygttaggtgggggygggggttgtaatgttatttatttgagagttaggtgtgtgygttttaaayggggttygttataagtyggtatttttttggtattatttatggtgtagggttttaggtagagggttggggattgyggattygtttttgaagygggaygygaatyggtagagttgggagaaggtaaataagggttaygttttttgtygtygtttygygggygygtattygtygtttyggtygtygtyggtatatttttatttttttagygtttttttttagttggattatygygyggtttyggaggtggaggttgttttygattttagtttttatttttggygtygaggtttygtattttttatatttatttggaaagggtgtttttygtttttttaaaaaaattgtttaatttgtgtagagtttttaattttaggagtygagtatgttgttttygygtgtagygttygygtgtatygggtygggagagggggygatagggyggaggyggtggttttyggaaggtgtttgggatyggatyggttgtaygtgagtttagygygaggttatgtgtatyggtttagttyggttyggygttyggaygtgttgygtattaataaaatgaaattyggggagataggagggtagatagttttaggttttyggagttttygttygggtygttygatttttttatygtatttatttttygtygtagtttttaygttyggtyggagttygyggggaagttgtagttttggygygttttygttygttygygttttttygtyggttygggggygttttgtygtagttattaataaagaaggtygttaagtttatttttttaaaagttgttgttgtatgygttttttttagttttttygtattgtattttttaaaataygattgattaatatgygtaattttttttttttgtgttgtgtatttttttttttttygygttggttttttagaataggtagttagtaggagagagagggagygagygagtaagagagagygagggagygaagagygttggtagatttgttgtaaaaaygttaaataaygtygtggagatgygtagggtttattygtygggggttggattttattttgtttygyggtgtttttttgaygggygttgttttyggttaygygtygttgtagggatyggygygggaaggatgttttygaagtygggagtttttggggtyggygygggagggyggggggygygtatttattyggggtygyggygagggaggyggtygggttygyggygttttaggttttaygtttttygtyggggayggtyggttygtaggatttaagtyggtgtygttaggagtgggygtaaagtaattttatggaygttatttattttttttaaaaaatagtttttaattgygatggtygyggtyggtattatttattaattttttgtgtatgtttttgtttttttttaaattaagatttttttgtgatttttttagaaaaaaaaaatgtgttggggtgggggtggggtgggggygggtaggaggagygagggagggggagtagttattttttttttatttattyggattttygttttygatattttygtygtygtttttttaatttttygtttagttgtttggtttyggyggggagtttaggtagygttgygggtttygtgggggaagggtgttttttttygtagttttattattaygtttgttggtattttgggttyggattttttatggattttggggygtttttagttygttttgtttttagggtygggttygagyggyggttgygttygtgtaagttttattaggtttgtttatattttatatatttatatatatatttygtttttttatttttttatttatattttttgtttatatttygttttttaygygttttagattygggyggygtttttygtaattttaaaaaaaaaaaaaagygagtttatatttaaaaaaattttttggygttatattaatgaygtatttaaaatttgttatttttttttgygttaaaaagaygtttttttgtaaataatagtttggaggygatattygyggagggaaygaggtttgtattgagtatttygtttttyggggttttagygttggaagattttygttttaggttttgtttttgaatygttggttttaaaatgygaatygaataaattgygtggygttttgtagtattagaagtgagtagaaagtgttggtaggaggggagtggaggggygaaygygagttttggggagggggygyggttttttttttygtatttattttaaatggaaaattaatatttygggygggggaatttgaaattgtaggygattttaagaaaagaggggyggttygtagagagggtttttattgggttygtygtttttttttttttttygggtgttttttggygtttagygttgtttygtattttyggggggtggagaaggtagtgatgagygggtgggtgggtggttgtatattttggttttagtaggattttgtttyggggygatttttttttttttgttttttttttttattatttygaaaggttaaaaatygaggggtaatttttaaaggttggtatatggygaggaagyggggygtttttttttttatttttygttttttygttttttttttttyggttttatttttygatttgattttgtggtgtataaatagtaygttyggattttygtagtttttggaagaagagtttgygttygttaggygggygggttgtygggttgttagtyggyggtggyggggttttgggtttgttttyggagtygygggttatatttatttaattygttgygttygtygagtttattttttttyga

SEQ ID NO: 11309 - DNA, 847 bp, synthetic construct
  misc_feature 1..847: note = Description of Artificial Sequence: Synthetic polynucleotide
  source 1..847: mol_type = other DNA
yggtygttttagtaaagtttttaatttagtygatatgaygygyggygtagttaatgggaggyggagttggygttttttggtygggggggggtyggaggggtgggtttygygttttyggtgtttgtygtgtttattgaatggagagagygagygtyggttagtttattyggtygtttygtgttttagtygtagtygtygygttttttagtttagttttaagtyggattttttygggygttaygttttattgygttygttttaggtttttaattyggttygygggttagyggggttagggggygtttygtatttgggtatttttagygatgygtagyggggtagygtyggtttygtygatggagttgttgttgttgtygtygtygtygttyggagygtttygtttygttygygtttygtgygtttgagtatygagttygtttttttttygygttaatttygtygttygttttttaggtygttygygtttttygygygttttttygggttttaygygttttgtttygtagaggtagttttttttaggagyggggttttgtatattatggttttygggtgggtaggggtyggygtygtygtgygygttygtttggygttggttttggygttggygagygttttgagtgggtttttagtygtygtttgttttattaagtgtatttgtttygttgttagygtggattgttaygggttgggttttygygyggtttttyggggtatttttygtaaygttgagygtttgtgagtatttttgttttattttaygygggttatttatttgggttttatygagggggttttaggygttagattygtttttttttttygg

SEQ ID NO: 11310 - DNA, 909 bp, synthetic construct
  misc_feature 1..909: note = Description of Artificial Sequence: Synthetic polynucleotide
  source 1..909: mol_type = other DNA
ygggaygggggygagattttgggtttttaggggtattgaggggtygtttatgtygggggatatggttatttgggggyggttttygttaatygyggagtggggaaaaggggggagggatggaggaygaaygttyggyggtgtttaaaggtaygaygyggagtaggaattatagttttggtttttagaaagygygygyggttyggggtagaatttgtygaagttttagttyggggygtaagggatgtgggggttattggaagayggggygygggtygttygtggggaggagattggattygaattyggtttattttattygagyggygaygttagygttgattttaggygtgtttyggttttyggygyggtttyggtttaatygtgtaygttygyggaaggtttygtattygygttagaagtggtttgttyggggttatyggttygtaagttttyggtgttttygaggtttttgtttygtttygygyggttgtagtyggygggaggggttgagaggygggtygygttgggatttaaggygtygttttttygttagttttttttttttttygttatygggtggtyggagattygggggtattgttggggtattttaaagtatagggttagtttgagtgygtaaggttttgaaaagaygggggggyggygataaggagtagggaggggggttggaggaagayggtaaagtgatttyggaagggtttaggygttttaagtttatygaagaygggaggtttttagtggygtttggggggattgtgggaaaagtagtttaagaaggggaatttggagygaggtgggggagaggtyggtatggttttttttaggagygttagygttagatagagyggtgataggtygtatygggagtatttygtttatattgaaygg

SEQ ID NO: 11311 - DNA, 2150 bp, synthetic construct
  misc_feature 1..2150: note = Description of Artificial Sequence: Synthetic polynucleotide
  source 1..2150: mol_type = other DNA
ygtttttygtggtygggaaggttaggtygagyggggyggttagtygggtygggaggagggggtttttygggtygygyggtygtataaagyggggagatttgttgttgyggyggtatgaggygygttttttttygygagttagyggagygygygygttygttttygtttttygtttttygttttagttttyggagygttattygyggagyggtttaygttagtygtygggygtatygygttttagyggtyggggaggtgygttgttyggttttygtaaagttattgtgaatggggagygggtgaygttagygtygaatgttaataatgtagygattgagagtgtgggygtttyggggagagygtaagtygygyggygyggagtaaatagygtygagtygtygtygttttagtagtagtagtagtagtagtagyggtagtagyggtygtgtaygttygggttgyggtygtatagygttaaygtgagyggtygtygttttygttatttygtttgtttattttygtygtygtttygttttygtttttttttyggttttttttygtttttttttttttttttttttggygtattyggggggttgggaaygagttgttatgtgatgygygtttttttygygagttttyggtgatttaygaattgtttatttygtyggttgtygggagggggttgygagtygggaagaygyggggaagaggaggyggaaaaggaygtaaagtttttyggygaggtgagtttygggtttygggtttygggtttygtygttgggyggggtggyggggtaagtttgyggggggagygggygygyggggygggyggggaggygtggggaaayggygygggaagggagtttyggtygtygggygygtagtygtttttttygygttttgttygtttttatggtattttttaggaaygggaagggggtgggagtygagtyggyggtygygtygygtygaatgtgtgttttttttttyggttgtttayggyggtygaggygtattgtattttgttggygtygaagggtgttttggaatagtagagggaggaggagtagagagtaataagttaggtatggggagggygggttgtaggaggygygygttygygygagtygtagtagttgttagattygyggttttgttttyggttyggygaggttygggtgtttyggtttttagtttgygattttagttttaggtygggyggttttttttttaattttyggygtgygtatttygggttgtttygygaggattttggtygyggygtttttgygtttagttgttagtygtygtygggtggttyggattatygygatyggyggggaattaaagtttaagtttagggtygtaggaagaggygagttgggggtttygyggygtagatttggatygaattttttttagygaaagatygggttgtyggaaagygtttygygtagttaagatttaagggygttaggtttttgagagggaaattttgtatttttttttttatagattttttatgaagttaaggtgtaatatatatatatatatatatatatatatattttatattttagtttttaagttttagaagttttatttaggagattggtttatgaaggggatattgtttttttygttttygygtygaggygtttygtggtttygttgtgtttygtttattyggygggtgttygggagttyggygtygttggagayggyggygggyggygtttaygggttattttaggtgtttaygaggggagagattggagygagtatttyggygatttyggtttggttaagtatttgtaggaattyggatygtgaggggaagygtgtagggtygggagtgagtgtgtgaaggggtggtatatttttggtttttggggtygygggygtatggggtatttttagtattttttygygygtaggygagtttggtaatttgagggaagtttyggygyggtygttgtyggggtggtttgtttgtggttygatgaggygygtttygtagtttgttttttyggttatygtygtygtygtgatttgtggtttttaggaaaygagagggatyggggygttttattygygagayggattygtagtttttyggygggttygygggyggygagaygyggygt

SEQ ID NO: 11312 - DNA, 506 bp, synthetic construct
  misc_feature 1..506: note = Description of Artificial Sequence: Synthetic polynucleotide
  source 1..506: mol_type = other DNA
ygttttaygaygtttatgttagggttttttagattagyggagaaattagtagttttggatygtaagyggyggggttagggaggygataaygggaagtttttgtyggattttggatatttaggatttagtgttgttygggygttttttygtagtagttttagggygaggaggatggggggggttttygtaggggttatattgtyggagttttayggattygggygggayggtgaggtttttatattgagtyggtggtaaagttttygygaggatgaaggaggaatttygtgttttttattttattaggtttygtattttttggttttttttgttttaggaatygtttgttttttgtygygatyggygagttttttygggtttttttgaaatagtttygtttygaggttttggatttggaagtttaggggtatygttygggagyggggtatttattgtgggttttygttagttagtatttaggttyggagttyggggatagygggygt

SEQ ID NO: 11313 - DNA, 1503 bp, synthetic construct
  misc_feature 1..1503: note = Description of Artificial Sequence: Synthetic polynucleotide
  source 1..1503: mol_type = other DNA
ygygtttttgggtatttagaaataggtttttttygggaattygttttygatygggygtttttataatatttgaagttttttaggaygttttttgagttgggtaaggygagaggatttttttttagagtttagtttygagtaatgttygagttygygaggtggggttgggggygataaggaggyggagyggggatttagttatyggggatttttttttaagttagtttttaaattattyggygttatgtatttatagttygygygtagttygtgygttttggattttatttaagtattaggttygattagggtyggttygaaggttatygtttayggttagggtagaggggyggygggaaaagggtttagtggattttyggtttaggagggtyggttagttgttgggtygygggtatttaaagttgygggggttygggttttygattttaygtttagyggggttttagtattygagggygygygttgygattygtagagtagygggtgtagtaggttggyggggttgggatygygagttttgtttgtaaagtttaggyggggtagaygttagggagggggtygygtttaygygggtagtttyggygttgataggtagygaygtattttttygtaattygtttattagtagtttaaagtgtgtattgggtttttagtgaaatgtttggttttgaaagtttagttaatatygggtttagyggagttattagggtygttttttgtttygtagaattaggttttggtttyggttayggtgggggtttygtattagttygataatttygaggttaygygttygaaggattttttgggataagaagtggagtggggyggttaggaygygggtygtggggatygygagggaggagggggyggtygttyggatttatttygtggggttttygygygygggygtttyggygtgtyggattatgtygtyggtagtttygggayggggaayggaggygtttaggygtygggtygygyggaaygyggagtttygggygttygtatgtttttggttttggttttttggaagggttaggtygtygttgtygtygygttttggggttttygtttttttttattttttgtatyggagygagyggggtttttaggaagaggttggttttggtggttaagggtttttttgttaaaagttattyggtagyggttygyggttyggagttttttggggtatayggaggttygggyggtygygttttyggggtygggtttyggggyggggggtgttggggttaaggygtygtaygggygtttaatttyggggtgtygtttttataggttgtggttggggttggggygygggaggttygyggggtttyggagagggaaatttagagaaaagttttttatttggtttggggtygtaggggaaggaagaygtttttygtttgtgtyggygtygatygygggtyggtaggtggggaggtttagagttggyggggagttygttttattygg

SEQ ID NO: 11314 - DNA, 907 bp, synthetic construct
  misc_feature 1..907: note = Description of Artificial Sequence: Synthetic polynucleotide
  source 1..907: mol_type = other DNA
yggtttaygtgttttttattttggttygtagaggtttgagtgttgtttygggtagtttygggtagggttgggtagggtttagyggattttaygggtygttttttttygtttttttttagttatttgtttgtygttttttttygtttttttttttttgaggtgttgtttyggttttyggggygggggtagtygygggtagtttagttygtagygtttttagaggtgttygagttttttgaaygtttygtaggaaagtagttgtgttgygtggagtttttttttygtttyggttttttygttygtgtttttgtttttttygttttgyggygggaggtggyggtgtgggttttyggggaggygyggygggttggggaggtggggaagggtgtgygygtgttgggggtgggggggaaagatttgtygtttttttttttygtttttttagtttttggttgttatgtagtttttatggtagyggtatttttagatttaatttttattttygtttagagttaattaaggtaaaatagtgaggggaggagggaagagygtggttagggaagggaggggggagaggtaggaaatttaattygaagttgtaagtgtagygtttattttgttaaagtygtagtatagatttygaagtygtagygtygttttttttttttttygttttagttygagygggaagyggtagtagttttttagagttttggtttggtagggaggggayggygttygagtagttatattgtagtttttygggtttttttttyggtyggygtaggtttygygtttaygattttttttgggagtyggatttgttttttttatygtygttattygtyggtttttgygttttttggttttygatatttygtttggtygtttttttgtgtyggttyga

SEQ ID NO: 11315 - DNA, 1925 bp, synthetic construct
  misc_feature 1..1925: note = Description of Artificial Sequence: Synthetic polynucleotide
  source 1..1925: mol_type = other DNA
ygggtttttygtygttttggggttgagtttggtgtygttgtttatattgaataggaygttttttttygtgagyggyggaatygttattyggtaaagygggtgttygaatagtttggttaggagggaggygttttygtyggggtyggggggygattyggatygaygygggtyggggtttygtagtagyggtyggtgygyggggtygtggggttttagggygtygggatttygttttygtaaggygygttyggtyggttyggtygygggyggtagtttttttagygagtgggaygagaggttggaggaggggtyggagttgaagttttgtaggatgyggagygtgtgtttgttgggttagttygygtygtyggyggyggaggaggyggtygggggtttttyggggyggtttygaatttgggtttagtygggygyggttatttyggyggygggttgygygtaygaatagtygggttttttygagggtygygygtygygtygttttagtttgggtagtaggtttagggygatgtgtagygygtaggttattaggaatattattaggatgagtaygyggaatyggygtattagtattatttttatggtygygygggtyggttygggtttggagygygttttgttygygygtttttttagttgtagttgggtaygagygyggygtygtttygygggttaaggtttatyggtgtygggyggttattagtttyggggttgttttygggttygggtygygtgtagggygttygtygtyggagygttgggttttygygttatttygggttygttttygttyggttttttyggagyggtygygtttttagtyggggagtttaggggttttggttygyggagtygggygygyggggggyggttggggtygtagtagggggaggttyggygttygtagtygtyggygyggggtttatygggygtgtgggtttatttyggtyggggygygaygggtttgggyggtggyggyggtygtaggygtttygatttttagygygtttttttttaggygtygggygggygggyggggaaggggyggttttttygggtygggttttgtttttaygtygygttygggagatyggggttggggggaaggggggggygaagggyggaaggggtgggygyggggagyggtyggyggggtttygggtaggtgtagyggtygtttygagygtagttttygtttggtygagtttttyggygtttygygtttygggygggtagatatygagygtygyggagtygtttttygygttagygtttatagattggyggagtygtygttttaygagttayggttgggttygggtyggttgygttttygtttttttttttttttttttyggtygygtttygygaygtttttgagtttygggttygttaaggagagggttttttttgttygyggtttgtagagggaagyggyggagatygggagggygygttyggttttggttaggttagtagttgyggtygagtggggggtttyggtttggtygttttttgggattttttttygttyggggtygtygtygttagttgtagtttttyggtttttttttagaggagygyggggtyggggtttaggttaagttttttttyggagtygyggggygtttgygtygtyggatgagtttttygtygggyggygatttygtgttttaygttygtttyggtaaggaggaggyggaggyggtttygygagagaggtttaaggagygattgggtttggatttaggggaygttagggtagyggagttttyggtatyggtttygttttttttttttygtttattygygggaygygttygttttaattttttaggygtygggttygttgggggygttgagaggggttggtgtgtygggggygtttttttgtttggggtygaygg

SEQ ID NO: 11316 - DNA, 1287 bp, synthetic construct
  misc_feature 1..1287: note = Description of Artificial Sequence: Synthetic polynucleotide
  source 1..1287: mol_type = other DNA
ygygtggttygggaggttttyggaggagggaagggtttattttagygaggggtataggyggagaaggtgyggggygaggyggtygygggtttttggtatttttttttttaygtttaggttaagttggyggtgttgttggtgaygttggtggtggtygyggttttttatttgyggatggagtagaagttgyggyggggygtggtttygygttagtttygtatttygyggttttagtataaggtgygyggtgayggttatttggaggaggataattyggaygagagygaygyggagggygagtatggggayggygyggaggaggaggygtygttttyggggtttaggtttggtttygagttygttggattyggtygtyggttttgttygtaygaataggygtaggggggygaygggtyggaggagtagtgaggggtygtttggttttyggatttagtttygtttttygtyggttttagtttattaygttttaggtyggggggatttttttygagtttygygttgttttygaaggtttttgtttttttttttttaygttggggaygttttttttagagttygggttattttygggttttygtagttttttttaaggyggagtggagttttgggaatttttyggttaagtataggggttygaaaatatagttgatatttygygggtttttagtaygygttttagygtyggagtagggttagggtttttttgygattyggtttygttttagatttttttagttttyggtygyggattygggtygygtgtgagygttttttgtattttttatttttagggttygtygagagttaygattttttatagaaaatgagygataaagagattttgtattgttttgattggagagttttaggtygygggggayggagygtttttgggatgtaygttyggttggttyggtttttgggygyggtggtgagaggttttgatttagggggatygyggggtgtggggagtgyggagttttattgggggyggggygaggtgttygtaggtttygtttattagtttttttttttttttgaggtttygtttttttatgtttgtttgtttttgttagttttagttaggagaagggagygggggagyggttggtagagatagaggagggtgtgayggygttgttggttttttatgggtttagagggygagatagatttygaaggtatattttttaggggtttgtgtaggtattttyggttttttagygattattttygygtyggatagggtttattttygagttaygg

SEQ ID NO: 11317 - DNA, 2906 bp, synthetic construct; identical to SEQ ID NO: 6859
  misc_feature 1..2906: note = Description of Artificial Sequence: Synthetic polynucleotide
  source 1..2906: mol_type = other DNA

SEQ ID NO: 11318 - DNA, 2146 bp, synthetic construct
  misc_feature 1..2146: note = Description of Artificial Sequence: Synthetic polynucleotide
  source 1..2146: mol_type = other DNA
ygaaagyggttttgagagygttttyggggttttttygaagtgtttaaattattagygtggttagyggtttygattttttattaygttttttttygygggtttaaagggatttgggtttygtaaatttttgtygagggagaygttygtygatttygtyggtttayggggygttttgtttttttyggggyggttttttaggtaggttgagagygaaygggatgagtatatttyggaygtttaagggggygtttagygtttygaagtygtygttttggtttgygtygtygtyggtttygttttttygggtaggttggaagygttaggtgttygygyggtttaygtagtagatggygtygtttagggyggygtagyggaagggttgtaggttygtggggtygtyggggaggygtaggggygygaygtaygggttttattgtttggttaggtagtggtatygggataygttgatttygttyggtttygtygtttgygtttygtygyggttgtygtttagatygaagyggtagatgaagtygtygagagttattatgtyggtygagygttygyggttgttgttgtaygggtatttttgttattygtygygtygygggttatatttgagtaggygatagaagagggagttttyggataygtagatttygtygtggtaggtggtggttttatgygttayggygaaggygtttyggggtagyggygttaygggggtttagyggtyggygygygggtygtagygttttaygttgagtaggtattygtygtttayggygtagaggtgatygtttagggttagtagtygtagttgygagygygtttggygtaggggttttayggygttttagttgttygtggtygggttgtagtagaagatttggtyggaygggygygygyggtygtyggggttygygggygttaygtygttygttaygaagaggtagttgtagaggaygtataggtygtagtttygygtyggygygttttygggtagtygygttagttygygttatttttyggtygtygygtggaagtagtagayggtygygttttygygygygttygygtttttygaggggttttgaggtyggttgttygygygttttttygtyggttygagygtygyggttaagaggtgggygyggtyggygygtaggyggyggygtagtagtaggtttygttttgygttygataggyggtygaatayggygggttygygtagtatttttagatagtggtygtttatgaagtagtaggyggygtygygtagttygtttagtygttgtygtttggtygygtttaggatttygtagtagttggttaggtttagttgyggttttayggygtyggtggygygttgygyggygtygggtagttgtaggyggygygygtyggttattatttyggttaygttgtygggtygtaygttygttatgygttygttgtaggygtyggygaggagtagtygtagygtygttaggtttattttttgtattygtagtaygtttygygaygygygygygyggaagtagtygttgygygtygttagtatygttttgtgygygygtagtyggygtttygatatttttagtattaggttyggtttttygtatatygtttygaatttygggggtaygggygygggtttttygggtttttygggggaygyggggtttttaagttaaaygygyggttygggggayggygtygygggttttttygggtaygygygttttttaggggaygygagttttttyggggaygyggygttygygttgtyggttttttattgtygttttattattygygggttatygttggagggyggggaggtggtygygtttttygtygttgaggygagggattgyggyggggattttttttyggagttgaagtatagggaygygtygagattgtagggtgtttgygtyggggaygyggygttttygttttygtttttttyggtagtttygggtttagtttttgggtagaggaygtagggggttatygygtgttttatggtygggttgtgttgygttgygttygygygttttyggtttygtagtttgtaggtttggttaaggtygagttttatttyggggtttttagttttatagttttttttggtaygyga

SEQ ID NO: 11319 - DNA, 865 bp, synthetic construct
  misc_feature 1..865: note = Description of Artificial Sequence: Synthetic polynucleotide
  source 1..865: mol_type = other DNA
ygggagtttttttttttygtgygtygttgttygggaygagaaattygtggggtatttaggattaggataygaggttttagtttgggtaggtggataagttgtggggttttatttttygtaggygatggttttttaaagtttgtataaatyggtttygtygggtyggttatgttygttttttttttyggygtgggaagtttttttaaaagtggaggggagygagtgtygygttttgttaatttygattgygtttgggtttttttygygtygggtttyggagtygttttttttgattttgygattayggtyggggattttgygygygttygggaatgtagagtttttagygtygygtagggttygtttygatttyggtyggttttgggtaattygtttygyggttagtttttattttaagatgtggttyggtttttattttygygggggggaaatgtygggygatttttatattgatttttttgygtatttagygtaaattaygaatttagagttggagttgttygtagatttygygtagttagatttygygtttttatttygtttygtttygtttygtttggygtattaattttyggtygaggaggggtygygtggygtygyggggggygggtygygtaygtttttygtagggaggatttagggatagttagggtttygggagagttygygygtatygttyggtttygyggygttagttatggygttygtgygtggtttygttagggatggggygaygyggttagagtygtaygygatygaaattygtattttggagtygtagagygygyggttttgttgtttagyggttttttggtaagtgaygtggggaagaaaygtagggygt

SEQ ID NO: 11320 - DNA, 865 bp, synthetic construct; identical to SEQ ID NO: 11319
  misc_feature 1..865: note = Description of Artificial Sequence: Synthetic polynucleotide
  source 1..865: mol_type = other DNA

SEQ ID NO: 11321 - DNA, 1463 bp, synthetic construct
  misc_feature 1..1463: note = Description of Artificial Sequence: Synthetic polynucleotide
  source 1..1463: mol_type = other DNA
ygtaatttggggttygtagaygygygtggatataaaaatataygttttygagatttatttttttygggttatattgtggggttgygttyggggtaygggttatgtttgaatttttttttatygtygygtttygggttygygtttygtyggtygttygtattgggtttygygtygttttygttattatatygagtygtttagtattttttttttttgaaggttggtttygttyggggtgttttttttttyggttttgtygtygttgtttattttttyggttttttttygtygggtygggtagggttggggygyggggttgggygagggygygttagtttattggagtttttttygggygtyggggttttttygggygggygtygygggttgtggggttggagttggagtyggggtagtggttgtygggttygggttgggttggggttttygyggygagtttgygayggyggyggygggygatttaggaagtgtaagggagagayggggtagggygygggtygggagyggggtatygagataatygggtttygggagggygatttggagagggagggygggagttaggggaggaaggaagaaggaaggaaggaaggaagtaaaggatggggygaggaygygygttttaggagtaagygyggagagttggggttgggggttgtagtygttggaaggaggggaygggggtgtttagagaggaggaggaggaggaagaggaggaggaggagyggggyggaggagygygggtygyggttgggaygttgggattygagagtygttgagtaygygttttaggtaggttttgggaagttygggatggaagtagttttttttttttygtttttttttttttttttttttttttttttttttygygtttttttttttttttttgttttttttggaygtgggttgtyggttgtagttyggagggayggggygygggayggagtttttygygggaggaggggtyggyggtyggatggygygygtyggggaggggtagygggtygygggyggaagyggygattttagttttygatttagyggttggtyggagggygagggttygggaggtygagggtagggaggtygggtttygtygtttttttggttttygggggtttyggygtttgygygtttygggatttyggggattttgtttygtyggggtttggatygggatttgggatgtgtgygatttttagtttgtyggtttttatygagggatttgtatttttggttttaagtttatttttttygagttagattyggttttttttttgttgtttgaatgatagtatgagaattygagggatatyggggatagtttatttygggtyggtttttttaggatagggttttaaatttatttttagygygggttttgygaygygttyggagtttttttygtttygttttttgagygtttygyggtttttyga

SEQ ID NO: 11322 - DNA, 1437 bp, synthetic construct
  misc_feature 1..1437: note = Description of Artificial Sequence: Synthetic polynucleotide
  source 1..1437: mol_type = other DNA
yggtttttyggagttgaggtttgygygattggatttaggggtagaatgagtgygtygggaattttaaaattttagattaagatataaggggagtygayggttyggaaatttygttgygggtgttttaagygygaggtygttygggtagggtygtttagggatyggggygttgggtgyggggtayggggttttatttttygygggttggggygygtagygygyggtttttttaagaaagttygtygggygagtttattaaagtttaaaaattygtygtggagaagggygygggggaagaggagagagggagagygttgatttaggygagagagaggggaaaggttyggtyggaggtyggygtttygyggtyggggtyggggygagtttayggtgggyggtggggattggttgygygttttttyggagatygygyggygggygggggagggggttggtygggttttagttgaggtyggtttyggtttygtttttygtygtyggygttygttttttttttyggygttygtttttygtygtygttgtygtygtygtygtygtygtggygtattygtyggtygtagtgaaaaggyggaggyggyggttttttyggtttttattgtttttttygtygtattttttttttatttttygtattygttaaatttgatgtgattttggttygaygyggaggttgttttttttattgtttygtgggtttttygttattygtttygtattygygagygtatygtttttygygtttttttttatttttygyggggtyggygtygygttygttttygygttttttttygtygttttttttttygtattatgagtaatttgaagtyggayggygagtayggyggtagtatyggtatyggtttyggygygggtttyggyggygttttggaggaggaggtgggtttgtggtttygggatttgtygggtgaagygtaygttaggygggygygggagagggygagyggggtttgtygygtttygyggggtyggggtggttatygttttyggygttttttygtygttgttttttygttygggtaggagyggttygtgttygygggygggagygtgyggtttggattgtttygtyggataggtattgttttttygttttttygggttygaggygggtygygygygtyggtygtygttygggygtttygyggtgggygagatgygtygygttygttttatgtttgtygttygygygttttttgttttttatttygtagtygttygtygttttttttygaggygtattttttgygtggttaggatttygtttyggyggtayggagyggagygggattagtayggttygagggyggtatttttattttattgtttttttygttttgatttttttttygtgattttggaggtttgggtyggtyggtttttyggtttttgyga

SEQ ID NO: 11323 - DNA, 717 bp, synthetic construct
  misc_feature 1..717: note = Description of Artificial Sequence: Synthetic polynucleotide
  source 1..717: mol_type = other DNA
ygaggagaaaggtygttaaayggagygagagtttttatttttatttattttagtgttatggtggtatatgtygattattatttgygaggttttttygtagatttgttttttyggtttygtagygyggaygattygtagygttttayggttatggttttttttataggggtgagtttgtttttyggatgggtggtgaagggtgattttggatttgatttttgaatygtagyggtttgtayggggatygygggygtgttgattttatgtgtttygtttagttgttgtagagtyggtttatygtayggtttttgygggaggaggttattttggagygattttttatttggtagggagatttygaatttattgtgygttggttgggtttgttgggtttgggttatttygygttgaatygtaggaaggtgtgagagaaggggaggggtggagaggggtttggttyggtygyggygaggtttgtaagaggttgatttygagttttagtaggtgyggtaygtgagtaygttgttgtyggygtttttgggygtattgggygaaggygaygygyggttygtgggtgtagygttgggygttttgaggaggtttttgttgyggtttygggygtttgtgyggtttttgagygyggagttgggatygygttttttttygttattggaygaygtgagtaaaygtttygttttygggtttygtttttgtygt

SEQ ID NO: 11324 - DNA, 1713 bp, synthetic construct
  misc_feature 1..1713: note = Description of Artificial Sequence: Synthetic polynucleotide
  source 1..1713: mol_type = other DNA
yggtagygaattaagttgygtaggygttttgtttttttttttattaatatgttygattggtttaygattgattatattattggttygygtaattttagtaggtttttgggtttgtagttgagtygaagtttttttttttgygtagyggggyggggtaygatggtggyggggggggaggggggaattgttttattaygtatgygtatyggggatggygatagggtttttttttttgtttttttttatagttttttttagtyggggggttgagtgtttttttttttttttttttgttttttttttttttttttttttatygtttagyggggtttttaattgatagttgtygtygggtttygttygtgtatygtttttttttgttygtgtttttygtaggtagaggggggygggagggggtgtgagggagaggaggagtyggagtygtygttgyggtttttttyggggaggggagaggagaatttttttttttttygtttttttttagtttttygttggttygggagggggtggggygtygaggtygyggygattyggtagggtttggtyggtgaagagtaggygggyggggtgyggaggggtgaggtyggygagggtygtgygygygtygtygtygggggggaggggagaggagggtatttaggttttttttttttttttttttttttygygygttatgtaatttygtttygtyggyggtgagtttaagattttygygygtatygagtygagtyggyggttgaggagagttaggttygatgtggygggggttaygygtygyggtygagtygtgaggaagyggttygygtttaygygttttttagtatttygagyggttgttttatatygtttagtttaggtttgtyggggtatgagtgtgttygggaygtygggagygatggagtyggttggggaggaagagyggtygttatyggyggtygaaggagaggaygaygaggaggaggtggtagyggyggtttagattttagggtyggtttayggaaggagtgttttttygttggaggaygyggaygattaggaggaagagatggaggygatggtgatyggaggyggttgttgtaaggagtaggagttgatttaygagttatagtagggttatygtattttgggygagtttttgtaggagaagtatyggggttttatygttttttttttgtagtttttggggggygttgttatygyggaggaggaggtggyggaagggtygygtagygggggtyggggyggtygygttttttygtagtagttyggatagggtatgtgtttgttgtagatggaagagaagttygttagyggttagtaygggggtattatygagttygtggyggattttaggttgatgttggagaygtgttatygtttgtayggagtggattattggatttttaaatagggttagaagttggagatgatgttggagtagaagttagygtttttttttyggtaagygagttyggttttyggtgggattgatagattgatataaatatatatttataygtgttygaggatgggttgggttaggggtttgggggyggygttgataggtgttgagtyggtgttggagaagttygggaggaggagyggygttgggyggggatyggaggggtgtggtgggtgtgggtygaattyggtttgygygtagattgagaaggaaattygagtttgtagygt

SEQ ID NO: 11325 - DNA, 699 bp, synthetic construct
  misc_feature 1..699: note = Description of Artificial Sequence: Synthetic polynucleotide
  source 1..699: mol_type = other DNA
ygygygaatygttttattttggatttttggaatygtgtttaggtattygggyggyggggttygtttaggtygygttaggtagttttgggtyggtgggtgtygggtttttttttttttygttttatttggygygttygtagygtygtygtygtygtygtttttttttttagygggygttyggagtatttygygtygygtttttttygtttyggttttygttygtyggagyggggtttaygtygttggtagttattaagtggttygttaaggaaatgtaggtgagtgygtgaggtygagyggtagttgttggagaygtggggtgtgtgtttgtgagtgygagygagaygaggagggagygttagygagygagygagygagtgygggagyggtygtttyggtttttygtttagtygygttygtagtyggyggtyggagygygtgggggtagygtttygtttygatagagtttygttttttttttgtygtttyggttgttttttygaggagtygggagtygtttatyggtttttttaattttgygttttttttttagttygagttttttygttgtttttttttttttttttttygagtttttttttttttggygyggygtygttagttagtttyggyggggagagtgtaggtattttgtttttagaataattagtaggatttaagtyggtttttygagygygt

SEQ ID NO: 11326 - DNA, 1191 bp, synthetic construct
  misc_feature 1..1191: note = Description of Artificial Sequence: Synthetic polynucleotide
  source 1..1191: mol_type = other DNA
yggagygggygaggayggttagtttttgtagtgtttaggtttgtayggaagygttttggtataatttagttgaggatataygttttttttygygtagtyggagggttgaatagtaaagtatttttygggggaattgtgtgttagygtagtttggagagagtaggtttagggggtagttttattataggagataggataygttttagtttgggtaaattttyggttttttttggttttaagttagtagtygtygttygygatttttttttttttttygtygttatttyggtygttttgttagtttygaatttgttygygtttggtygygyggttttttagtttayggggttggyggygyggttgggatgggatygatgtggygtatgygtggtggygttattaggygygggagttgttgyggyggggayggtgttgyggayggtygagggttaggtygtttyggtygggtttgtggtgggggtagttttagyggyggyggyggyggygtgggttggygaggtygygyggayggygttygatagtagttggaggagyggtttgtygatttggyggygagttatttggaggttattygtgygygggaygagtgggatyggtagaaygygyggttgygttaggagaaygttyggttgyggttygagaatyggyggttgaagygygagaatygtagtttttttygttaggttttgyggtttttyggygaaggyggtaaygggaygttygyggaggtaygtygggtttttgaagaggttagtaygaatyggagggttagagatagyggtygagaggaygagtygggtagttttagggttttgagggttygatttgagaagttggaagttatgtatygtygggttttgttgtagttgtatttygagtagyggggattaygttygagyggggataaggaggagtagtttttataggaattygatttyggttttygttttygggattyggagttttttgggttttggttgtagtygaggtygtagtyggtgagaggyggagtttygagygggttttttttttttygtttttagttattttygatttygygtaygttttggttygttttttgttygyggatattttggattayggtgttttttygtttttattagtggatattttygggtggygtttggttattygtttggtggaggtyga

SEQ ID NO: 11327 - DNA, 536 bp, synthetic construct
  misc_feature 1..536: note = Description of Artificial Sequence: Synthetic polynucleotide
  source 1..536: mol_type = other DNA
yggaygggatgtaaagtttgggtgagayggttatyggaygtttattggaagggtgyggggatttttaygtygatatttygttttttygttttagttygygtatttatygygtaygtagagtagtgatatggtygaggatygggtaagtttttgtygygttttagtygygtyggatygttttttttttttttttagtaggtgtygygattgttttygttatyggttttaygggtttggtagttttttatggtttyggtygtaggtagygtttygtygttgtttyggattygttttaaattttatygtttgagygaatttygggtagyggtgagtatyggtyggtaggttggggattgggygyggtatagygaygttatygttgggaggtaggagttgtygggattttttttygttattttattygggattygygygagygtttgggyggagttaattygtggtgtttygttttttagttaattaatttaygtttagtttatygatttygttttttttygygagtaygtaggaggygg

SEQ ID NO: 11328 - DNA, 728 bp, synthetic construct
  misc_feature 1..728: note = Description of Artificial Sequence: Synthetic polynucleotide
  source 1..728: mol_type = other DNA
yggttaatayggttaggtttttygggygttttaaggtttygttaattttggtaaaggyggtgttgaggtgaattaygtggatttgaaaaggataygagggtaggagagggttaygtttttggtttygtttygtttygtttttttgttttttttyggttagtttygygtttatttyggtagggaaayggtggttttttatagtgtgtttygagttyggaygatttgtagttttttagtgtagatgtagttgtagagttyggtattttygttygggatttagagttatttttagtttaggaggtagggttagttgtattgygtagggagaggtaagtgagtyggtttygttyggtagggttagtttaattttygggtaggtattgtygygayggtttttttttttgygtttygttttatttttaagtttyggyggggagatttttttattattgtggttattgttgygtaggygtagttttgggagyggygggagttggaagtttaggagttttagggggygtagggtygggtagaaggyggygagttgggggyggatatttatyggggattggaagyggttygygtaggttggggatattyggggttagggygggtygtttggggtgggagagtatagtgaggaagtttgaygtttaggttaggaatttagggaattygggtagaaaaggtgagggggtgggayggtgggyggygggtgggaygttygg

SEQ ID NO: 11329 - DNA, 1431 bp, synthetic construct
  misc_feature 1..1431: note = Description of Artificial Sequence: Synthetic polynucleotide
  source 1..1431: mol_type = other DNA
ygagttaygttgtttttttgggagtttatygtygaaattaaagttatttttygtygggagtaggtaaaaggatgaggggaaagaaaattaaygaattatttttaggaattgaygtttttgttaatgattyggaagaaataaaygtagttttttygtttyggttttgggttagtttaygtgatttttttgggaggttaaagagtatygttttgttttttttgttgttaagttaagttattttaygyggygtagtttygattttttyggtttygygtagttttttttttaaattyggagaataagttttatttttttygaaatgagaatttttttattggttygaatgtgtagtttattaaattaaaggggyggggaatttttgtttttattggtttttttttttygtaattttygttttttgttgagygagtttagtttttttttgagtttagagygttttttattttgtygggyggtttttgattggtggaagtgaggtaaggttgggtttygttttttttttygttygttagtaggttggagtyggggttagttttggtatttttttttagttagtggttaatttttggtttagtggggattgtgttygtttttttygtttttttttagtttttttttygttatyggaaygagtttygygtttggtaggttgaggaggagtaaagaaagtaggattaaagagaaggaagatttggttaggtttgggtggygtttgtagtgttagaaagggaggyggtggyggyggyggttgygattayggtygygygggaygtgaggttygagagtaatygaygggtagyggyggtygttttagygtttygtatyggggtygttagttagtagaaygygagtttttgtggaggagtagggtyggygygaggygagattygggagygtgagyggggtttttggggygtygtygttttttttygtttyggygtygggggttgtagttttggttttygtttttttgtygggttagtttgtaggyggagagagtyggayggygttyggagygyggatttygttttgtggaggatagygygtyggttgyggttttttttygattttttttgttyggygtttyggttygggtygtttaggtgtaggtgygtgyggtttyggggtttggggaygtygtagttyggttyggggagggggygttaggtygggagtygtagygygggagggaygagttygggtyggyggggggaggggagygggaagygtttttgttgttggygatygggattttttttyggtataggggaaaggyggggaagttattttttatygggtttgtgtttttgagaggattttttgatggttgygtgaaggggagyggtaggatagtttttgyggttygtggagyggtyggagttagggggtgggggagggaggatygatyga

SEQ ID NO: 11330 - DNA, 588 bp, synthetic construct
  misc_feature 1..588: note = Description of Artificial Sequence: Synthetic polynucleotide
  source 1..588: mol_type = other DNA
ygatttattttgygagttygggtgggagttttaggtttgtaggggtygygtggygttatttttygatygygatttttaatggygagttygtgyggtttttagtgygtygtttttttttgygggtyggtggggtttgygagaattyggggttgggggygggtttggtagtggygggyggggatttygggtygggatygagaagygttttygaayggtagttatattggggttgtttagtggtttgagtttttttttgttttttttttatatttttttgttttggygyggggggttttygyggygtygaggtttygttgygtygtttattyggagggaggagggtttttgggaggygtygygtgggggygyggttygtggagttygggygttagggatyggtyggggtyggygtaygggtgygttttgggttygttygggtygtgggagttagggagttagggagttagggatttyggttttygtayggggtagataggggtagygygggygattyggagygtttgygttttygyggttttttttttaatagggtaaatttaggggtttgatttygygtttgttttgygg

SEQ ID NO: 11331 - DNA, 1203 bp, synthetic construct
  misc_feature 1..1203: note = Description of Artificial Sequence: Synthetic polynucleotide
  source 1..1203: mol_type = other DNA
ygtttttttgaagttygttttttagyggtttggagttyggggygtggtyggttygaatttgttttttaggtttagaayggagttygtagttygtaattygttgtggtygtagygggtygygtttttygttttygttttaggagyggtygaggatttgtttagttgygggygttaagttttggtygtattttttttttyggyggagggagtyggttggygttgyggtttttaaggygygyggaygtygyggagggtagttagtygygygggagygggtagygygygygagggygttgggygtygtygygaggyggggaagygyggggtygyggyggtgygggttttagggyggyggtygtygtygtygtagtagygtttygagyggggagggtygaggaggttygaygagttggggatggagagtatygggttttttattgttttagagygygtgtgyggttttgggygygtatagtgayggtgayggtatttttggttyggtagygtygaggtygtttygttagatagttagyggtyggyggtaggtygggttatgagyggtaggggtygggtygggtttygttgattttggtttygygyggtagtttttttagttttygtttyggtttttyggtatgagagttygttygggttyggggttgyggttgttttagattygtygtaygttggygygtttygggttygyggagtygyggtgttgatatttgygtygtattgygtygttygttygttygttgtgtgtttygggggygyggttatggaggtggtgggtgatttygagtatagtaagagggatttygtgggatayggggttttygtygtggtttttygggggyggtatygttaggtgagygtyggtyggggygaggtygggtttygggyggtaggtayggggttaggtggttttgaaatttggygtagtygygagtygagattttygattyggttagtygttygggtatgttattgtgygygtagttygtttygtygtttgttttggttttgtgagggttgttgtgaggtttaagtttttggtagygtttygtttatygatyggttgttgttgatttttttgtgtgttyggggtttatttygyggttygttygtaggagygtttgtatttaggttattttggatttaaaatagayggtattgtatygtgtagattygagggttgggygt

SEQ ID NO: 11332 - DNA, 5370 bp, synthetic construct; identical to SEQ ID NO: 6909
  misc_feature 1..5370: note = Description of Artificial Sequence: Synthetic polynucleotide
  source 1..5370: mol_type = other DNA

SEQ ID NO: 11333 - DNA, 1691 bp, synthetic construct
  misc_feature 1..1691: note = Description of Artificial Sequence: Synthetic polynucleotide
  source 1..1691: mol_type = other DNA
ygagaataaaygttagtttttatttttgtggaaygtttaaygtagttggttgggggaataygaggttttgtagggagygagtttyggtttyggtttgayggaatataggygaygtaygtgaagtttaggttttattttagygtaggygggtttttagygatttatagttgttatatattyggttagygtygattttygaaggygtattttttatattttatttygagtatyggttttatygttagggaaggtttttttggatagtaaggtyggggtttaggatttgygagatttattttattygtttygttagagtttaggagtagtaataggtttgygtttttttygggyggygttttgtagattttygaygggttaagggtgtttttagtttagtygtgygtttaggtyggggagatgggyggaggattggggttttygatttttttgatagtttttgygygttagaaattgagtagatayggggttygygttatttygttygtygtttgttttatttygygaggttgygtttttattygggttygggagggtyggttygygtttygggtatgaatggggtttttttttttaatagyggggaaatttygttatygttttttatttyggttttyggagttygyggtggygtaggtttgtttagtaagtttttgaatyggtagataaaggggtatyggaggaaaagtygagygtttttttaaatttatyggttatttttttttttttaaaataaaggagtttttygtygattttygttttttttygtaaggygygtyggtatttyggggagyggttatttyggggtattgtttaggtttttgggagygygtygtattttagttygagygtygyggggatagttggygatttgtatttataggagttttaggggygggtggagygttygggygtttygagtygtyggtyggattttggagggttagygygggattygttttttygtagaagtttgyggatttygygttyggttygtygagttttgygtatttatttygtygygagtagygtaatttgtggyggygtygygygttyggtygygtttygaatttttttttagtyggtagttttygagtttyggtygtgyggyggtygaagagggttyggygtttyggagtagtygygygtygttttygggtygttttygtttygtygtygtygagtttyggagagagygygggygttggaaagtttyggtggygaatggyggtttgagggygttgyggyggyggyggggygggggygttggyggtttttygtttttaagygyggagtgggggygttgaggygggtgyggyggyggyggyggyggtagygggagagggygggatagygggagggattggtayggatagtgatttttayggggagttgtygygagygygyggattttagttaggaggatygttaggggttygttttygtygtyggttttttttttayggtygtgggaggggattyggygtattattyggtttygtttttgygtttygggggagtygygtttygaattagttttttttttaygagggtagggatttyggttttgtttttttttygyggtttttagtggggattygygttttaatttagtttttgttttayggtygggggattagygtttttattaagttygtttygtttttttaygt

SEQ ID NO: 11334 - DNA, 1223 bp, synthetic construct
  misc_feature 1..1223: note = Description of Artificial Sequence: Synthetic polynucleotide
  source 1..1223: mol_type = other DNA
yggaatgttatttgtttygattgttttygggtggttataggygygggggaaggygtagggttaggggygttgagggtgaaayggtttyggygttygggyggyggyggtggtygtttgyggtagtttagttgaaaygtagyggaaattgtagttagttayggggttgygggaggtaaggtaggaaggtggygttgtygtygagygtttggagttygagygtttattatggyggtaagggtaatggtygttayggggagygagtaygttttttygygygtataygtygtygygtygggttttyggggttygttatyggygtygttgtygtygtygttygtttttttatttttttttaygggttgtagyggaattttttttttagatatygtttttaagatggyggttttttttttyggtaattttttttatygttttttgtagtaggygtygagtygtygttattttgtttttygttttttttttttttttatygatatttatatagygaaaatyggttyggtyggtttgyggtttttattttaygtttgtagttttygttttttygttaggttttatttyggygyggtgttttaggtyggtygyggagtygattyggggtttttygatygttttyggtataatygggygatttttttttaattttygttygtttayggagygygttttygtygtygttyggggtagtygggttttttttygggtttaattgyggttttttyggggtttgttyggygtygygygttaygtygttyggtttagygygggagggygttttgygggtygtygattaggtygagattaggtygttgtgygygtattaggtttygyggtygyggyggtattygggatttatyggayggaygtgygggyggtyggygayggtggygggtgttgtaggtyggtttttttttggagtattgggtygggtttyggttggtggggygggyggagggagggaggaggggtygagttyggagttgataaaaagyggtttagtttttyggtaygggttygtygttagtaygttaygttatygttygggagagagatttaggaaaatgyggaagggtagataggttttttttttygttyggtgggtttttttggtatttygtgtyggygtygttttygtttygygatyggggagtttagtggtttygttgyggyggggttttyggyggtyggagttttygtgatagygt

SEQ ID NO: 11335 - DNA, 1103 bp, synthetic construct
  misc_feature 1..1103: note = Description of Artificial Sequence: Synthetic polynucleotide
  source 1..1103: mol_type = other DNA
ygaggtaygtattaggggggatttygtattygtagtttttygtttygtatttygtagttygggayggtttttggttttyggttttagygaggtygtygaagtygtagtatttagttttggaaggttaggtagtygggatygtagggattagtttygagyggyggyggyggyggggtagaagggtagtygttttttygggatttaggaygtyggygggygggaggtatataygygygtataagyggaaagaaagygggtttattgygtggggatgttygttygygtagttgtttyggyggyggyggtygttgtttgtatygaggtygaggygyggyggtggyggyggyggttgyggattgagtttttttygtygggyggtggatgtagggygygggaggggygygaggggaggggtgygygtttgggaggyggggagggaaagaggggaggaagtaggagygygggggygggygyggttagttaggggyggggyggggygygygyggggtygggttttgtttattgtayggaggttgtgtgyggggygygygygygggagayggtyggaygggygtggggagaggggyggtttgttaygtatttygygygtttaygtgttttygttattggagagggtygggtaygyggagagggtggttgyggggaygyggtggtaggttttttttygaggatyggttyggattygaagatygggaggagggygggtygggggygtttygggttttttttttygygtagyggtttttagaggtttgygggagttaygaattattgtaggyggttggggttggggaggtgggagtaataaagatagttaagtgagggtggygtttygttttatyggggttttygttaatttgygtattttttgaaaagyggtttygtttyggggtttaygtygtttyggttttygatttyggaattyggtggtttgtagyggygtygaaaggtttatygaygatttttttttttagtagtaagtyggagggagttaaataagttttatttataattttagtgttattatttagagygttttaaygttatttagaaagtatygatggtaaagyggygygtggygt

SEQ ID NO: 11336 - DNA, 616 bp, synthetic construct
  misc_feature 1..616: note = Description of Artificial Sequence: Synthetic polynucleotide
  source 1..616: mol_type = other DNA
ygtatttaatggygattygatagttttatttggtatyggtgttyggttygtggggygggtggagggtygggtagtygtagggygygggttttttygggtggayggtgttyggtygggtygggtygggtyggggaggtaggygyggggygyggggygyggtgtatagyggggagygygtagggaggygaggaggygyggattgggtttygttygtaggagaataaataggtttttttyggtygttyggagtttygtttttygttttttttttyggtyggtttttttttttgttttttttggggtaggtagaggygtttggtatatttygtatattttttygttagygtttttygttygttygttttttttyggtttygtttygyggggttgttggagaaattaagtttggggttttttttgtygagtayggggygagttttagaaggttttgtygtgatggaaaatttttaggtaaattttttygggttygtggtttttaggtygggaagttttygttaygtgaagggttttygtttttagttgygygatttggtttyggtatagggttaaygatttttatagatgttgtygggttaatttagtygagaattatygt

SEQ ID NO: 11337 - DNA, 206 bp, synthetic construct
  misc_feature 1..206: note = Description of Artificial Sequence: Synthetic polynucleotide
  source 1..206: mol_type = other DNA
ygttaaaggygaygtgtyggtygttagttttaggtygagtttygagygtttgtaggaataygtttttttattyggygygggaygtagagttgygagagaattttgtttagygyggatttaaygttagggygtygtttagaggttggtttttgtttyggttttattygtygggagattatagagttgtttttttagtygttygtygt

SEQ ID NO: 11338 - DNA, 1141 bp, synthetic construct
  misc_feature 1..1141: note = Description of Artificial Sequence: Synthetic polynucleotide
  source 1..1141: mol_type = other DNA
ygtattaattggygtgtgtaggygttgttgtttygygttgygtayggagaagygtttygaatttatygtaygatgyggagttaggggtagygagtgagyggyggtttttagtttttttttgttttttttttgttttttttgggaatggtagggggttttttatgataaatgttygtaaataggatagggttyggaygattttagagtyggygttttttttttatatttttagttttagggtyggattygttttygyggttgttatygtttttgtttygggygtttygyggggattatttygttaggtgagygtttttaggagtttttttgaaatttatttgygtgaagtataagtttattagygtgagggtgaaaaattgtaggtatatagggaagtagtagagtagttagaagaygaaggggttgagygaattggtygttaygaagtttttgaagtagaaggagaagaggayggttygtagggaggtttagaagaggtagagaaagaggaagaygttttggtagttgagtygtttgtggyggtaaygtagtattagttagagttgtaygtagatgaataygaagagtagygygtagaatayggtgtagaygayggtgaggttaagttttaygtaggggggtayggtyggggttagygtgggyggtagygagtygttgygggttgggttttayggyggggtttttatygggtygggggygttgtygygyggtyggggaygttygggttttatyggggtttayggtygtygtygttttygygggggttttygygtatygygtttagtttgtagtttygagattggaggaaagaaaataagtygtattttttttttyggtattatatgatttattgggayggtttttgtttgygattggtagygtygygttygtygttttygygygtygatyggtttygygygttttygtttyggttygygygttttygtttyggttygygygtttyggttygttttttttygggtatygygygttttygtttygygaatttyggttygttttattttygttatygygygttttygtagtgygygtttttagagtygtaygttttttttyggttttttttttattttyggggtygygygtttttagattgygg

SEQ ID NO: 11339 - DNA, 1819 bp, synthetic construct
  misc_feature 1..1819: note = Description of Artificial Sequence: Synthetic polynucleotide
  source 1..1819: mol_type = other DNA
ygyggaygtaggaygtagagttttagtatyggtagttaagaggaygtaggaaagygtaygtatttataggtttagagaygyggaygttagatttaggtttggatagagtagtttygtaagttttaatatattttgtaaatttygaagataggagagagttaaaatattttttttgttygtaygtaggttttttttgttttttayggttygattttgggaggyggatgaggatatttttaggtttggatgggggttatgggatattttattttagattttgttaygatttgggttgtgttygttyggtgttttyggtttaygggttgtataatttggyggtttygaaattggygtgggggaggggagggttgtttattygagtaggaygyggttgtttatttagtyggaggtgaggaaygatttttttatttygttgtygggtttaagyggggttygagagtygtyggggagagttaaagggaggggatygatggattttttagagtgaaattgtgygttttggagagtttygaggtagtttygygagttttygaggaggtygttgtygtttggtaaatataaataataataaaaggaaggaaatttaggyggtagtgygtagaaygagtatagggttttgtgagggygygtagggtttaygygggtgtttttaatagggttttttaygtaggyggygygggtayggggtygggggygygyggygtttttagygggagggygtttggattaggggtttygtttttttttagygtattttygtttttttttagygtattttygtttygygttaggtttattygtagggttttttttagtaygttygyggtygtagtagttagtttagtatttattttygaagttygaaatgattttatttagttgygygttgatygyggggttygatatgatggttggtgggtagygggtygygyggagggtagyggygaggaagygttttyggyggggttygggttttgygygttggttggggygtygygttygygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgttagagaagttagggaygggygaygt

SEQ ID NO: 11340 - DNA, 1813 bp, synthetic construct
  misc_feature 1..1813: note = Description of Artificial Sequence: Synthetic polynucleotide
  source 1..1813: mol_type = other DNA
ygagtttattttattaaygttaaattygttagtttygttagtyggttgtaggatygagggagggtgtaaaaggyggggggyggagggggggtagattagattaggygaaatttaataagtttttagttttttagtttaaagtttttattatygtygttattaaygagttattttaattgagttagtatygtygtttattygtyggttygtyggaatygygtttattttttgtaatttygttyggatyggtatttygttttttyggttyggttttttttttttygtygggtgtaaagttaaagatttagtaaggygaygtgaatttttgtatgtagggtatataygtygttttyggtttygggagtgygggggttygyggygyggagggaggttgggygttygggttttygggttaaggtygtygygygtgtttatttatgtttyggyggtttyggtttygttggtttyggygttygtttagatttyggttttygtygttygttygagtttttaaaggtgttgttgyggtaattttatggygatgagtatttgttaaayggygagtygygagttggtygttttagttyggggggygtyggggttttygggygygyggaggyggyggygagyggygggygtttyggtyggtttygygtttttygttygattttgtygttttygtygygttatygatttatggagagagatattaagggggaaaatggygttttyggagttygaggagttttggagtaattatatttatatatataygttygtaygtatatatattygtatatattggtatataggygygyggygagttttgttaattttagtaggagttaaaaaaaattttatatatatatatatatatatatatatatatatattttygttttttygattaatgttttttttttttttgtttttttttttttttttttttttttttttgtttttttttaaaggatgggttggagygttaaaaaatgttggtgggtttgggttygtaggaggyggygygyggagggygagggygtttttgttgagttgtgtagttyggttygttgagttyggyggttttgttygttygttygttygttygyggtygttagtgttgtygtygtygtygtygtygtygtygttgttgttttatggtygygttygtttygygttttygtygygtttygtygtygttygttygygttttyggtgagygttggagtggggtygggttygtgtgtttgtttttygygtttttttygaatttyggatttttagtgaaaggaagggggagggygygggygyggaagggaggtggatyggagyggtagygyggtttagtygaaygggtatygatygttatttygygatttttttygtagggggygtyggygtttaagttgttygttyggagggtttagagtygttttttagattagagtygggggaggygtagttagtagygagttttgagygatttttttttttattygtttttttgttttagtgaatttttgttagttgaagggagyggggtttttgttyggggaaaaggaaaatagttygtggtttgggatttgggattttttgtygtttttagygtttttttygtttttyggygtttttgyggtttagtggtttttgygygtyggagttygtygygaagattgagyggtygyggggatygtygygggtttygygygtatttttgggtttaatattgttattatttgatataataggagtagtgtygggggggtattgygygtttagaygtgagttgtgataggttttygaaattgggygt

SEQ ID NO: 11341 - DNA, 1872 bp, synthetic construct
  misc_feature 1..1872: note = Description of Artificial Sequence: Synthetic polynucleotide
  source 1..1872: mol_type = other DNA
ygtggatagaaagtaygygtaaggggtttyggggataggaagttattagtttggggagygggaggtattggatattttttygtttygyggtyggtaygggtgygygtgyggtagyggyggtaggggtttttygttttgttyggggttttyggtygtgtttygtygttygggtygygttyggggttgattygtattattttgtaaggaagtgaaygtttygtaygggaaggggaggygtttgygtyggtygtygygtagtttyggggaygttyggggttgtygtyggttyggggtygtagaygatygygggaygygygagtttttygtttttttttgttygtygtttttttygttatttttgttygagaggagttaaattyggtttttagagttyggggagggtggggatattyggtgtttttttygygttaggaggaagggggagggyggagaggatttttggttagtttgygtygagtagatttaaattaaaataaaaagattaaaggagtagyggtyggggyggtagyggtttttaggtygggatattyggggtggtgygttygggtttgygggggttgygtyggygtyggggaggyggggggagygggagygggygaygyggggaaggggggagttagggggagggygtyggtyggaggaggggyggattygttygttttagtygagtagagtatagtygagtygagyggttygggygggggtygatttyggttagygtyggygtagagagygggyggaggygtaggttatgttgyggttggtgtttatyggggttygggttatygtggatatgtygtaygttygttattttttggatttttagggtttygttattttttaagttatgtagaagttggtggtgattyggttgagttttaattttygygaggtygttattttgagtygggattgttyggtgtygtttttyggggayggagattttttygttyggaatyggtgagttyggygttttttaattttaygttttygttttygtttygggttygygtygygtygygtygttttygtagtttttagttygttygygtgtttatatttyggygygygttygggygtatagtttgagtttgygagatttygggaagttgaattygtygttatttggygaaggygaatgtgatgtgattgttgttggtgtgaatattygatgttatygaaygtttttataattgagggttattttaatttgggatttttttttttttttttagtttttttttttttttttttygtttttgaaataaaatygaygggatttagaaggggaggtttttygtygggtygttygygygtatttatagtttttgygttgatataatttttagggtggagygggagtagtttggaygtaaattgygaygtttaggtaaaygtgtttyggaggaaggaggttgggattyggttggttttttttgttttttttaggttggtagtygtttygtagtggyggagtttgtygttggatgtgtgggtgtgtatttygtyggtgttgtttgygtgttgttagtgtagtgtgattgttgtttgttttttgagtgttaaygatygtygygtggygygtgtttygggtagttgggttagggtyggggtgggggtatggttgtttttgtyggtaygttttgtagatatttaggtgatatygggttgttgygagattttttggtttttttatttttygygttttttatygtygtgttttygttttatttatttttagtaattggygaagtaatagggaggaaayggattttattttttatyggagttatgttygtttaggtttttgtttygtgggtttttggttgttygatttgattggtaaggygt

SEQ ID NO: 11342 - DNA, 652 bp, synthetic construct
  misc_feature 1..652: note = Description of Artificial Sequence: Synthetic polynucleotide
  source 1..652: mol_type = other DNA
ygttttttyggtggagayggygaygtggtttataygygagtttttygtygaggatgaattattagttagttygagttgttatattttattttagtatagttatygygagagtttyggggtygygtyggygtgttttaygtaygygtagtttttygyggggtyggttagtggtgtygtygaggyggggggagtggtygtygygtyggtygagtgaggtagggttataygtaggygtattygygygtygatagttygtgtatygtgtggtagyggttgtgygygtttaggaaggatatttygttttygtaggtygtygggyggtagtagggttgygygygtattygttttygtygtaggygtygtygttggygtagtygtygtagttygaggtygtagaygygygyggtagtttygtaggygtttgygtagtagyggaatagtatygtttygtyggaygygtagtttaggtttagttygtttaygygtatttttagttygygtagttygtaaggtygygtttttaatygygtaygygygygtygtygtyggggtttygttygayggygyggatttgggggtygtttagtttagggygttagttygygtagttttatygtattyggggttttttgtaggagtgtayggtttgyga

SEQ ID NO: 11343 - DNA, 722 bp, synthetic construct
  misc_feature 1..722: note = Description of Artificial Sequence: Synthetic polynucleotide
  source 1..722: mol_type = other DNA
ygtttttygtagyggtgtagygyggtygtatttygtattygttgtttggtgtygtggtygttttttygggtagtttttygggttyggygttggyggtagtggygagyggyggagattttttttyggggtagtyggtgttygaattgatygygtagttgttgygygttgagttttattttgyggyggtyggaygtttyggygtagggggyggygyggygggygyggtgttgggtatygataaygtgtgygagttggyggygyggttgttttttagtatygtggagtgggygygttaygygtttttttttttygagttgtyggtggtygattaggtggygttgttgygtttgagttggagygagtttttygtgttgaaygyggygtaggyggygttgtttttgtatayggygtygttattggtygtygtyggtttttaygtygygtttatggtygtygagygygtygtggtttttatggattaggtgygygttttttaggagtaggtggataagttgggtygtttgtaggtygattyggtygagtatggttgttttaaggttatygygttttttaygttyggtgagttaygtttygaagagggtygygggatggggggatttaagggaggttaggaggagggyggtttggatttagatttyggtttttatagygtttygttygttttttaggtttggggttttgtaygygtygtgagtgaaygt

SEQ ID NO: 11344 - DNA, 858 bp, synthetic construct
  misc_feature 1..858: note = Description of Artificial Sequence: Synthetic polynucleotide
  source 1..858: mol_type = other DNA
ygttygatttaggtttygagtttttttttygattttttttagtttaaaggttgtattygttttaggtttttttagttyggttttttagtttttttttyggttttttttagtttggggttygggtttttttttyggttgagtagtygggttygygattttttttatttttttyggttygggttttyggttttttttagaggtgaggtaggggttatttagaatttygyggttttttattttttttaagattattttygttttagttttttgttttttattttgtttttttaatttgggttttygattattgtttygattttattttgtygttagggattattagtygtttttttygygtttaggggaygygtagyggtagtttttgttgatggtaagggtttgygtattyggaaattttagggtttggggygtggtgyggtttttgyggttagygggtttygtttgagttttagggttttttygttgttggattaygttttttataggttttagggtygyggatgaatttygatttttgttttttttttyggtgttgtggttattgagttaagtttggygagtygaggtgattygggtygggttgygggaggagttygyggtgaggtggtttygygttgtygggygaggtyggtttaygtggagtygggagtttgaggtttttgtaygygggagttgyggaygatggtggttagtgttattgtttaygaygttattgtggtgtgtgtgtgtgagagayggagattttagtgtgtgtygtgggtgttgtttgatyggatttaggayggtgagtaggggyggggtttatygtgtgattttggtttayggtgaygtgatygt

SEQ ID NO: 11345 - DNA, 598 bp, synthetic construct
  misc_feature 1..598: note = Description of Artificial Sequence: Synthetic polynucleotide
  source 1..598: mol_type = other DNA
yggagatayggttataygagtaattttagygaygtttttttygygygtgttygtttyggtatttyggatatttttattttgatagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagygtttyggaggtttttgggagtgttygttygttygygtttagtgygtaggygttagaygtttagggtttgygagagygagttgagtggttttagggtttatttttggtaggagagagggtgggattygtyggttaggtaggtgygggggaggagttggggtyggtgyggggattygtyggaatttygg

SEQ ID NO: 11346 - DNA, 1281 bp, synthetic construct
  misc_feature 1..1281: note = Description of Artificial Sequence: Synthetic polynucleotide
  source 1..1281: mol_type = other DNA
ygyggtgtyggygygttagtagttygyggttaaggttatttgtttttagggtttyggtatttttgyggggaggyggtaggtagaggaygygygygtagtygygtaggagtttttaggygagtgggggaagtatygtaagagaygyggatttggagygyggttattgygttatygtagygatttgggttatttaagtyggygggattgagaggtygttgygygtgggtaggggtttagattgygttygyggtgtttgtttyggtttttatttyggaaygattgtagttttgyggggttygtygtttatatygygttgaggaygttgtttaagttaggygttygttttygttygyggttttagtygttygtagygygtygtttttagaygygygtggttgttggygagggttgagatygygttttygtyggttagtttttagtagtagygtattttttttgtttygygttttygtttyggattygygtygtygtagtttygyggtgatgagtttygagtyggtttygtygtygtygtygttttagtgttttggttgygatygygyggagtygatygtttagygtttagaggagggygaygaggtttttygygygggygattaygagatggtagtygagttttttygttttatgttagtygggttggygtagtyggatygyggtttgtgtttgaggttgggggaygygttggttygygtyggtygttttttygaagttttgggygygtttygyggygtygygyggttyggggygttgyggtyggaggagttggaagagttggygggyggtttggtgygygtygtgggtttgygygatyggtygttgttygyggagaattygggyggygagttygaggygttyggygagggagggtyggtttyggagtttygygygtttygygatttgttyggttgttygygttgtyggyggttgttgtataagtyggtgaygttgttttgygggtttatagtttgtaagygttgygtggagttagggttygygyggtygtaggtgyggygygtgaaygtggtgttgagyggtttgttggagaagtgtttttyggtygagtgtyggttgygtaggttggtaggttaggygyggagtttgtagygttagtagtagtyggaggtygygttgtttaggtgygattaggttttggagttgggtgagtyggttgyggggygggttygttttttttatatttgttyggtttagtagyggggtggggagttggtyggtgggttygaggttttgggttttyga

SEQ ID NO: 11347 - DNA, 1788 bp, synthetic construct
  misc_feature 1..1788: note = Description of Artificial Sequence: Synthetic polynucleotide
  source 1..1788: mol_type = other DNA
ygatgtagttyggagagagtatygttygygtagygaygygtatagatttttttttggagaygygtttttyggygygtgyggtygagttygygtgaaatgtatagatttttyggtgaggttttgtttaygtgtgattttgagtattgygaagttttttttttttattttygygtggttatttaaagttttgtttatatttygtaygtgtagatgttaattttatagaaatatatgatgtaaggatagaaatgggaaygattggaggttgattttttygtgattaygtttygttaaygyggtgygtttatgtatayggygagtaaaygtatatagtyggtaaatagttatttttattatgtttagtttatagttaygygtggggagaaggtagyggagagggyggyggtggtaggagaagtgggaagtygygygttygygtgggttgttttttgatagttyggygttgttttttttttttttygggaayggygtttattygggggtygtaggtttaygygtygggygygttygggggggtttygtagygtygagaaygggataatgaggaygyggtgataggttgggtttttgtygyggtagtggyggyggyggtagttggagttgttygtgtagtttttgtygyggttatttttattttygttttttyggtttttatttaygtttygagggtttttttgaattygaagatttttttgatgtttttagtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagagttttagttttttygggagttggaaayggagtttagtttgggggygtyggggttttttygttttyggygggagggggygtttttgygtggttyggaagygtygggygggygggggtgygyggyggtyggatgyggggygtygagggyggggygttttttygygttgtggtttgtggttygggggattygaggggtaaggygtggggtggggggggtgggggtyggttgttatggygaygggyggyggyggyggttgggatggaggyggaggygggygggagtttattygtattgtattaaatyggttttaygttagtttygggatagattygygaggagtaagtyggggagtttttgggygggtaygygtaggaygygttagtagttgtttygtggtttttttgygagtaaaattttygggggtgtttggtagtygygygggygttttggtgttgggttggagyggtyggygggtttggtygg

SEQ ID NO: 11348 - DNA, 626 bp, synthetic construct
  misc_feature 1..626: note = Description of Artificial Sequence: Synthetic polynucleotide
  source 1..626: mol_type = other DNA
ygtgaggattttttyggtatygtttygygygggtttttgtttygtgtttaggyggaggyggggtggttattgtttttttttttygtttygygttttyggyggttttttygyggttttttgygtygygttttttttaggaggygttttgatttygtatttyggttttttatttttygatygttagttttagggtygtygyggygaygygygattttttttttttgaggggygygggtttyggaygygtygggttttgttaggtatttagtggagggtyggaggtyggygattagttygagtttagtygtttygggagttggygygagtgtygttaygattttttttgttttttgygttygygttgttyggtygtygggyggtygttttagtttttttatatagttttttaaaaatagttygtttygtatygttttgtaaggtagtagggagattygtagygtgttaattygygttygtygttagggttaagtttygttttaggttttgtttygggttttttattggtttttagtgattttatgagttttttgtttattttatatggttataygyggtttaatggaygtttttttygagattttayggttgygyggagaatygaaygg

SEQ ID NO: 11349 - DNA, 1037 bp, synthetic construct
  misc_feature 1..1037: note = Description of Artificial Sequence: Synthetic polynucleotide
  source 1..1037: mol_type = other DNA
ygggtttgattttygygtttygttagtaatagttttttttgatttggtttaaggtttyggttttgtygtttttaaaatygttygtaaggtttagtygttygtygggttttttygttgttttttaagttttttttaattatttgttttagatygygttatttgtaatttgtttygggttggygttatattyggygtttyggygttttttataagtgttttygtttatgattagygtttgtaggggtagttyggagttygggtggggatagtagygtagtttttggtygtagygyggggtgtagaygtygtaygtttygttttttagtygggygtatatygagtagtagtygtagttyggttttyggaygagtttygygtatggtatgygggygttttyggttattgyggttatygyggygggyggygtaatyggygggggttygtaggyggttaggygttygggtgtgtagggygggtagyggaatagtattttygygygygtttygtygtygtygttattygygtttagtagtagtagtagtagyggtagtagyggyggyggyggtagyggtagygyggggtagtttattttyggtagtatgttggyggtyggtagygyggygtggygggygagygagygagygggygggygggtaggtggtayggttttgygagygygggagtygtttttttygttttttttttttttttygtygtygtagtygggttttaaagggtyggttttttttygttttttgttttttttttttttttttttggagattatttttttttttttygatattttttygygtyggtaagtgagtgygygtaygttygttygtttattttygygttggttgygggttttgggggttttttgtttttttygggtttygttttttygtatttttttggtttgattatgatttttgaaggagaatayggataattygygggtttgggtaggatyggygtggyggtggagaagagygygtgtttttgtttgtttttagtttagttygygaggatttygt

SEQ ID NO: 11350 - DNA, 977 bp, synthetic construct
  misc_feature 1..977: note = Description of Artificial Sequence: Synthetic polynucleotide
  source 1..977: mol_type = other DNA
yggttttggygttaattygtyggtttttggttttttggttttgttatttttggyggggttgtgggtyggtttaagattataagagggtttyggygggaattttyggtggtgttygagggatttaggtaggtyggygatttttttttaatatattttttgaagttatygagaygttttgtatttgtygygtttttagagtttgtygtttttaggttttagttttgaggttgyggtgatatttattgggtatttygggttttgtaygtttygtaggtyggtygtaggtagtyggttttgttgttatttttttttttyggtygttggttggtttttttgttttggaggtatagagggatygggygttgaaaggtgtagttttgtttgtggagggatggatattyggagttgaagatagtataggagagaggggatttttatttattagtgaaggygtygttagggygtttgtttttatgttttttttagatttgtgatatygtygtgyggtttagattttygggggyggttgtatgttagggagggagtattttagggttttttgtttttaagggagagggatagtattttttygggtttttagtttttttgggtgtggygggagagttttgggygaggttgygtttatatttgtatttyggtyggttttttyggttgatttygttttggttgatttygygtatattttttttttagygttgtaaggatygtttgaattygttggttatttyggtgatgaattagtggttyggtgtgaagttgygggtgatygagggttgggaygaggayggttattatttagaggagtttttgtattatgagggtygygyggtggatattattatattagatygygatygtaataagtatggattgttggygygtttggtagtggaggtyggttttgattgggtgtattaygagttaaaggtttaygtgtattgtttygttaagttygg

SEQ ID NO: 11351 - DNA, 6206 bp, synthetic construct
  misc_feature 1..6206: note = Description of Artificial Sequence: Synthetic polynucleotide
  source 1..6206: mol_type = other DNA
ygttaygttatatygagagaagyggagaygatatttttattyggtgggggygggggygaggtttttttagygyggattygggttyggggagtgtagggygtattttttttgtgggtttttaagygaaggtatagttygggggtyggggtggagggygygttttagtaggtygggygtaygggtatttgtaggaggattatttgtttgttttyggatgggtggtatttgttgatgtgtygygtaaggtygggygagttgtagaaggtggtygggtagtatttgtaggggaatatttgggyggygtgtagtaggygtaggtggygtttttgagygtttttgttggygaaygatttttygtatattgggtataggtggtattyggyggaygtatttaggtttagtaygtyggttttttygtygtygtyggtygttttttggggygttttttygtygggttyggggtataaggttagtaggttttyggtygggggygttagyggygygtttttggtttgtagygtttggtggtgygttagtaggtgtttgygtaggtaggtttggyggyggaattttttggygtagtgatggtattygtagagttygttttyggagttygattyggataygtygtyggggttyggygtgtttyggtygttgtygtygtygggtgtttttygygttttagttttggttgttgtttttggtttyggygygygggyggyggygggygygggtygyggtttgtgttagyggyggtgygaggttaggttggtygggtagttgaagattttggygtattygggatagyggtattttataygtaygatgygygagtatttgtgttgygttagygygaaygggtyggygtatttttttttgtatagttggtagatgaattygtttagyggtygygtygygtttttygygyggtttygyggygtttttatygggttttttttgattttgagttttagtaygggygaygtggttatttygttttygaagtgtagtttgyggatggttttgggttttttggygttyggggttttgattgttttggygggyggtttygyggyggtagggggygggggtygttttttygggggtygtagggyggyggtagggggtagtggggggtyggggttygggtygygggtygtttyggygttagtygagaaygtygtgtttattttgagttyggygggygygaagagtagygggtygtygtygtaggtgtygttttygttagtttygttygygtygtygtygtygtttttttygagtagygyggygggygtggggaaggattyggtygagatyggygagtttaggttgaagttgygttygaagtatttgtgtttttygtgttygyggtttaygggtygygtgggattgtagagyggygyggggtgygtagtttyggggttgtygaagtgygyggttygygggttttgygggggtggttgyggtttaggygygtaggtaagygyggyggygagygttgtatgggygygtttygygggyggyggyggyggtagyggttyggggatygggttyggygtygggggttyggygygggygttttygtagttgggygagagtagtagtgygyggtygtygttttygtygtygyggattyggtaggaaaygggygtggattttttgttgygttttattaggaagtygyggggtatgttggygyggttygagggtayggtattggttyggtttttttttygygttyggtttyggyggtttttagtgttttyggtttattgttygggygyggyggttgygggattygygtggygtyggygayggttyggtttagttttgygttttgtaygygygtttttgttttygggttyggtagtygtttttttttaayggggggagggggttattgttttygtttttygttttttttggagttaattagygygttygtagttttttagtttggtagggtgggagggygatggggyggttaaaagggggtygggattygggggtygttyggtaggtgyggtagatgtatttgagggygyggggttttygygygygtttttggtygtttygttyggygtygtygtttygttyggtttaggtataygttyggtttygtttttttttayggtttgttgtttttttatggggaggygtaygtgtttgggttttgtgtttttttttyggggggygyggagtygttaaatgggttygtttattagygygataatgtaygtttttttttygygyggggattattygygggtygttagtaaaatagtaataaaggagaagaatggttttaaatatgttaggagggtttaattygygagtyggagtygagggggaagttgtgygygttgattgggtgggggygggggygygtyggggyggtgygggggagatygttgyggaggygtagtggtttygygtggtgtttgggaaataaataagaattygagagagtagtagggttyggayggttttygttyggattttggayggatgggtygttggatttaagaggttaagtaaaagggtttttyggggttttaagtgtggatagggggttyggttttttggtagtggtygagggygatgtttgtgttygtagttttygygygtttayggggttagagaaggtttttttygagtttgagaaggaattggtayggtttttttagtttttygaaagygygggattggagygygggygggttgggttgggtttttagaggaaygtgaatttttgaatttttgggtttttggaggtttgggaatggtatttttggyggggttygatttaggtygttyggagttttygygtggtttaaggttyggttaattygggtygagttggtygaagttygaaaygygyggtyggtttygtgygttttagtgaagttggttttttttttttygygyggttttatgtatttttatttygagygggtattttgtttgtyggttgatattagatgttaaattaagggttttaattaaggygttgygaaataaaggggttgtttgtttgggygtagtttttayggagtygtgttttttttatttttgtgaaggaaattaattttttgttattgagtttyggtygyggttaatttggaygtaaaagagaygygtgttggayggggggagggggggtaatttgtattttgaggtaggttgaggttttygagaggataagtygttttttttgtgttattaggaagagataatagygaagatttttttygtttttatttttatttttatttttgttgtygtttygtttggatttagattgggtygtttgtttttattttttgtttagtttagtttygaggaaatataaaaggtagaattttygggggatagggtagagaattttaygagtgygtagtggttttgatygtttaatattggggaataaatagttaagttatataaaatgttatatgttgtgaggaaaatgttattttattgaaagagaaggaaatatttttttgtaaagttttgtatattagatagattttgttgagttttatttaygtttaattttattgaaggtatttaattgttttggattttttttttgaaaatattttggygtagaaattaaatatgtaaaaatagagtttatatgagttataagttgtgatggggatagttgttaggtttaattaattaaggggttaattaggttggttaattaagggaaagatatttgataattttatgtttgtaatattttaatttatatattgaaaagggaagaatgtatatagtgaaatatattttgaaaagttttattttagttttaaaaatgttgtggtgagtgttagtttttttaaaagttagaaattttaaaatgagtttatttaaaatttataaatatatttttatttaaaagtaattgatgttatttttttgtttttttgagttttgattaatagtgttgatgaaattagaagtgggaaaaggatttygagatagttttggttaattttattttttaattaygaattttatttggattgtagaatagtatagggygggggttyggtttgttttattyggttttgtatatgtaatattttttttatttaatagataatagagagttagttattttgtgaattttttaaaaataataatatttataattgtaaataagtygtggggatgggaaatyggtatttttattaataaaaaaaataaaataatttttgygtgagtgaatttaaatagggttttgaatttagttaagggaatttattaaaygttattgagatattgagatttaatgaattygtttttttttttttatttgtggtttttagttttgttagygtaaatgaaatttgtttttagaygggtatagttaaaataaatggaaatttgaaaggtattagtattggaaattaattttattattyggggttggaaggagttaggttgygtaygygygtaygtatatattagygatttttaagtaggtgtagtttagttygggtygtggatygtagtygttttttgygtgatttttttagaatttgtgtattygtatgtatggggatatygggtygagatatttgttttygtttgggaagagtaaagygttattatagtgygttttygaygtyggttttggygtaygygattyggagaatgggtygygtgaagttaagttgggggaaatagygyggatttgtttttttttaggggggtttygygaaagttagtgaatataaggatttaaggtagagtatttaaggggtttttttyggttttaggtgatttttttttttttttyggggttttggttagygttttggaaaaatttygggtttttttatttttttttgyggatttygyggtgggtttttttttygaygattgyggagttygaggttttaggttttttaattttttttattttggtgtgyggggatgtygtyggggagygygtyggggtttattttgatttttattayggttggaaattaaagttaaggtaatagggagtttgtagaaagygygaagtttggaaataagagtagaagyggggaatttttgyggaggagttggttttttggggtgtttaggagaataggaggttttggttttaygggaggagtygggygggttygtatttttatttygtagagggtatygygtttggagaygtyggygttgggggtgaggtgttagygttttttattattattttgttgtagattttttttttggttttatagaagtttttattttyggtttttagtttttygagttataatyggtaggaatygtgygttatygttgtagtgttygtygttyggagggattagygtttttttgygtygggtgygttygattygagtyggtgagaggttttgtatttgtaggaatgaggggttgttgtgttagttttaggggtaygygagagataygygtagttygtttggtygttatttygttyggttyggttttaggtatttttygggtttttygttygygggtygttgtttttgttyggygtattagtataaagttgttagggatttttygtttagataattttatataaaaggagagtgtatgaaagagagygaataagggaygattygygaggttgygtygtgygttttygyggggagggatygygtttaagtattttttttttttygagttttaagtgttttttggtaatttgttgygygtttattattyggtygggggtygayggygtggttggttattttttttattttttygagagtatygtyggggttattgtaygttttttgaagtgtttttagggttgtttgtttttgttttagtgggatygtygggttagggagggaggagagygggtaggaaggttygggygggyggygggaagggygaygtyggygaaagttggtagaggygaagtttagaaggtgagaaagttataattaaagaattaggttagggagagttaggayggtaygggatttatygggatgatattgattttggggygtaagaggtgttttttatttgtgaggtgttggyggtygttagttygtgygtttyggttttaaayggaattgataaaatttagygaaattgattagaaaggttgyggygatttygattttttttttttttttttattttatttatatttgtatttygtttygtttgtygtaggaggayga

SEQ ID NO: 11352 - DNA, 574 bp, synthetic construct
  misc_feature 1..574: note = Description of Artificial Sequence: Synthetic polynucleotide
  source 1..574: mol_type = other DNA
ygttagygttaaygaatgtggggatagttygtttggygttygyggtygtatttttatygggtagtttygtatttttttttygggtttttaagtygttygtttyggttgygggagatttyggygaattatattygagaggggggygygtggggyggagttttttttttattgttttttygttattagtygtttttgtygtygagttygtagtygttagygygtttygagtttttttaggttagaggttttygtaggygatggyggataagagggyggggattttagaagtygyggygygttygtygttyggttttgttygggagggggaygygygtayggttttygyggttygggttygagaagttggggggygygggtttttttatttygtagygggtttygggatygttttttttttttttgggygyggggaagyggtttttayggygattatttygagtttggaaaatggtygggttygggaygaagttttagaaatttgtggtgtagaggggttagggattygggtaggagttagygagaaggtygaggaygygaataaggaggagggygt

SEQ ID NO: 11353 - DNA, 3438 bp, synthetic construct
  misc_feature 1..3438: note = Description of Artificial Sequence: Synthetic polynucleotide
  source 1..3438: mol_type = other DNA
ygtgtttgtttygttttggtygtttgaggtyggagttatatatagtttgtatagattygagatattyggtttygagtgatttggaaaygagtgtgtttttattgygtttaaataagaygaggatatttataaggtgygagtttttaatttttagttattggtaggggttgygtagyggtatygtttaggttttttttttaggyggtygatttatttttgyggagagtaygtttttygaagagggttgtagaygygtttttttagtatttaatttgttattttataagattgagttaagttttagttaaaatatatttattttattaaaaataggyggtttaatattaygtygtattttagttttttygagggygtaagagaatagagagtttttagattaattggaggtaaatattttattttttaatatttaaaaataatttaggygygtttgtatyggtgtggtttaygygatttttaygygygaggttagtygggttggtttagygtagatagyggtygggatttatttatttagtgygygttttttttgtttttygttgygygygtttaaagttagaaagaagaaggtgaygygggaggygggtygggttttygggtttagygaattygygatttattyggtttyggygtttgagtygaggttttagaaagaattygttaattttagttattttggatttgggtagggagggtgygyggtttttaagtttagtttggatgtttagtgyggtgtgtttyggttttttygtttgtttttyggggaggttttttattyggtggttttgggtygttttattgtggygtttttatttttggttatyggttttttttygtttaggatttttyggtttagggagtagtygaygggtattttygaaygttggggtayggaattttaayggggygattagagyggagttygyggttygaggttygyggttgagtaygaagaygggattygaggatttgtatatygttygaggggaatttgttttgggttttggtgtatatatagtatgygttttgggttggtttgggttgggttaggtaggggagatttggttgggtaygaggygtygtttaagtttttyggtygtgggtygggyggtygyggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygttgygttttygtttttygtttttttagttttttttygtttttttttttygygtttggttyggygygtttyggtyggtygtaaagtttttygggyggtagyggyggttgygtttygttttagygatggtygyggagttgagtatggggttagagttgtttattagttygttggttatggagtatgttaaygatttygatttgtttaagttygaygtgaagaaggagttattggggygygyggagygttygggtaggttttgtataygtttgtagttagtyggttyggtgttttttatatygtttagtatttygtgtagtttygtgttttygtygtttagttttagttygatygaatagaagatatatttygaggatttgtattggatggygagtaattattagtagatgaatttygaggygtttaatttgaygttygaggaygyggtggaagygtttatyggttygtatttagtgttatagtygttgtaaagtttygatagttttygyggygtttattattattattattattattatttttattygtattatgygtattygggygtyggygtggtttaygaygagttgggttygtaygtttattygtattattattattattattaagygtygtygtygtygtttagygtygttagttyggygtaatagttgtttattagttatttygggttygggtygtaygygayggtttyggygayggyggygggyggtaayggtagygtggaggatygttttttygaygattagttygtgtttatgttygtgygygagttgaatygttatttgyggggttttattaaggaygaggtgattygtttgaagtagaagyggyggattttgaagaatyggggttaygtttagttttgtaggtataaaygygtttagtagaagtattatttggagaatgagaagaygtagtttatttagtaggtggagtagtttaagtaggaggtgtttyggttggttygygagagagaygtttataaggttaagtgygagaaattygttaatttyggttttagggaggygggttttattagyga

SEQ ID NO: 11354 - DNA, 4088 bp, synthetic construct
  misc_feature 1..4088: note = Description of Artificial Sequence: Synthetic polynucleotide
  source 1..4088: mol_type = other DNA
yggttyggtttggttygggataygtttgtttygygtatatatagttagtyggttttgttygaaaygtattaagtygygtttagyggtaatygttttttttttttttttygtygtttttttttygatttyggygttaygatttttttgygtttttttttttttattgtattatttttatygtttygatttttttygaggggttgatgttattagtttttttatttttttyggttattttttttygttaaagtttttttttggygaggtttttttygttattayggygttttttagygttattttttttttttttygttttttttttttttttttttttttttttaataaattttatattttayggaggygggtttttttttttttattygttattyggttttttgttttygaaattttttttttgtygtagttttyggagttttatgggttttttttttttttttttaataygtatttaaatttttggygtygtgtaggtttygyggaaaaagagagaaagagagaaagagggggagagygagagygagagtaagagagagatattgagygggtaggtygggggagggggattygygttygygtygttayggtttttygtttygtttttgagttttygttyggtygaattygygtttttgggtttttttttyggtttygttttttatagatagagttygygaaygggyggggggttygggagygygygttyggggyggggggygggttyggygygygyggtttgyggggygtttttygagggttttygggtyggggtyggygtttttygttygtttttatttagtagtagtaggyggtgygtggttyggtagatttgtttgtttttttgtagttgtttttygatttttttgttggttttaygttgygtttttttttygttgygttggttttyggttttattgttttygaggtagtttatggyggyggyggyggyggyggggygyggtygggttgyggyggyggygggygygggyggttttaygtgggtygggagggtyggggtagygtygggygggygggtygggygygggttyggtttttyggtaaggagygygyggggyggattgygggtygygggtygyggggygygyggaygggygggaaggggagggtgtyggtyggatygaggggygygygtagtttttygtttttygagtygaggtygagggggttgatggtygtygtygggtygaggyggattagagtaggagttgygggagttgttgtygtygttgtygtygtygtygtttttattgtttyggtygggttttygtygtygtttygagttaaaagygtygyggygggyggggggaggyggggggaggaggaggyggyggyggygaggggggtggaaggaggaggaggaggaggagggtygaggagyggtygyggyggyggyggyggttgggagggygggagtyggyggagggaggyggtttttygggagttyggggagggggttttttygttygygttyggtyggggaygggaygggtyggggagaygttttttatttttygggttygggtagtagttyggttgagtygaggggggagagggggygttttygygttagtgaygatttttygtaygaygttaaygttttatttttyggatygygtygttyggygttttygaggttttttttttttttygygggygtygtygaggggttggggtgggyggaaggggagggagygygygttyggatttaggaaaattttygaaagagygagagatatagagagttagagagtaggagtgtggaaaaagygaggygagtaygaattaaaggatagagtaatygaaaaggaaaatgtgtttatatatatataygaataygaataaaaatttatattatatagygatggtggtgtttggtggyggtggyggggtggggggtttgattagatgagtygtttttygygttttyggygtygggygttatggttygagtygaaggygtttttggtttyggagygttygyggtttttgygtttggygyggtygtttaagtaggagaagaaggygtagtttaggaatattyggaagtagtaggtygtttygaataygaagtygtagtygyggttttgtttygtgygtttttgtagtaggaagttgagtatttaygaggggttgygtatygagaagattaggaatattaygaggggtaggtgggygtttagygygttagttttgagyggttygggtygttataygatgtttttaaygygyggygtygygtagtaggygtygttttygtygttygagttygtgttttagttagtttaggttttattygtgttttyggyggyggygtttttttyggygttttygayggygtttttttyggygtttttgtygtygtyggyggyggtygyggyggyggyggtttyggggtatygggtttttttttgggtttttggtattttttttttttttttttttagtattttttttattttttttttttttttttttttttttttttttttttttygtttttgttttagtagttttttttygagttttttgygttttttgtttgttaggaatttttyggggagygtttttygygtygggtttttggggtttttygygagtttttyggggttttygttttttygyggygygagyggttttttyggttyggttaaygtygtagtygtygtygtagtttyggtagttatttyggtagtygtygyggtygtttttttttygtttttygtygttygggttttgagttttatggttatttttagtatggtggttyggttatttyggggagttyggttygygtttggttygggttttttgtttgttttyggtttygggttgttyggttttygtgygtttygtgtyggggggtttggttgyggttttygtygygttgtttyggggtygyggagygyggttgttygggtttygggttgttgggttggttgtttaagagttagygttaaaaaggatgagtaaaygaaaaagggataagaataaattaaaaagtatttaataatagygagaaattaaaaagtattaagaaatgttaatttaaaaagaaaagtgtaaaggygyggatggtaggagtttgtttatttttaggygttttttggtttggtttttgggtaygttaatggagaagagaaaagagagagaattggggggtgttyggaggygtttyggggtaaggtagyggygttygggygtttttgttttgtttyggattyggyggtttttgtttgygtygggygattygtattttygygggaggtttyggygtttttygatttatatgtgagtgaggtgtatttataygtaaggtagygtttgtyggtygttygtygtygtttygygtygggataggggttygttttagtygtygygtygtagttyggagttagagagtaggggagygtygygtyggttagttatttgaygtagttygtttygyggtgtygaygygattgagtgttttygtyggggagtagagtttttaatyggtttygatgaygttttagtttttttagaggatygatttatagtagyggtttttataaatygaaggggaagygygaaaaatyggtttatyggggaygtatttaaatgggtygtygygtattttgggggtgtaggtyggtgtygggatygygygggygtgggtygggggygygggggtygygatggyggggggygygggygygtttaaggyggtgggygtttaatttygttttttagatttgttttttaattttyggtgagtggtgtagttttgggyggygtgtaaagtgtgygayggyggygtttatttttgttgtgygtttttttatttttagttatttatttygtttttttagyggygygygttygtygaggtaggtgttagagagtygaattygaattatttgygaygttyggayggagtttygtattttyggaygagaaaagtgygatgggagtgtaaagttttttttgttygaagtagtaggygygtyggtgttaygggagtygaggagyggtggtygtggttgtggagtyggtgttygaggygt

SEQ ID NO: 11355 - DNA, 522 bp, synthetic construct
  misc_feature 1..522: note = Description of Artificial Sequence: Synthetic polynucleotide
  source 1..522: mol_type = other DNA
ygatatagttttyggygygtygggtattgaggttttggagtatagygtggggggtttggtatagataygatttaygatygggtygattttyggttagaaagaattatgtttyggtygttygggtygygggttygyggtgtatttttgtaggtttttattttgtttyggtagaggtttgtaagaattttgtgggtgtttttyggagygggtagaggaggagtttagygtygaggtttaggygygtttygttttygttttttttygtgtttttttttygttgttttttttttaaaggtygagatttggaygttgttyggtggtttyggygggggttttgtttttggtygttgtttttttgaattttaggtgagaagaataaaaygttttgaygttgttyggttttyggtttttggagaggaygggtygtttttgtygagagaattgtgyggaattaggaagygttggtgttttttygtttttaygggattaagygaaattyggttttaaaygaagtaaagtygg

SEQ ID NO: 11356 - DNA, 2260 bp, synthetic construct
  misc_feature 1..2260: note = Description of Artificial Sequence: Synthetic polynucleotide
  source 1..2260: mol_type = other DNA
yggtattygggtygaagygtttggttygygttttygygygggtttttttggaatygtttygggataygyggttttttygttgttggattttttttygagttttagtttgttaggtagggattttttgggygggyggyggggaagygtygagtyggyggtygtttatatttttttttaygtagtataaaggatattygtyggtaaatttttttygtttttgattygggtygagtygggaatttagygttagttttgtttttggyggggttgaggttttttttatattttaggttatttggtaaaygttttgaggttgttattttttttgggtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggagtttaaggtttaygggttgaggtttgttttygygtggatygtygagagttyggtagattttttttaaggttttgattttaatatttttagtgttttgttaattatattttttgttttttttttttattaaggttatygttaagatattttttttttttttttttttygtygttygttattttttttgttttttttttggttttttttttagttttttgggtttttttttygygttgttttttagttttagttgtttttttyggtttatatttyggtagttttttttttttttygttttygggtattttttttttttggtyggtttttgaaatttagtaggttyggtttyggttattgtttttttttgtttgtttttatttggtttgtttttttaattatygtttttttatatttttttttttttttttttggtaagggggayggggggaaayggggtattatattttygtttttygatttygttattttttttagtttygtgagtygygttttttygttttttttaggttygygattttattttgaggttttttagatttygtagggttttttaygttattaagtttgtttygattttttttygttgttttttatattttttgtygyggygyggtyggttagggatttatttygaggtttagttggtgggggtgttggggtgygygyggattyggtatttayggyggyggyggyggtagtagtagtaggaggaggagaaagaygaggaggaggaggaggattagttgagyggygttttttttttagttygtagygygtattggttttttggggtattttygggagagtattaagatyggagattaggyggygatataggtaatygttgttgtayggggttgggtttagtyggtttttagaggttagggtagggggaggtaggattgggaaggagggtyggagaagtggggtgtagagggyggggtagygagyggttaggttyggaggaaggygttttaggygtttagggatgtygtygttygggttgaygtygtyggttttttttttygttaggygggygtttgtagtygygggygtaygggtttygtttygtttatyggttygttgtyggygttygyggtgygtttygttttgtgtttttygtagtyggygtgtatttggtgtaagtaaaggyggttagttgatgggtygygygyggattggttgtttygtygtttttttttttttygttygatttttttygyggtttttygttttygttttyggygyggtttygtgttgggtattatttgtggatygtttaataaaggygtagygyggyggggttygggtggtygggtygyggtygtygttttttgtttaggggayggtaggttgyggttgggtagggaggygaagygtattgtyggtttttagtaaaagatagattaaaagaaaatataygttygtgttaggaggttagttaggtataatggggttttatttttttgyggygtagaattygggttygggggttgagaattagatatagttyggtttggggttgtgggagttaagtttyggggtgaaattygattttgygttttaaaatatagggygygttttygggttgtgtgtgygygttygggggygtttttygtagatttggttygggtyggtgtttttgtygygggaaggaggattyggaygtttaatttagyggygaagtygttttttattggaggaggtttttygaaaaygt

SEQ ID NO: 11357 - DNA, 1502 bp, synthetic construct
  misc_feature 1..1502: note = Description of Artificial Sequence: Synthetic polynucleotide
  source 1..1502: mol_type = other DNA
ygayggtgagygtggagtagttygyggtttygttgttttttttattttyggatttttagtttttttagagtggaggggtaagtatatagtaagtatttgatattygttygatttttgagttttttatttgtaggagttagggggtttgtttttygtaygttttttgttggagggaggaaygagggaaggagaaaatttaygttgaggtygttggtygattattttttttatttttyggataatattgatgggttttattaaggaaagtygaattttygtatgttygaggagtgtyggaggtggttgtgygtttagttttttttggtaaagggttygaagtattygtttatttaaaggyggtygagagttatattatttgtttgtatgaygggagatatygaaaygttttttttgaaygygatgataaatatttttttttatttagtagygaygtgtaygtgatagtttttgggttttygtaattaygtggaaatttggaataggtttgyggttgtatatygttyggaygtyggggtttttgygtttttygttttttttgatygyggttgggtagtygagtygtaggtagttgggggttttygaaygtygtttttgtatygygtygtttttgtttygggtttyggtagttttygggttttygtattgttygtygygttttgtttatagggaagygtttttttaggyggyggyggttttggtgyggatttttyggtygtagttatgtgggattygygggtagttaggtgygtagyggygygggaagtattggggtatttttggtttttygggttygttattttttttggygggaggyggtygygygyggggattggygattttgaggtagyggtygaaygggttygttyggttatttttgtggggtttatagttatttaggtgtagattygagttagttgygyggggtyggtygygggggayggtttyggttttttyggttyggagggattagggtaygygttgygataggattgyggyggygygyggtttgtttagtttttatttyggtatygaagtygtagttttygggtttattttygtatttttaggggttttygggggttgtygataggtttttgattagygagygygttttyggggtaagtatttttggygggtagaaatttgggagyggagtatagyggtgtaagggaatygtgttaggygggaagggyggaatttgyggggaatttggagygygttggttttttttyggtagtaggaggtttttttttttgttygttygattgagggttgttgggttggtttaaattggattgtayggtttattagtttgggtttatygagtttagggggaaggtagtagtagggatttaaggttgggaagyggagtttttagaagtttttgtttttgtttyggagygttttygaatyggagttyggagtttgttgtttgggaggygygttgygtttttttttaattttttgttttygtttygygg

SEQ ID NO: 11358 - DNA, 510 bp, synthetic construct
  misc_feature 1..510: note = Description of Artificial Sequence: Synthetic polynucleotide
  source 1..510: mol_type = other DNA
ygttttttgtygggagttattygttagtttttttttttagttyggttgygtagygtttttaatttaatttttggatttattttygttttagtttttttygtgtttagygttttttgtaaatgattttttyggtygggtgtttygttttttttttyggtttttttygygtggtttgtttttygttygtttgygttygttyggtttttttgtttttgygtttttatttgatygtaaaggyggttagggtagttttygygyggtttgatagttayggtttttagtttgtttttggaygtgggaaattygggtttatagygtttttaygtatattgyggtatagattggygttttttayggygtttttattggaaagygtttttgtggttttggggagagggyggttttattygttatttttttyggagttgttttygtttatttttatgggaggaaatygtagggygtgtgagttttygatttttygtttttattttttttaggatyggtygt

SEQ ID NO: 11359 - DNA, 940 bp, synthetic construct
  misc_feature 1..940: note = Description of Artificial Sequence: Synthetic polynucleotide
  source 1..940: mol_type = other DNA
ygggtaattgttygggttttgtttatttttttygygggtygtatttgttaaggtygtatygttagygttttttgtygttttttttgtatagagattygygtttattttygtattygtattygtattygtatttgtttttatttygygttygttttgygtygaggtygygtagtttgygggtagtggygggggtaygaggatgygaatttaggyggggtygggagttgggygygttttttagaattttygttayggttaggtttgagttttatttatttaygtygtattttttttttttygtgggggtttatatggtygtgtygggygyggtttygygggygyggygatygggygataaygyggyggggayggtygygggttyggttgtggygtatygygagtygaggyggggayggttaggyggygyggggtagtgggyggygtattttttataggtygttygggatgtygtygttattttygttaygtttggatygygaggtttygygggtggtttagtagtttttggyggygygggygaaggttygttatttgttygtygtygttgttttygtgtygtygtttgtttttttatagtttygtygttyggttttyggygtygtygyggttyggttygttttagygggttygtaggaygttygygtatgygttattttttgtygygtaggggttygygttgttygggttygygtygtttygagttygygygygaatttaygygtygttgttgygygttagyggagggaaattygygagaagttattggattgttyggtttyggatyggtttttagaatygttggttyggggtttttagttgtagtaaatttyggagggggygaagtyggttaggtgggygattttttttattyggattttttattygttttygtttttagtgttttttgtttgygtttyga

SEQ ID NO: 11360 - DNA, 2718 bp, synthetic construct
  misc_feature 1..2718: note = Description of Artificial Sequence: Synthetic polynucleotide
  source 1..2718: mol_type = other DNA
ygttygggtygttttttttgtttagtttygagygyggagttgtttaggatttttagaygggtgygagttattgtttgaagttttttttttttygtyggaagaggatgtgtttaaaggatygtyggaaattttggttgaagatygtgtagatgatygggttgagygagttgttgtagtagtygatttagaagaagaatttgaagagygggtygggtatttggtaggtttygyggtagatgtygtataggttgtagttgaagaagaaggggaattagtagagtaygaataygtttatgattatagttagtataaaggtgaagygtttttygygygtttgggttattttgyggyggtataygttgttgygygttyggygtyggygygataggaagaattygayggagygygagttggygygygataggyggttatygggtttyggggatttggaggyggttagygttttygatttagtygttttyggtttygttttttgttygttygtatygttygygttttttttygygttygttygtygtygttygttttgtygtaaygygtttyggygtygtygtttttyggtygttgygttgttttygttyggttttaygtyggygggygggggygygtagtgttygttttygtttgygtttgtygtygygtttagttygttttyggtagtyggggaygtatygtyggggtttaygggggygygtttttygttgagygtgygygtgygtagtttggttattyggtagatgygygygtagattaggtttatgatgaggtagggygygaagaaggagtygatgtaggaggataggatgtattaggtttygtygttgaggtygtattgygggtaggyggygtygtygggttggyggtagagygagattagyggygggaaggagatgayggtygagatgagttatayggttaygatggtggttttgaygyggygtggtgtgygttttaggttgtattygayggtttgygttatygattagtagyggtttaggttgatggtatatagatgtaygatygaygaggtgtaaaatagtatatygagygttaggtataygtygtattatatttgttygaagtattagtaggttatgagttygttggttaaygagaagggtatgattagygtggttattaggatgtyggtygaggttagygatattaggaagaggttttgtggygygygtagygttyggttggttagtayggygattattattagtaygttgtttattayggtgaagaygatgaggaagtttattayggtagttagttttgttatygygttygtygagtattggtygygyggyggtttttaggaagttttygaggtattggtaatttygtygttgtttttttygttygygtygttygtattggggttygtygttgtygttatygttagygtygtygttagygtyggggaygttatggttttttygygagttaygtygttttttttggagtyggggygtagtygyggtagttygggygttttttagtyggggtyggygttygtatygtygtttgttgttygggygygttygtyggggatygyggygtttagtagtyggttttyggtygtggtggtttygygggyggygygtyggagagygtggttgtygggtttttygtagttgtygagygtgtaagtgtagagtaggaggygttyggagygagyggygaygyggttgyggggggaggggggtaggtttyggggttttygygyggtttygttttyggttyggtttayggggagygtttyggygtygagtttayggygaygyggygttygagygggygtgtttgagyggtttygyggtttyggagtttagtyggggygtaggygataggyggyggyggttygggygtttygttttttattyggtyggttagggttyggygygtyggggygtyggtygtygttttttygggttttygygttygygygtttttttygtttttaattttattttttygggyggggygtyggygtygtygygagtttttyggttgttttygggygygggygtttttygyggtttaygtttggtygtgyggtygtygtttygttygtyggagttgygtygtygtygtygtygtygttttgygttgggygygagtgyggtygtttgygatyggtttttaatttgggtygagttgygtagyggggygggygygyggggyggggygggtygygggttttggggagttggtygggaatyggagttygyggtygtttggtygaatttgttygygyggygtyggggaggagttyggggyggyggygyggggygygygttyggygagggygttttttttagggtygtttgtagtttgygggayggggtygagyggyggtyggtttgggtggtgagttttagaagttgttttttttaagattggagtttttttygtttttttyggygtaggtatgggygtaggygggggygygtataygygygygygtagtaygggyggttyggggtttatggtttgatggtagagtaatttttygtagtttgggggaggaygygaygttatttgygtgygtataggttttgtygagtttagggttyggattagattttggatyggygtttttygttagagttattttygtatttatttyggttttagttttttyggtttattttttagygttgttggagtatgaattataattaayggygg

SEQ ID NO: 11361 - DNA, 2661 bp, synthetic construct
  misc_feature 1..2661: note = Description of Artificial Sequence: Synthetic polynucleotide
  source 1..2661: mol_type = other DNA
ygygggtaaagygtgtttttyggtgggttataagtagygttyggtttttttttttttygttaagttgtttgatttttttttttaggygygygygtatatattatatttatatattttaaaattaagattygttttataggatttgggaaaagaaaaagaaaaaaaagtttttaattattatttttttttygtygatttttttttatttttygttttttttttagygggtagttaaggagagttagaggygggggaggggagagggaggagaagygaygtaagtgggtagttttttagygtyggygaggygygggaggaggagaagtagtggggaggygtagtygtttatttgyggggtagggygyggaggagggattygggttgygygttttygggtygaggaattaggaygygttyggagtttygtaygyggttaagttyggggygtttttttttttyggtygggygaatttaaggggygtagttttttgttttgatagagttggtyggyggaggygtgtagagyggygagtyggygagttaggttgagaaattygagtygggaataaagaggggtyggattgagtgtgtgtgtyggttygagtttygggtagaggtatttgggttygaggttttygttgtgatttttygagatttygtagtgttttttattgyggagttttygygtttgtyggtaaaaattttatttttggtaaatttttttttttttttttttttttttyggtttttattttttgttttttttttttttttagtagattaaatgagtttygagaagaaaaatygaagygaaagggaagaaaataagaagatttaaaayggatatttttagygtgggtggttttttttttttttttttttttttttattttttaggaagtggaygtttygttattttttgatttttgtatttttttttggggtaaayggggtttttttgtttagatttttttttttttttyggaaaataaattattaagtyggtattyggggtaattatagtggagagggttttygyggagaygygtygtyggatttttttttgtattttggggaggygtgttttttttagaatyggygtttttygygygtaaatttyggygaygyggggtygyggggtggtygtyggggtagtttygtttagygygygtygygtagaygttttyggagtygttagttatygtagttttygtygtttagtgtttttyggtttygggggygggygtttgygtyggttttygygaagygggaaagygyggyggtygtygggattygggygtygyggtagttgtttyggttgtyggtyggyggtttygygttygttygtttygttttygttygttgttttgttgtaygaatttttttaatttttttttttttttttatttttgagttatttttttgttttttttgttgttgygygggtgtttttatagyggagyggagattatagagtygtygggatgttttaatttttyggaggaggtggyggyggygggggggattyggaattttgygttayggaygagatgattttttttaaggaygagggygatttttagaaggaaaagattttygtygagattagttatttygaagaggaaggygatttagttgatattaagttttttttggtgaaygagtttgaaattatttyggttagtaayggataygaggtgagygggtygttgttttagtttygagaggygtggygggtttttgggaaatttagagagggaggaagggaaygaaggygttyggtygttyggttgagggtttygagtagatttttygtttgttttggggtgtgtgygtagttgggttttyggttygtagtgtgtgtgtgtgtgtgtgtgtgtgtgtgtgtgtgtgtgtgtgtaggatgggaggtagaggggtagggtaatttattttaaatggattagtttagggggttyggtggttgaayggttggttygygggtaggaatttataatgtttygttttyggtttttttgttgggttgaggggtgtygtgttttaaagygagtagggttgaataaygttattgataaattttttygtgggayggaaaataaagtgtataygttattttttggtagatgtttttgtaaaagtgygttaaattattaaaggtttaggtggagaygagtagagttataggygggaggaaggggaggygggygtgggttggggtaggyggggtygtttttattatyggtgagtygggtygyggggagtaggtyggtygatggggygygtattygggttgygggggyggtgyggggtttagtttttgyggttttagygtttgggttagtagttgggagttgtgggtgygtygagtygatttatygtaagggtatattttggttgtatygtttttaattttagttttttttaatygttattatttggaaataaatttataatttttatttggggtttgggatyggattaggttttaaatttaygtagaagaaaggyggagaagtagyggaagtygggtattagttttgtagggtggaaggygttttatygggttttttggttygttgygggygatagagttggtaatttgagtagagtaaatagagataygtgggtgttggttagagaaagygyggagtagggtygygt

SEQ ID NO: 11362 - DNA, 801 bp, synthetic construct
  misc_feature 1..801: note = Description of Artificial Sequence: Synthetic polynucleotide
  source 1..801: mol_type = other DNA
yggttattaagyggttttttygtgagtttygtttaatgtttgtgygtttaaattagtagygttygaggaaygygttaattgggagaagtgaattgagggggttyggyggtygttgaggaggggagygygygggaggaggggygaggagttyggaggygggygyggttggtagtttagagggttygggyggaggtttgagagtagggttggaggggyggaggatyggggagattygttygyggygttttyggtyggttttgagtaggygtygtggtagygttygygttttttgttygtttttygtygtygttaggaygtaggttygygttagggttggyggtagggttygtagttgtyggtttggygtttttatttygygtagtyggtttygtttagttttttygygtttgattggtyggattttgtttttggyggaggtaattgttygyggattttttatttygygattttggttttttygtaagtttttyggattygggygttttyggtttttttttatttatttttttgtygggtaggttygygatttttygtttttygggtygtttttygtygtattyggttttggtatatttttattatttagttygggttygttttygttttgggtttattttagttttttagygtygtttgttgayggagygygggagttttaaggggtyggggttattyggtyggygtgggtggtgttaggttygggttatatttyggtatyggattygagttttttagtttttygagtaggattyggaggaatagaaygttaatttttttygt

SEQ ID NO: 11363 - DNA, 311 bp, synthetic construct
  misc_feature 1..311: note = Description of Artificial Sequence: Synthetic polynucleotide
  source 1..311: mol_type = other DNA
yggttaayggtattayggaagtattagttggtatagaggttyggtgtaattatygttttgtatygtaaaaygggtttaggaagtttttaggagatattagyggtgttagaatygagaaagtgaygatatagataatttatggatttygygtaygggaaaygtttygttgggygttaagaayggtgtagtaattgaaaaatygtttagtgggygttattggtaaaagygttgttgtaaaatygttagtttygtattagaagtagagtygttagatagaattygggatttgaaattatygaagyggagatyga

SEQ ID NO: 11364 - DNA, 1048 bp, synthetic construct
  misc_feature 1..1048: note = Description of Artificial Sequence: Synthetic polynucleotide
  source 1..1048: mol_type = other DNA
ygttttygtaaatttttygggttttaygttttgyggttattaygtttgatagagaaataattagtattagyggttgattyggttgttygggttttygtgtaggygggygggagyggataggttttggtaygtatgygttyggggygggattgygttttaggtttgygygttgtygttagattagygggggggyggggyggyggyggataygygttttaggyggtagtygygygagagggattttgtgtttygttgatttttttyggggygttttttttygtgtygttttttttttttttygtygygtttttgygaggygttttttattyggtgggatygattyggggggatggagggggtaygtttttataatttttttgggatttygaagagaygttygygtgygatttgagaygtygttttygtygagggtttatgggygygtttttataggygggtagtggaygtgagggyggygagyggyggggtygyggygtttaggagggtygygttygggttyggtttygygtaggtygygygygygygttttygtygtygttygggtygygttygtttygtttttaggygtyggtttyggagttyggttygygagtagyggyggttgtyggagggaygatgagttgygyggggygggygggttttgttyggttygtygygttygttttgttgatttgtagtttgtggtyggtaygggtagataaygygagttaggagtattatayggygtttattaaygtgayggtgtaggagttyggtygyggygtttygtttaygtttygtatygatygygggygttaygggtttgatttttttaaggtygaggttygyggttaggtgttggygtygttgtttttttayggaggtgagtgtyggttygggggyggygggyggtggtygttgtatttygygtaggyggygggattagggttttyggtttyggttttggttttggttttttygygttgttyggtygatagttttagttagggtygaggttttygtygtggatagttyggtttgttttygt

SEQ ID NO: 11365 - DNA, 301 bp, synthetic construct
  misc_feature 1..301: note = Description of Artificial Sequence: Synthetic polynucleotide
  source 1..301: mol_type = other DNA
ygggaagtagtaggygtayggtygtttggatttttttggaggtgatggtygagygtttgttgtaatgygttaggygggaagtttygtyggygatgygttygaagatgtygttgataaaggaatttatgatttttatggttttagaggagatgtyggtgtyggggtggatttgttttagtattttgtataygtatayggagtagttttttttgyggttgygtttgygttttttgtygttttttttttgygttttggttayggtttttttggagttttttttyggggygggagyggatttygt

SEQ ID NO: 11366 - DNA, 1395 bp, synthetic construct
  misc_feature 1..1395: note = Description of Artificial Sequence: Synthetic polynucleotide
  source 1..1395: mol_type = other DNA
yggttttgtgaggtttaygygggagygyggaggtttttgggttttagggygtyggtagatggtttgtagygtatygttyggttttygygttggttaygttygttagygttatttttttttttygttttttatttttaaaaattyggyggtygagtagtttygtatttyggagggttttyggtgtaaaattgagtgggaaagagaaaggggyggagagygaygagagagggaaggtggggaagaagagttyggtygttttyggtttttttyggygagttttgagtttttagggtttattygtttttttaagtygaattatagaaattttttattgttatgttaatgaygagaggggttgtggggagagggtttygaagatttttttggaagaagggaagtttttttttttgttttygttttttttaygtttattygagttttttttagttagttttttgygtttttttttttttatttygagtttgaagagtyggtggtttagtttygttttttattayggttttatgygttttttatagttttayggttttttagtttagttttagaatagaggaggtggtttgggaattyggggygyggtgttagtyggatttttygtttttyggttgggygygttgygggttgggtyggygtatttgyggttattyggygagttttggtttattgattttygtttygagagagtygggagtttttttttttttttatttttygttagtttattttttattgaayggtggggagggggygggagygggggaygttttttagtttttatttttyggaggtttggyggggygggtagyggagtygggygygygtagaaygtagtttttgttttttttygttttagtattttaaatyggtttttgtagtygtygtagtagttgtygtygtttaggttgtttgggggggygattgygygttatttagayggyggagygtyggggatttaaatgttattaaaayggtgatttattattgyggaagtyggtaaatttttgtaggaggtttagttattggttgatatygttaygtgttttttttttagygtttttygttttttygtttttttttttgygtattgtatatttatattatttttttttttyggttttatggaggaagtgagaaagttggtatagttaygtygggtttygtaggattaggttatttagtgatagatggataatgtaagaatgaatttttttttggaatattttatatttagtagtggygattyggggatttgtttagttygagtttatttttyggattataggattataattttttagtygtgygyggttagygttaatagttgyggyggygaygatygttttttagtgggtaggggggtgtagatyggttygt

SEQ ID NO: 11367 - DNA, 766 bp, synthetic construct
  misc_feature 1..766: note = Description of Artificial Sequence: Synthetic polynucleotide
  source 1..766: mol_type = other DNA
ygatttygttttatgtyggtygtatygtgttttttttaggttttattagtatttgggttgttatggtgagattaagatgggtttygtttataattaaygatgttatttygtagygagttaaagttattttttattttgggttygttaygygatttttgtyggttttygttttaygyggttttagtayggygttaaggtttygtttataaatyggtttygttttttygtgttygggttygtygtttattagaygtygtttyggygtagygagttgagggtaygtttatttttttttygggtttttagtttttaaggttttagtataatgttttaggaggaagattttaggttttttttttattygaygttgtttttgggygagtygaggtttygtttattygtyggttyggttttygtttttatttgaygttgtttttgtgtagygagtttaggttygygttygtagtygtgttattttyggagttygtttttttgtttaggttttggaagygttygygggtygttaagttaygttgygagttttgtttaggaaygtttagtygttygtygaagtttagtattttygyggyggygttataggtgaatagtatygggaagtagtygtggttttgygyggagggygggggttattggagygtygyggaggggaaatygaggtyggagggaaggttaggygggygtttggtygttygggaggtagatgttagtttaaggatatagaygggttatagygagggaggttyga

SEQ ID NO: 11368 - DNA, 691 bp, synthetic construct
  misc_feature 1..691: note = Description of Artificial Sequence: Synthetic polynucleotide
  source 1..691: mol_type = other DNA
yggygattagttttygtagaggyggggttygagtttttagttagagttttaataagtagtygaagaaygygggtagaggtttygatatggttaggagagtaygtygtygttygtaggtgttygggtttygtygagatygggaagaggtggygtygttagttttttttagatttaggggtggttygataggtttaatttygtttttygttttgttttttygttttttttttyggygaygttyggttygyggttggtyggttygtygygygtttygggaygagggygggaggygagygygttggtygtygygtatttattattgttaaygtygtygtygygttttttttattttatttttttttttttaggagaatttttagtttyggtttttttygtttyggygtttygttaygtgatttygggtygttttttataygtgatygtttttttttttttttttattttygtattygttttttttttagttttttgtttygttttgttggtygttaggtatttyggggagaggtygtttggaggyggggttttaggttttatttttyggagggtggagaggggygggtaaattaygtygagtgggyggggtttgaatagaggygggttygygggttttttttygtygttttttyggttatyggaygagyggtttygtgttyggtttttttatygt

SEQ ID NO: 11369 - DNA, 1024 bp, synthetic construct
  misc_feature 1..1024: note = Description of Artificial Sequence: Synthetic polynucleotide
  source 1..1024: mol_type = other DNA
ygygtatttattttgggttgtggagtttagttggtygtygttygtttyggttaygygttgyggttttaygggttygggagygagggtttygttygygtyggatatgggtygtttygtygagttygygtygygtygttgtygtttagttygtygttyggtagggygtayggaggaagggttgtgaggtgttgggtgtagggaattgattgtttttggyggaaaaatatataaaattaaaaaaaaaaatgtttttagagaagagtatattatttttgygggaygttttttttttttttattttttttttttaaattttatttyggggaagttttgatttgaaatttgygaagaaaattgttatagygtaagttgatagyggyggggttttaggggttygaggtggatttagyggggaggggttggaaagagagatygggtttgggagaatttyggggatggggattaaattttttttttttttygttyggagattattatttattttygtattttttygtagtygttttaagtttttttttttttttttttttttttttttgtttyggaaagttagygagttttyggtagyggtygtattttygtttyggtggtttgaygayggyggyggtygtttttgygygttttttygttttttttyggtttagtttagaygtygtagtggyggtaattgyggtagyggtggyggttttgatttygygtatttygttttttttttttagttagtttattttagtyggtttttttgygagggggttttttttttttttgtttttttttttttttttttatttttataattttgaaatatttttttttttgttgtttttttttattatattyggatygggaaggtttygaatttttggttagyggtttygatgttgggagyggygygattygggttyggtygygygatttttygygttttgygttgtttgggttaggaggttagagtyggtttgggttggttygggttttttattygggygttgygttttttygg

SEQ ID NO: 11370 - DNA, 1339 bp, synthetic construct
  misc_feature 1..1339: note = Description of Artificial Sequence: Synthetic polynucleotide
  source 1..1339: mol_type = other DNA
ygtygygggttttggygagtaggtgattayggatttttggtgtttgttgggygagayggtgaagtaatttttttttygttttttttttygtttagaaaggtgtaagattygttaaatygtgygttgtatagyggyggtyggagtagaygygggatggtygygygttttttgtatagtatagaggggtagtyggagagtttgggaaaggtaygagyggggaattagagtatagggtgyggattagaaagagtagayggttagtygggyggggaaggaagttgtygagttgtaggtgtggaaggggttgttttaggtttatttttggtagaygagggggyggggagtygygtyggggaygaggagattgyggatygggygygttttttgygtagtygttygttygygtgtttaagtttttygggaatggttttygtttaggggtttagttygtygtygttagtttygtagagtttgtagttgttggggttyggtagtygttagggggygggagttgygtygygaataatggtygygtttggtygygggttggygggaggyggagtggaggtagagtyggtgtygggygygygygtyggtygggygtgttggggygygggagyggttgygtaggygggggygygyggygygagygygggagggygyggygggagygtyggggaggygggyggaggygggyggaggyggggggyggggagttygaggggtggaagtyggyggyggtygagyggggttagttttttgtagtgtttgttaatgttggagtygtttgtaaagtgttttyggtaagaaggtaaatatttttatygggggygttygggagatttygattttygygtygtyggygaagaaggtagagggygttggggagttttgtagtttygtagtayggggaattyggagaaaagtagtttttttygyggttttttttttttygygtttttttttttatatygggttttyggggtagtagyggggaggggagatyggygggggagggaggatagggaggygaaggaattggggtggggggtgygtgtgtggtggagggggtgggaygatataggtgttttgaggggaggagtygggaggaaggygaggaggtygggttaagtgggggtgyggaggtyggggagataggaaygyggttgygggygygggaggttggggttttagggggtyggggtggtagyggtyggaagagaggayggygagtgtagttayggtgtggttgygagggagagggagygtttagagtagggtaggggagggyggttyggggagggtttgygggaaatgggtttgggggygttggaggygg

SEQ ID NO: 11371 - DNA, 2273 bp, synthetic construct
  misc_feature 1..2273: note = Description of Artificial Sequence: Synthetic polynucleotide
  source 1..2273: mol_type = other DNA
yggtttttagggatygaggggttygtagagtgatttattttattttygggaagttgtygggagtttygyggattygtygyggtttttagtttttatgtgtaggggtttyggggttggggtttggttagtgygaygtttygttygyggttatttatagttgttgaggaatagtagtatygygaagtygagygtggyggtggttagtaggattaggtaggygttgtagggtattatgaagtttygtattagtagggaggygttaggyggttgtygggtgtttygygttagyggtagyggaggtatggttyggggtttyggttttgygttttatttttagagygtgggggttttttayggggtgtttttgggtttttttagggttgttygttttattttgggatttttggggyggyggatagtagttgtgtttttagagtttatttagttatagttttgggggtgttaggtttyggttttagttttttaggtttatygtgggaggagggtagaattttttyggagtagaaattttaaatgtgggtttygaggtaggyggaggagggattgggagttygtagttatttttgttgtttatagttttttygggttggtygttagygttyggttttttyggagttttyggagtygygtaggtyggagaggyggtgygygyggtaggtgygygggggtygggygtygagggtttgttgttttygttttyggtagaggyggaagyggygataggagygggtaggtaggaggggyggtygygtygggagygagaagaaagygtygtttgyggaggtygygtygggtttygggttttttttagtttttttygttttygyggggttggggaggtgagtgaggggygaagaygtygyggagggagggygggagtagagataaaggaagtygtttttagggatttyggygttygyggggagttttagaggatygggyggatgyggaygggagagygtygtataaaagggaaygtygggtaggyggggtygggggtgtttggttggggttggggttggggttgggttyggggtygggagygttggggttggggttgggtygggattggggttggggtggttgaggttggggtygagggtgggtttgaaggtgttgggattgggggtgggattggggttgggtttgggggygttgaggttgaagttggggtygggggtgggattgggggygttggggttgggtygggggtgggattgaggttgygggygtttaattgggattgagtygagggtagyggtggggttgggtygggggagtaggggtygygtygggtagygtygygtgttggagyggaggygggtgyggtyggggtaggtygygggaggaggaagygtttggggagtaggagttgggtygggygggttygygtttygtattygygggggtgaatyggagtygtygtagggggttyggggggtygygtgygatygygtgtgygygtygtygtgygtgtgttygygagtgtttgygttygyggtttygttttggyggggygtaggtgggggagggttttaggtgyggygygagttggagggtggagtgaggtgagyggtttagaaatygtttygtttatttttttttggggattgatagtggtttttttagtygtyggygttttygattttygygyggggyggggttatgtaaatgagttttatgtaaattgyggyggggattttttgygggttygtggggttggaaygtttttaagaggtygtttygggaaygttygggttttgaygttattgyggttyggggyggggaatgggggtttgggtttatttgggatttttgaygygtagttyggygtttttatattygttttygtaggtygtttttttttttggtygttgtttagtygggggattygggggtaagggaggggttygttyggttyggtgtgtgtattattttttagagtttatgttaggttygattattttggaggttagaatttttyggygatygtattttagygttttygtatatttttggttattygtagtttttggaagggatttttgygtatttattattttgtttttttttttgtttttgtaatgatygattttattttttaagttttagttttaggaaagtaaggattyggygttagggygtttttgtttygttagttttttttagtatygyggattaagttatttgttatattyggttttatttattttgtagaygatagttgtyggtagttattagtgttatygygt

SEQ ID NO: 11372 - DNA, 5586 bp, synthetic construct
  misc_feature 1..5586: note = Description of Artificial Sequence: Synthetic polynucleotide
  source 1..5586: mol_type = other DNA
ygggtttagtttygtatayggattygttaggagtaggtggttagtaygygttgttggyggygtattaygtaggtgtaggtgtttttattgayggygttggygatgatgtttaggtgygtttygtttagggttaggtagtyggggtaggagaattttaggggtttttggtttttgtattagttgtaggggggyggggygttttttgtaggtatagtttttttygttgtttgtttygtatttttgttttaaggtygttygygggttgtttatttygaggatygttyggggygtttatttattatatttttttttttttgtggaggattttttggtygtagyggaaggttaygtttttgttttygggtattagtttggttttggttttggggggyggtggggtggtggttatygtggggaaggggaattttgtttygggtgggggaaagagtttygttagtgtttttttagtttygattatggttaaggtttagtttttaygtagttttgtttyggtttygtgggtattatygtagtagaagtygtagttgttggggtagagtttttttatgagtygtyggygagygtygtagaagttttttygygtttaggaygygtataygaatagtttgtygaggtattttgtygggagygtggggagtayggtttggtttaggatygttyggttttygttttttygttygataaagggatttatygtagagtyggtgtagtttttatagttygttttgggataaygttttttagtygygtagygtggygtttaggtgtatgagygttyggtygtgttgtgagtgtattaggtttagygygtggtygatttygtgggtygttaygtgtattaggttygtgagttataygtttgygggtttygggggttagygtttgggagtttygggtttagtttygtygttygtgggttagtttttygaggttyggtgtatttgttggagygtagtygyggagtygttttyggtygtagttayggaaagataagaatgttttgggtttaggyggtgagttyggtttttaggaatgtagttttagttttygttttagaggygtagggggatgggaaagggagtttagggttgtygggatgggggtttttaygggtttttttttttgtttgttagattttagtggtagttattatttyggaaggttttttttgtygtttgttttaaagttygatygyggtagtttattgtgttgtagaggagaggtttttaggaggttagtttggayggttattttttttttagttgtagygygtggggtttaggatttagtattygttgtygtygaagtggatgtygtygtgyggggggaagaaggygtgggttagttttttygtggggtygtygaagtagtggtgtagygyggagattaggtagttygtgtggttgatygggtagaagtttggggggagtayggggttgagaggtygggygygtagggtygggtyggggygggggygggygtttatttattyggaggtygttgggttgttygggggttatttygyggaagttgaagggggataygtygttttatatgyggaaggyggtagttagggttygtygygtttttygygggtttagtaggtttygygggaaggagaggattttgtagggagagtgagtttagygggygtyggtygygttttttttttyggggtttagttagggygtatttgtaggtgaggttgaagtggttttagygtagtttggttggagttagygtgtagyggygtttgyggggggttagtgggttygggattygggtgggggggatygtygagaggtttagygtagygaygtttttttttagggaagaaagygtgygtgggaggtatyggtgayggtttttaggattaaaaattgtygyggaaaatggattggaaggaaaygggggtgggggtgtttagggttgggagygggygtggygggttttgtttgtttgtggtttygggttttttaatttgagygttttgttgtaygtttttgggaaygyggtttagtggaggggaaggggttgaatagtagggygaggttttttattttttttaataattggatataggggygtttaatttttygatttygggaygtatattyggatttttaaatatttygtatatttygtataygttttgygggtttttygatagattagatttatagaygtgaggatttttttaattyggtatttggtttttttttygtygtttatttgygttgygttttaggtyggtatygtyggggtttttagtygggttagtagtattagygyggggaggaggtatagggygattagygyggttttaagttagyggygttygaygtttgttttyggggttttygaggggataygggtttygyggtttatggtagatttgttgtggggtttagggttgtatggggtagtaaggygygggggttygggtygtagagttttyggggaggattyggaggggaggtagtggttyggyggttygggttatagttyggtgtggtgggggggagggagayggggygggagagggggtaaggttgtttttgaagggaattagttggttygttygttggtygagttgtttgttgtttttagtygggggtatggggattygygtttygtgggttaggggtagaggtttgggtatggtttgttgggyggggttttyggaggggggagygaagagggttttaggtagttygggaagggtagygttagggttttygtttaggaaagggtagtagtgggggtttttaagtttttattgttgggtagtgagtgatttggtggttttttttttaaatggaatttttaaaaaatttttgagttttatatgagyggagtttttattttggtttaggtagttgagttgggtygtaggagaygygtygttygtttgatagtgttttygagagttgggaggggatggtyggatggggaygtggtagtgagtatggggyggtggagggggaggyggggagggggtgygtgggtaggtaagggtygyggagggtgttaggttgyggggyggagggagggaatttgttagggtttttyggggagtygggaaggggygggttttggttgygggaagtttygtggagggtagygygtgaggtggagggtgtgtggtttttaaattttyggttaggttttagtaaaggggagagggagaygggagggaygggaaayggagttaagygtygggtttggaggtttggatyggttttgattgggggygggggyggggagttyggagatttaaaggttygayggggyggtyggygtttaggygygagyggttttgggttgggatygagatygggtatyggygtttygyggggygggggtgggggattgggtagaggagtaggagatttygagttagatyggtttgtgtttgtttygttttttttygtttttygygtyggygtygggtttagggtgayggtagttyggttaayggggttagygttaagtagttggyggyggtygygggyggtttttggaaagygygagaggttgggtttggtygtygtatttgtttygatatygtttttygtttttttagttygttatttygtttgygtgygttyggtttttagattttgtttgggaygttttttaattaattttttgttgggaygggattttatagttttggggagtgtygggttttttggattagagygygagttttygyggtygtttttaggayggaagagygaggggggttygggggtagatataggagttttygtttygtyggattygggtttggggggygggaggyggtygtgttygygtttgaagggtgttttggttygaaggtygtagttygggygggagtttggattygagagtttggggygggyggggyggatttagggaagggtttttttttttygtttttaggttygttygygtgtttygaggggaggattttagaggygttyggttttttaggtagatagtagaggtaaygttygagaatttttttttttataaaatatagggygggggtaygygaaggtagttygggygyggyggayggygyggtttataygaagatttggatgyggtygyggatgggttggyggtagatggggtaggygttgagygyggagtygtagggggygtatgygtygtggtygtattggaataygaggyggatgtggttgtygatgtagatggggtaggtgatgygtttttttatttgtyggtagyggttttgtagtttttttattagttggygyggygggtygggggygggggyggygttygttattttagagtygtttgyggggtgggggaygggtgtgagttgggaggtygggtgggggaatgyggggagtagggagttgygggggggygaggttgggggyggggtgttatttgggaygggttgtgatttgtaaggggggttggyggggtgggtgatttggaggtagaggtggggttygggtgygggtaggaggtgagtygtggaaattaggtataaggtggtgtgygggttggagttagggttgtaggtgggttgtgagttgggtyggggtgtgatgggggggyggtgttttgggtgggttgtgatttggggtggggttatggagggagtgtgatttgggaggggtygtgaaatttagyggggttggggtgtgatgggggaggagggtgttattttgaggyggggttgtgggtygggtgtgatttggagtaggtggggttgggggttgggggttggggggtygggtgtgagttttgggagggyggggtgtaatttggggaagggttatgggyggaagtgtgggagggaaggggtgggggayggggattygygggttattagttgagtaggaggygtgttgggggygtagagttttatttatttgggygtagttttttgttgaygattatttggtatttgatgtatttttttattttgygygygtattttgygaagaggagagygyggttggttgyggttttattagtygggtttttttatttyggggttttttatttatttttatatayggtgyggtgttggtayggygagaatagtattagtagygttagttyggagtatattaggtatttagyggtttygggtttyggygyggygtttaygtgtaggttygttayggtgttgggggtttygagygtttgtttggggttyggggtygygttttygttygtttgtygttttttgtagggggaggaggyggtttgagaggggttyggaggtygtyggattttattttygtygtttayggatttatyggaagygttgggygtagttttgaagggttttgagtaygygattttyggyggttaggtttagygggtttygatygyggtggttggtgtagtttaygtyggygttttttagygttaggaagtaggygatygtygygtttatygttagtttygygttgtyggggaggttygaggtttgtagttgggyggtaggatagaygtyggtgagggygggygtyggggtaggttygagggaggygttttttggtatttggtagttttagtagtyggygt

SEQ ID NO: 11373 - DNA, 1264 bp, synthetic construct
  misc_feature 1..1264: note = Description of Artificial Sequence: Synthetic polynucleotide
  source 1..1264: mol_type = other DNA
ygygggtgaatygagygttttttygtttttttggtttgtagttagagatagtttttygtygttygatttygtattygttgaggagygtagggttgtgttygtatttygtttygtatttgtttgtttagggaaatygggagtttygygggtttygtygygggaaggaggyggtattgggttttaaaaattygtgttgaggagaagtygagygttttaatatattygtygtyggtygggtygggttttygygygtttygaygtygttttagtttygttygygygygttygataygttygttttygttttygttttgatatagatataygygygygttttygtattattttagaagtttattyggttygygygygtatttagataygygtggtttatattygtygtataygtttttygtataaataygygygttttttaygttttyggttattttagatatayggtttygggttttaygtaggttygggygtygatatattttygyggtatggataygygtgttttttatttatttttyggttaaaygtatttttttttgtagttttttatttttgttttttatatttattttttattttygttttagaaataygttttttatatygggttygtyggatttttatattttttattygygttagaaaygygygtattttygtggtttttttttgtygygygtaaataygttyggttygygtaygttttttyggtttggtttygtatattygygttagaaataygygtggtygygtattaygttttyggttygygagtaygygtgtttttaygtttyggtttygttttygtttygygygygttttygttggtygtygttttygatygtaygygtttttygtttagtttygygtygtygygtatttattyggatttgttgagttyggtttttgttygttaggtttgygtygagtygtygtttattggttttygygtttygttyggtttygttyggttyggtttagttyggtttygygttygtttagttttattygtygtagttggaaygattygyggggtttygggtatygyggttttttygttattgttygagtgygtygttyggattaatggyggggygyggyggtgagtttatyggattagatttygttttttaggtygygtggtttaatyggaggatgygaygttattyggagtygggtagaggttggtgyggggygyggagtygttyggygyggggattgygtyggaattgygttygagtygygt

SEQ ID NO: 11374 - DNA, 716 bp, synthetic construct
  misc_feature 1..716: note = Description of Artificial Sequence: Synthetic polynucleotide
  source 1..716: mol_type = other DNA
ygaygggygygtgaggtttagagaggagtagtttygggattygtttttttttttgtttgattttggttaggaaaaggggtttggagygttttygggtttyggaaaygygggatttttygtaggtagtygagtagggyggtygtyggggttatygttgggygtygtyggagttttaattygatttatgtgygggatttyggttttttgtgygggagttttygttttgygygtygggttttyggttttygttttygggttgggattyggtttttygtyggttttattgagttttygtttyggatttgtygatttttygatttyggggagagagattaagagattgggaygtaaagggygtgaggatygtattttttattygtaggtttttttaggggygtygygtygggggtttyggttggygatygagtaggtttyggtygagtattgtyggygttgttatttgtgtgtatyggggatagggayggagggaygygatttttatttattyggttygtttatttgggtygttygygtttyggyggtttygattygaygttygagttagyggagttyggagtygttgggtttttygtttttttygttygttygtttttttygttttttyggtttttttygtttygtygttttgygtygttttattataaaaggtgaggttyggggggagggggygygggattttygtttygyggaagygg

SEQ ID NO: 11375 - DNA, 619 bp, synthetic construct
  misc_feature 1..619: note = Description of Artificial Sequence: Synthetic polynucleotide
  source 1..619: mol_type = other DNA
yggtggatygtttgggygggtaaaygtttttttaygttggygggtaggatttgaattygggtttttagggttttgtaggtygttattgttttygttttttttttgttttyggtttttttygtttggtttgtygyggttygtygttttttttttttttttttttttygttygttttttgttttttgtttttttttttygtttttttttattttttgtttttygygatttttttttttttttygatttttyggygtygttttttttttttttttgttttygtagtttaaataygygatatttggagtaatagtagtygttyggyggtttgggttttattataggtyggtttttatygyggygtgtattatattattttattttaaagaattygtagagaaattygtttyggtygataatagaaagtaaaaatatagttgatttttattagggtttttttataggtttygygtgaggtaatgaaatatggaagyggtgagatatgtaatgttttattaagyggttttagttataayggygtgtatgttaattaygtttgtaggttatygttygttttyggttgtyggattatttagygygttttttttygagtttyggaygg

SEQ ID NO: 11376 - DNA, 293 bp, synthetic construct
  misc_feature 1..293: note = Description of Artificial Sequence: Synthetic polynucleotide
  source 1..293: mol_type = other DNA
ygttttayggggtaaatttygaggtttagtttygygtgggagtygtagyggggygggttygttttgggttgggygggtttttttagygtagygttgggggttgygggttttttagtagtyggagtagtattttgagtttyggttgttggagygttgggatttttggttgtygttttygtagtagtagtaattattatttygttgtyggyggygtttttttgggaagtagtagtaattggtggagttggagtygtagtagtttgagtygtygtagtagtttttgtyggagtygt

SEQ ID NO: 11377 - DNA, 2748 bp, synthetic construct
  misc_feature 1..2748: note = Description of Artificial Sequence: Synthetic polynucleotide
  source 1..2748: mol_type = other DNA
ygaatyggtttttttyggtttygtattttttagggtygttyggygagtttttgtatgttttttattygttaagttygttattyggtttygtttttttataygygtattggtaygtttttttttagtttttagygggygggtagtttgtygggtatttaggaagttygggtttttyggygtyggaggatttataatttagttatygtaataagttygygtagttaaagtagttygtttgggtattaggttttatygtttttgtttygtggttttaagagggttygtgttagttttygaggtatggtygtttggygttyggtatattttagatttatttttttttgagggtaggggtttttyggggagagaaagagtagtttyggggttygtttygggtttttttgtatagattttttaggtayggagaataatggaatagttttgygygttttttttattygagtaagttttgttttttttttttygtttgttyggtttttattagttatagggtaaaggtttttyggttaaataggagtttyggygttaaygtttagagttttygataygttttaaaagatttgygggtgtaggggttggggttagagtyggggttgaggtatyggatatgygtttagatgygtatagttggtagttygttygttttyggttttagaygttttttttagttagaatttttatatygyggggaaattygatttgygtttttattygggatttatagaggaagtggagttttagttgtgtttyggggttaattagtttttatatttgtttttttatatttgttttttagattygggttttygttggaygttttttttgtaatgygggatgtttttgttaagygtaggttatattataayggaggtttttattagttttaggttttgttatattgggattttggttttatttttgagagtttgtaatttttttattttttattttattgtttagttttatttygggtaggttagagtygagttygggttttygtttgtaatgtttttaagaaggtatatttgagttatgygtatttggaggtgggttagtttagtatatttgggygtaatgtttattatagtttgatygtgaataggagggtttttygggaaggygtaaggggagggggtttygttttttttatattttttttagtagttggttaggagaaagttaggggyggggyggggyggggyggtaggatttatttagtatttggttgaagagtagttgttttaggttttttagtayggttattattagttyggggtttattttgaggaaggygygttttttttggtttttggtagaggggataggtttagagtttttttgygttttggttttgttggagagtagttygtygttygatttgttattttygtttayggtygttttaggygttttgttgagyggtttgattttygtatagggttttygagggattyggttyggtttttttaggttgggygygagyggagttaggggggttttggygtygttygtygggttgtttttggtttggaagagygagtgtttygatttggatagygttttggatattagyggagttttayggtttttggattttattttgtttaagtttttgggygttttggttatatygtygttttattygggtttataaagttgtagttttttttyggagttygtgagaaaagagaggttggtgagtgatttttgtttgygtaggttggaggygggyggttygtyggggatayggttgtttaygttgtyggatttgaagatttttagtttagtygygttggttttggttatgtygtygtygtygtygggygttttggygygtttgggtagtatgtttttgtygttygtygttgtygtttttttgtyggygtttygyggttygttygygttttygtygtygtygtygttgtttagttttatttygggttgtaygtttttgaygttgttgtttagtattttgttygygaggagygtatggaygattygygygtttgtaggtayggggggagggggtagggggygggagygtaggaggaggaggygggggaggaggagggggagagagaggayggaagaaatygaggaagaaggggagagaagggggagagagygagggaggagggagagaggtaagtygagggygtaggggaaagaaaygygaggaaggaagtygggaaaaaggaaagagtagggaagtyggggagygatagggyggggtyggaggaaaaggggyggggyggyggggaaaatataaattaaaatttaaaaattagttaaaggaaggatggaagtttygyggttttttyggygtttagyggtgtttttgttttggtgttyggattttagttygyggtttgtttgtttgttagtttygtggatatygtattgtygggtagygtttyggtygtatttagttagttagttagttygagtygaggttgtaggttgtagtttygagtagaggaaggagggaaggggaaggyggggagtaaataggaggaggggagygagtgtgygtayggggagggaggtgggggagagatagtgtgtttatttttggttygggagggggaggtatttgygagyggagttttaggggyggatgagtggggggtagggggaaataaaggaaaagtagttttttttttagtttttygygtagaagyggggygggtttttggattttyggagggtayggggattttttgtygt

SEQ ID NO: 11378 - DNA, 433 bp, synthetic construct
  misc_feature 1..433: note = Description of Artificial Sequence: Synthetic polynucleotide
  source 1..433: mol_type = other DNA
ygggattgggygttagttagtagttygtaggattaggyggggataggygggtagtatttataggtaagtygttagggggtttaggtttttyggaayggyggatagttygagtttagagtagtyggtagatagtatgatgtygtttttttggtagtggtagggggtygggtaggyggtgggtttygggtygggttggggggygtygtyggtttttygggaagygtatagygyggygtaaagttatagygttyggagtttyggygggttgggtatttyggyggtygggttattggggtatttggyggtygggygyggaygtayggygygatggtygtagttgttttttttyggtttyggygggttgtatygtyggtggggatygttttaggggttttattgggyggyggyggyggyggtgggagygtygggaygg

SEQ ID NO: 11379 - DNA, 1376 bp, synthetic construct
  misc_feature 1..1376: note = Description of Artificial Sequence: Synthetic polynucleotide
  source 1..1376: mol_type = other DNA
ygygggatttttatttttgygaggtttttagagtttttttgggaggaggttttygttggaaygtgtttgggtgaggagagggagatyggtttttaggtagggayggttagggtgygygtattttagtttttgggttatttyggygggagtttgygttttttttaggygygatttttaggaaggtttygggtggtgatygtagattggagagtgagttgggttggggaaagagtgaggyggatygtttttaattttyggtaaagtgtgygttttygttttattatttaggggyggyggtttttgatgagtttatgggggyggggygttaggagtttygttygygagtttttttttygttttygygaagtagtagttyggaattygyggttagggattygygtaggtttttttttagttgaggggyggtygggtattygggtttygattygygattatygtatttattattattatagygggaattgttyggyggtttttagaagtttyggttyggtygtagaggtgggttttygagtatagaggtttygaaattyggttygtagtttttagttttaatgtyggggggygyggtggtttygggygattttttatttygtttttggagtttataggtggttttataatttygyggttygygttgygttygyggggtttagtaygttgtygygggatttgtttaaygtggagtgtgtgtttgttttttttygtttyggttttyggygtagtttttatttagaagaygaaattgaagaygaagagtaggtatttgatgtatttggtgtagttttttatttttatggyggygygggyggygggyggtttgyggggygygggtyggttttgggyggygggygggtyggygyggggtttggygggtggtyggtaagggggtttggygggtygaggggygggggygygaagaaaggggygygggggygygggggygygggggygygtggggygttgggygtyggaggtttggtaggatgygyggtggggtygtygtygtygtygtygttgygygttygttttttggtygggygygygtttygtttygtagtatttatagggygtygyggtttygtttttttataggtttygtttyggttagtttaygtttygttttyggtttygttttttgtygttagggygygtagtygaggggtatggggtygttgtatttatttttaatttggygygtttyggttaggattttagggtttaggtgtatygtgttgggygygggaggygtttttaagttgttgtygygtttygagtttttaagggggtggtagtagggtygygtttgaggataggtatgtagygtttgtttaggagtgtagtttyggtgtygg

SEQ ID NO: 11380 - DNA, 3393 bp, synthetic construct
  misc_feature 1..3393: note = Description of Artificial Sequence: Synthetic polynucleotide
  source 1..3393: mol_type = other DNA
ygtagyggaggygggaggagagtttttggygggtatttgtttttygygtttttygygygtttaaggttgggtttyggggtattttattygggtygtttygggtttagttttagtttagaatgattttatattttttatatttttaagttttagaaattatygttttgagaattttaaggaggatattttttttygggttttttgtagygtygagtttyggtaggttttttyggygttygtttgttgygagatttttttgtygtttygaggagtaygagattttagtygtttgtagattatttatatttgyggagggtggtagtaggggtttggttggtttgaaaygygtyggggaggygygygttgtattaaatttygtttttgtttttaagggtagattyggggtaaggggattaagattttygaygtatttagygttatggggatagttatggttaatattttgtttttgyggttaattttaaggttattaaaattttttattygtagagagygygtatagtagtgyggatattyggggattgttttaaggaaggttgagttttgggagygygtggatttygttttatygttyggygattggttygyggggttgggggyggagatygagttygygttgtataaatatttatgagtyggtagygyggygygagyggggttggagtygggaagttgggttaagggygttgttttygtygaggaggaggyggyggttgggygygggtygygttatttaggtgttygtttygtttttyggtttggatttgtttttgggtgtttagtaggaaggagattgtgtgtatttygttygattgyggtyggagygyggygttgatttttttaggyggygggggttygtttgtttyggyggyggayggaygaaggayggaygtyggagaaagagggyggyggtttgggtygaggygggtttttaatttyggyggyggyggyggyggtttggttttgggggygggtatgagttttygggggtygagtggtggtygttagggttgattyggygyggtaagyggttyggtttagttattttgattgygtatygyggttttagaggaaatttgyggygttttygttttttttgttyggyggagttatygtygttyggygyggyggggagaagtggtygggygygyggagaggaggygagygagygygggaygatgagtygaggttyggtygttttgygtygygagggttgagygygattyggggttagtagagyggatttayggattgtggygygygtttgtagtygtttttaaattttyggagyggyggaaaggagtgyggaagggttttgtttaggttgygggtygygtygttgyggaygygtttttagaaggggttagattatyggtagatttttttttygggygaagtataagggagattttagattattygttgtattygtttgyggttttttygtgggtttttttttyggtatttttttgygygtygtttggagggygagggtatygggtygaggygtatagtatggagtggggttatttgttggaagtgatttygttgttggtygttttggygttgttgtagygttttagyggygttgyggtygtttyggttaaggagttggtatgttaagagattatygtgtygttgtgtaagggtatyggttataattatatttatatgtttaattagtttaattaygataygtaagaygaggygggtttggaggtgtattagttttggtygttggtggagatttagtgttygttygattttaagttttttttgtgtagtatgtataygtttatttgtttagaggattataagaagtygttgtygttttgtygttyggtgtgygagygygttaaggtyggttgygygtygtttatgygttagtayggtttygtttggttygatygtatgygttgygatyggttgttygagtaaggtaattttgataygttgtgtatggattataatygtatygatttaattatygtygygtttagttygtygygtygtttgtygtygtygtygttyggygagtagtygttttygggtagyggttayggtygttygtygggggttaggttttygtattgyggyggyggtaggggyggtggyggyggggaygyggyggygtttttagttygyggyggyggyggtggygggaaggygyggttttttggyggyggygyggttttttgygagttygggtgttagtgtygygygtttatggtgagygtgtttagygagygttattygttttataatygygttaagataggttagatygttaattgygygttgttttgttataattttttttttagttaggaygagygygtttttatygttttttggatyggtttgtggtyggtgttttgtttygtgtttattttygttatygtttttattttttttatygatatggagygttttaagtattyggagyggtttattatttttttttyggtttgttattttttygtgtyggtgggttatttagtgygtttggtggygggttaygagaaggtggygtgtagyggtggygygtygggygyggggggygttgggggygygggyggygyggyggygggygygggygyggygggygygggygygggyggttygggygggygyggygagtaygaggagttgggygyggtggagtagtaygtgygttaygagattatyggtttygygttgtgtatygtggtttttttgttggtttattttttyggtatggttagttttatttggtgggtgattttgtygtttatatggtttttggyggtyggtatgaagtggggtaaygaagttatygtyggttattygtagtatttttatttggtygygtggtttgtgtttagygttaagtttatygyggtgttggygtttagttyggtggayggygattyggtggygggtatttgttaygtgggtaattagagtttggataatttgygyggtttygtgttggygtygttggttatttatttttttatyggtattatgtttttgttggtyggtttygtgtttttttttygtattygttyggttattaagtaataggayggttttattaagaygtataagttggagaagttgatgattygtttgggtttgtttatygtgttttatatygtgttygtygyggtggtggtygtttgttttttttaygagtagtataatygttygygttgggaggttaygtataattgttygtgtttgygggatttgtagttygattaggtaygtaggttygattaygtygtttttatgtttaagtattttatgtgtttagtggtgggtattatttygggygtgtgggtttggttyggtaagaygttggagttttggygttttttgtgtattygt

SEQ ID NO: 11381 - DNA, 1381 bp, synthetic construct
  misc_feature 1..1381: note = Description of Artificial Sequence: Synthetic polynucleotide
  source 1..1381: mol_type = other DNA
ygttttaaygtgttgttttggtattaggaygygtatggggaggtggagataaayggtgygtggggttygygtgggygygaggaggggtygttayggtttttttgagagtgygttgttgagttyggttttggaggygtgyggyggggaggggttagttttygggtgttttgtgyggttyggttggggttaaagttyggggygggtttgtttttgtgtaygtgggagatggttaggggtgttggggatttygagggttggtgtgaggtttygggagttatyggggtgattggtygtygttygtagaygggaagttttaygaygtttaygttttttatagygattgtttygaggatygtaagttygtgaattttattttaaagtygtagttggagyggygtyggggttataagttttttttggaygatygygattttttgtygygygttggtatttygggttttatttygtgtttygtttattyggagggttygtttygtttygttttatgtttygttttattyggggttttatttttattatygagtttygtttttattttygtttattygaggtttygttttaaaaattygtttatttygtaggtttygttttttttttagagttttgygttyggtatygtttttgagttttyggtttygttttttttygttttygtttttgygtygtygaygttygttttttygtagagtttttygtygattttttggtgaatttgagtygttgtygaygttttatygtggtgttttyggaygtttttttgagtygggtttggtgtagttatagttttyggtgggtttygygyggggttgggtgggttttagygtagtatttatttttttgayggtttygtttygtagggagggtttgtgtyggttgttggagtttattygtagatttatttttattattttygagggttagaggygygatttygygtattyggygtttygtttgttgygttagtatygttatttggtgattttgttgttttggaggttyggtttygtggtgyggagtaggygygggagggttyggggttagyggygggttagagatgggyggtgttygggttttaggttgggattttttygtggggagttttgyggtattaygttttgtgaatgggttttggggggaggtttygttgtttggggtttygatgyggggagtygtttttgaggttttyggagttayggaatagttgtygtagggygtggaattygtgggtagtygtaggtgtgtttttgggggttaggaygttaggggttttygaggtgtttatatttgtaaatygtttygatttggtttttagattttttttttygatttttggaaagaagtgtagttggygttgtygygg

SEQ ID NO: 11382 - DNA, 493 bp, synthetic construct
  misc_feature 1..493: note = Description of Artificial Sequence: Synthetic polynucleotide
  source 1..493: mol_type = other DNA
ygagttgtttttgggygygtttggggttgtatttgggttaygtgggygtygttgtgtagtyggtatttttyggttaatttygyggtttggagaaggggttttgtattygtygtygttgtttgttttygygyggttttygtttattgttttgyggttgttttgygggttgaaaagtttttttyggtgtagaatttygggtttagygatagtttgygtygagtgtgygtatttgtyggagattygttagttygtyggtygyggtgagtggtttttggagttattggtttagggygggttygygggatggggygggyggttyggggygtagtyggttaggtygttgttatggtaaygyggtggaaaaaygggtttttgggtatttygttgtyggtyggttggtaattttttagyggagggatygggtygagttygyggattttttygagtgttttttggggtttagtygttggtattttatttttttygggttygg

SEQ ID NO: 11383 - DNA, 922 bp, synthetic construct
  misc_feature 1..922: note = Description of Artificial Sequence: Synthetic polynucleotide
  source 1..922: mol_type = other DNA
ygtgttttttttygttatttggtayggttygtgttttygtygttgatttggtaggttgygygygtatatttyggtygggtgygggtyggyggggtatagyggtttttayggttygttttygttagttatttttyggttttttttttygttgttygygtgtttygggtyggtttagtatttttygagttaygtgttygygtttttyggyggggaggagygtagtygygggggygygtttyggtgatttygttttttagttttttttttttgagttygggagttyggttygygyggttaggtgygaggagattygggattttaygttygttygttttgtttagygttttagtttyggygtgygaggygtygtttttttttttgttttgygyggtgtatggaggggttygttyggatygtagtygtygttatygtagtygtygtygygygygygyggggggatgatttgggggtggtttttygagtyggttgtagygtaggaggtttggaggtttagttagtttygyggagaggtgygggggtgggggtttygtygtagggtyggagggaggggtggygygygggtattgggtttggggggttttggtttaggggaygggaggtttyggggaygggygggtyggygttttttggagggygtgggggtgtagggttgygtgyggggtttggatgttgatgtttgttyggyggggagtttyggygtttygygttttygggggttyggaggtatttygygggaggaggyggggtgaggtgttagtgataygaygaaatttttttttgaygatggttttygggggtaggtgagatgtygtagagyggggagttagggygttygygygtttttttaagggagtygggtttttggttttttttaatttttatttttgtagagygttygyga

SEQ ID NO: 11384 - DNA, 719 bp, synthetic construct
  misc_feature 1..719: note = Description of Artificial Sequence: Synthetic polynucleotide
  source 1..719: mol_type = other DNA
ygttygaggatgttggaggtgggggtygtygttttagttygggygtagggttgggggattgggggyggaaatttttygtagaattgtttygtttgtttattttaagggaayggagaggattyggtttttygygaaaatttggtttagggaaagggatttyggaaagtagtttygtagggttgtggtagttttatttygattygygttgygtttaygtgtagggttygatttttttygggaggygyggygtyggttggggttaggyggtygaggatttygyggtttttygtttygtttygtttygtgggttttygygtatygtygtygygtatttatttttaygggtggagyggggyggggtagtayggtttygygygtagtttygattygttaggygtatygatyggyggygtagygttggygygayggttygattyggtygggtttttgtttygggygygggttyggtttgggagygggygagttygtttgtaggggaggyggggattygggttygggttgggggyggggaaggggttggataygtttgygtatayggyggttygatttttaggagttttygggaggggtagaaagggyggggtggaggagggggaagggygggggtgatgtygygyggtygtaggtttgggatggtgttygygttttygagattyggatagaggtaagtaggggygtygtgggtgttagagaggygg

SEQ ID NO: 11385 - DNA, 958 bp, synthetic construct
  misc_feature 1..958: note = Description of Artificial Sequence: Synthetic polynucleotide
  source 1..958: mol_type = other DNA
yggtgtayggggttatatagtyggaaatttttgtyggtttygggttattttttttttgaaayggtttttttyggagttattttttggaggattttatttygttyggtgttygggtttygtatttattttttttttttyggttygtttttygtayggygtttattttgtttttygttttttygttttatygtygttttgtttatattgtttttygtgggygttttyggtygtttttttttttygggtttyggtttgggggtgtttagttygttyggygtyggtttaaggtygygygatttygtaygttttygagattygtttygtygttygtygttygggtygtatttatygygttygtaggatttgggggttttygttttgttygygtttyggtatygtygtygtygtygtygttagyggaaatagggggyggggtttgttygggaatggygagtttgyggggyggggyggttygggggyggagyggggaggggyggggyggagyggggaggggyggggyggagaaggatygtagggttgagyggggygttagygttagtgttyggtattgtttygggttgggttttttgygttagaggaaggggagttyggggayggggtayggggttygygaggtaygggtgttttttyggggtttyggaagttttttttttygtttygtygttygtatgttyggatyggtygttttttygaggtgttatgatttygttttttttttgyggygaaygggttttttttyggggtaggggyggggaggttygggtttggtagtgygtttttttgggttttgygtttatayggtatttaagggtttttttggtttaggtttyggttttttttttygygttaggttgtttggtttygttattttatttttatatttaygaattttttttttggtgtttygggyggattgtgygagatgttgatagygygg

SEQ ID NO: 11386 - DNA, 3843 bp, synthetic construct
  misc_feature 1..3843: note = Description of Artificial Sequence: Synthetic polynucleotide
  source 1..3843: mol_type = other DNA
ygygygtggttttyggagaggygtttattatttgygtggygttttttygygtyggagtgyggttttgtttttagygttagtgygtygygyggttygtyggtttygtaggattggttatygttttttatttatgtaatttgygtgtgygtgtgygtgtgtgtgtgtgtttttttttygttygttttttttttttgtgtgtaagagagygagggtgggggayggaggtaggtaggygagtaggtagggaggggaagaagagaagggaagttattaaatatatatatatatatatatatttatataygygygygtatatattygttttaattttttagaagtttygggattgtagttgttttatgtggggtagtagtgttggtagggaygtyggtygggagyggtygggagygggagtyggtygtgygygygyggttggaggttygttggggtttygtttttygygggagttattgttggtttygttggagttgagygtagagttyggatttgtttttttttgggygtttygttayggttygyggagtagaggagtygygtygtygagagagagaggagttatyggygyggygttttgtttttttgtygtygttttygtygttttttyggyggtagtagtttgtagttayggtaaggyggygtgattygttttayggaaaagygttttggggatygyggygaygtttygttagttttatygttttttgtattgttggttygggtagggttygggtagtttaygyggttgtygagggtttygggagatgtttgtttgtttttttggtttaggaggagggaggttagggygygggtggtygaagaggtaagttgttttggagtttggagtygtygtagttttyggagttygtygyggattggagtttgggagtaagggttgggggagggtagggaggtgggaagygggtgggagggaggyggygygttttaggttygtttgtttttttyggatttygtttttygtttyggttyggtygtttgtagtttttttgtagattagttygttttaggttttygtygggygttggaggagttygygaggyggygtygggttttagyggttgtagtttgttttgyggggtaagtgtyggttgtagtagtttygtaygggyggtggttggagtttagattttggagatgygattttagtttttygttttttgtaattygyggggygttygtttttttttatygggygttyggtygyggtattgatgttygtttaggagttaattgaggttgtagtygttagatggaygtttggagggttttygggtgtgagtgtgattgtatgattatttttatttttagtttygggaaatgtgttttgggttgaaatgtgattatygagttttttagttattttaattgttatttttaaatgyggtygttatattggaggagtagattggaaggtagtggggyggtgtgtgtgtgtgtgtgtgtgtgtgtgtgtggatatatataygtaatygaggaatatataattaattatttgggtgaagggyggggggtttatttagtgagttttttttggygggggggtygggygagttagttgttygttgttygttttttttttgtttgttttygtttaggygaggttggaaagtattggaaatttagttgygtggtttttaattttggaaattggtttygtttttagggtaaaatgttaaggygatttatgtattygygtttatgtggatgagtgtattattgtttagttgggtgtagagtttttaatagtatygygttaagtttttattygatttttaatttttttttattttttaatygtggagagagggtttatagaaatgtagttatttgtaaattatygaygtagtgaaaggggygtagggaggtagttagagttttgtttgaatttgtatattggtttggtgtttgtagtataygagattatttygttgttttgtagaaggyggtggtggggtaagttygggattttaatygtyggggtggggggtggggggaagagggtgtttatgtattgagttttgaggtygagtaaggagagagatttgttgagyggtatygygggtaattatataagttgtttyggtgattattyggaattgtgatgygagttttyggttttygaaagataagtttgaaagtttgtttgtttggggagtgtaagtatyggggygtttttatttyggtttgggtagttaggataygtttygtattayggygtttatttgtgygatgggygtygggtgttgatgttgttgtttttaaagaatyggttatygaggtagggattaagtgggggtattyggaattgatygtagaggaggagttagttagaattgaggttttattgggtttttagagttttaagttttttttyggaggtgttggaaggttttttagggaaygtygtttttagaaattgatttggtgttttggggagttttaaagtttttttttttygttttttttgggygtttttttttgttttttaagttttgtgttttttaygtgtttagaaatttgttygyggtgtttggttttttttggagatgtttaggtagtttagttatttaggtttaygttggygaggggttagagggagtagaaygttggttttgtygggttgttatttttatttatatttatttttggttttttgygttagttyggygttgatggggaygggatggggttggggtygggtatggttttygttttttygtttttygtttttgtagatagtagtttgtttttgttgygtttatttttttygtttygtygtttttttttagygtygtagtttgtgtattaygttgatgggttttgatagagaaattatagtaagagtatgtttttaaattttgattttygtttgtagggggataagttattttagttttgatatagtygtggggaaygttgaagtttgggatatattggttttgaatttttttttttttagttygtagttaggagatggtgatgtgtatgggtggggagtgttttgtttttgttatattttagygttttgaaatttttygtttttttttattgaaattttygatttgtttgaatttgttttttgttgtaaaataaattttttttttygtagatttgtggggtttttyggattttttgtygttgttatgatttttaataatgygattgaaaagttagtgttyggttggaaaaaaatttttaggtgttagtyggtygygttttgattttgttgaaggagtttttaattyggttgttagaggggttttggtttagtygtgggaatttaggaagaaggagggygtttyggaggyggttgggttagtttttygggtagggygggaattaggtygyggyggggatygtagagggggaggggaygggatttygyggtaatttgtttttyggygagtygggttygygtattttagttttttygttttagtttttygtggttygtttttttygtyggtttttagttgttttygtggtataggagtyggtygygattttttygygtttttygtyggagttygygggaygtygttaattttgggtttttyggtggtyggagtagyggtgygaattagyggggyggtygggtgggyggggtttgggygggaaattggagtygagaagatygygttttaggttaagttttagtygtaagygtygygyggtatagtgtagggtttyggtygygtttttttttygttttyggttyggtygygtttttgyggatttatagygygtttygggygttttgtagttgggtttttagygggggagtttttttygttaaagttayga

SEQ ID NO: 11387 - DNA, 384 bp, synthetic construct
  misc_feature 1..384: note = Description of Artificial Sequence: Synthetic polynucleotide
  source 1..384: mol_type = other DNA
yggttggtygggggaygtgttygygttgtttttttttyggtygttagggggygtaggaagaagttttggaggtttgtttygggatygygtattygtttttttttttygttagttttttttttattttygttgagtttygtttygtygtttgttttttgyggtattygttygtataygaatttagttygggaatygagttgygggagtgyggtttgtgtygtttyggttaggagtttgtygattgtagaygttttgygaatyggtaagatgtgttttttggggttgtttttttttttatygtttyggggttaagttattttatatgagtataataaygagttggtgaygggtagtagttatgagagttygtttttygattttygg

SEQ ID NO: 11388 - DNA, 1432 bp, synthetic construct
  misc_feature 1..1432: note = Description of Artificial Sequence: Synthetic polynucleotide
  source 1..1432: mol_type = other DNA
yggaygttagggggtgtttttagttttagygtagaatttygtttygtataatttatyggattagttaggtygtygaagggtattaggttttagttattaygaygtttygttygaygggtygtagttatgtaggagtggtagaggttgtttgaygaagttttttttgggggtygatgttttttttygggtgggaaggggygttgtyggtgagggttattttggygtyggtttgygtygttygaagtygggggggaggggaggttttygtttagtaggggttaygttygtttyggaygggggtygygygggygtttaggygaygtattttygtyggggttygtgatygttaygttyggygggyggygttgygttttttttyggggtttygtttaaggttgtagttyggttygygtygtttttagggygtttttttygttygygttgggagttyggyggtygyggtttttttygttagttttagttgtagtttgtttttgttgttttttttygttygttygttygttygyggtttgtagttttygggttygtttygaggtggagggattgtttttttygggggttgtaygtattygtagyggtttyggtttttygtyggatatatatyggtttttgtaggttgtaaagaatagyggygagaatgtatyggttttttttttttttgttttgagtttygggtgtggggggaggggaagtyggygaatagyggyggyggtagyggyggyggyggyggtagygggygaygtaagttyggatgtagtttygggggtttyggygttgagaaatagtygattttagtggygtaggayggataygaggayggttygggggattgtgtatygggtgtgygagttygtaagtygtagtaggggtygygygygttgggtttttaygygtttatggtttygggyggygygygggggttttyggggtygtagtttygygtygtttggygygygtyggygtttygtttggttttaggttygggtgtygygygtygygttttataggygtygggttyggttgttygtttttttyggtyggygygygtagttttttygyggagtagtyggttaggtagttttgttygttgtttygttttggttygattgataggygygagygtyggtagtagttttygygtttygtttttygttygtttttygyggtttagtttaattagyggyggttgagaggyggttattagggtgaygyggtatygygttttgygaggggyggagtygggggtygttaygygygtttttygyggtaaaatttaaaggtyggtagggyggttttttaatttttttttttaagtagggaygaggyggaatttgtttygygaggattgtaattttyggtatgttgygygtyggygtygggtggaggggtttygattgggggygtagggygt

SEQ ID NO: 11389 - DNA, 325 bp, synthetic construct
  misc_feature 1..325: note = Description of Artificial Sequence: Synthetic polynucleotide
  source 1..325: mol_type = other DNA
ygttgtygtygttgttttttyggtttttttgttattattttttaygttttgtagttttgttttttgtttaygggttgttaagtygyggtttggtyggtggtggtagtggyggagttagataaagttttygtttttttygttttagagttttttaggygttttaagtggygggaaggtygttagttttttaggtttygygttttttgtttggygtgggggtggggagtygygtttggttttaggagttttttggtttttgttaatttttygtttttgtatattgygtttattgtttgagatgygtygagayggttttygttgaygt

SEQ ID NO: 11390 - DNA, 1242 bp, synthetic construct
  misc_feature 1..1242: note = Description of Artificial Sequence: Synthetic polynucleotide
  source 1..1242: mol_type = other DNA
ygtttatagataaygttttttygtygttggygttggttygggatgyggtttygagatttttgtagtygygygttggtttaggggattttygtaggaygygggygggygtyggggtygggtygggtttgggtagagtgataggtttttagtygtgagttttataagtagatttatttataatatttyggataggagtttaggtygygtygttygygtygttygyggggattyggygtgaatttataygttttttttttatygtttygtygtttgttayggtttygagattyggttagttttttygggggtttttttygtygygtagtatttygttygtgagtagttttygtttgygtttttttttttttagggyggtygtttttattttyggtttttatttagyggggatttattagggygagggttgaagatttygygggaygtygygygtyggggatagygaygtatttatttttttagttatttgggaggttgtaggttygggtyggagttygaggtttaggggygygyggagtagttttggttaaggygtagggygyggggttgtatgggggtttagtttagygtgtatatygtgtattttttagygtagggtttygygttttttygtagttyggtaayggtygttattttagagtttygtttattaggagtttygtttagggtatygtttattygggtttygtttttatygyggttttygtygtggtttygttttygtttagagtttygtttttagygtatattgygttagtyggatttgttttgtagttgggttttttggaggtttttatttygyggttattgaagyggatgagtgtgaggttgattgggggtttggggatgggggatyggagattattaagaatatggttgtgttgggaaatttttttttagagtagagagggagggttttttttygtyggggtgttttttattttttagtttttttygygtgggttygtattttagttagaggggatayggyggttaggtttgygttgttgygtttgagtttaggtyggtagaggtygtagatttyggttttttagtyggtagggattygtaggtgygygtttttayggaygtttttyggggaagttygagttygttttttgtaggtygggaagtattygtttygagayggtygtattttygtagyggaagggygtttgtattatagttgtagtattagygygtgygaggyggggttagggtygg

SEQ ID NO: 11391 - DNA, 1460 bp, synthetic construct
  misc_feature 1..1460: note = Description of Artificial Sequence: Synthetic polynucleotide
  source 1..1460: mol_type = other DNA
ygygtttttgttttttttygatttagtygtaaatttygagttttagyggtygttttttttttttttygttttttttgatttaaggttttaaaagataaaygtgttatttttygtttygtttttggattttggtttygatygaatgtagtggggatygagaagygtaaggtttaggatttgttagaggggygygttaagggygtttttgtttygttaggatattatygtttgggtattttattttattttttygtagttttttttggggtygggyggggyggggyggggtaggggggtygggygyggtttaygygttttttygagtgygyggtgygggaygggygyggttgaygygttttygtyggtgtttgtgttttttygtaggttaggagggtattttgygttgttattyggatttggygggtagygagttgtagyggggtaygtttayggtygagtygtagygggaatagagyggygtaggtttgaggagtttgggygyggaygagyggttgyggttggtygagtttaaygygtagtatygygygygtttyggtttttttttygtgttygtygygygttttagygatyggayggyggtgtygygygagttggygygtyggttgttttgttygttygygtaggagttgygtattgttttgggygaggtgaagaagatyggtagtttgygtttggtygatttttttygygtagatttygttaagttgtagttgtygygygggttagggattygggaygtataatyggaygygygggggttayggttyggagttgtgygttttgggygggaggyggattygggtttggaatagygtttatataygtgtataaaggaagtggagaattgaggtaattataygagtaatgagtttttttgttygtttatttataygygtaygygttgttaaaatatttatattgtttagtgttttgtttyggatttatttagtttattgttttaattttttattttttttgyggttttygatattatyggtttttgtggattttaaagygtttatttagttttttttaatttttttttgttaagttygaattgtaaagtaaaayggayggaaaaggaattttttatgttatagyggtttgtttgtttttttttttttttattttatttgttgygttygatttttatatgtgagyggaagyggtgttttygtttttgggtattaggggagtagattgggagttaggaaagttaaaygttggtttyggttyggtttggggagtyggggaagtygtaggaaggaggyggtgggtygggaagagttttgygaagggaagagttaatygaagggttgggaaggygtttygtggggayggayggaatagttgtagttatygtttttaaaaggygggaggygtttagttaaagatttttttyggaggtyggttttgggggggtggttygattgtttygg

SEQ ID NO: 11392 - DNA, 1064 bp, synthetic construct
  misc_feature 1..1064: note = Description of Artificial Sequence: Synthetic polynucleotide
  source 1..1064: mol_type = other DNA
ygattggyggttgtgtggygatagygtaygtttagtttttggaaagttttgtagtttattaggagagttttyggggygtttttttttttggtttttttagggatttgygggtagtggaggagttttttatagygaggtagygygtttaagtyggataggatgtttaygyggtatttttttgtttygggttggaaggygaattttaggtttygygygtttagggtattgttggtttttagtagtttttttaygattagaggtaagtttygagttataatttttagttgggtgaagattatttttatttttagtattagtggtagtattattgttttttygggygygttatagygtagttgtagtyggaygyggtttygagaygggttgygygygtttaggtgagagtagygtatttygttagggttaaagtygtaygggaagygtttgggatttaggyggttyggtygttgggttagtgygtygttgtttagtatygaaatygygtagyggttttygggttgtatttgtaatattaggttatgtaggggatttagttagattttayggtygaaaggtattyggagttygyggttygttagtattatggtttttttagtagggatttttgtagttttygygagattaggggatagtaaygttttgtygaaggtagygggttgtgtygggaygyggtttattagtgataggagaagtagtagtagtagtagtagtyggggyggyggtggyggttttggttgaaagttggtggagttgtttgttyggygygaggataattygggagtttyggttgagtgtatggtttyggtgttygggtttggataggttagtttgagagtatgygaagtyggttttygggtagataataagagatatygtygggaagtgttaggaatttygygygttgttygyggggtttttttgtagtyggggttgggttagaaggatggtaaagttgygyggygtygttygggttggagtygtagtygaggagtygaagtttttttaggtygtttagtttygtygttagygttttaatygygygg

SEQ ID NO: 11393 - DNA, 622 bp, synthetic construct
  misc_feature 1..622: note = Description of Artificial Sequence: Synthetic polynucleotide
  source 1..622: mol_type = other DNA
yggtttgttaygygttttygtyggggtttattygtatttgggtyggggttggtgtttaygygygayggttygggagtayggatttttgtttttygtagtatygtttttygggtggagtyggyggtttygtttygtagagttggggttgtatttggggtaayggggtygggtttggaygttaggtyggaggagtagtatttgttaggagtaygtttygtyggtaggtygtaggagttttgggagtygtygttatgggtaygttyggygggtggggggtyggtygggttaaagattyggagttaygyggggygggggtyggtatygagggtygggaggygygaagggtaygyggyggygggaagyggggygattygaaggtttaygggggtygggaggttgyggggygttygggattttttttygggtggttatygtgyggtyggggygyggaagttagaggtgtttagaggygtygatttygtygaggttgygattttggttygttygttygtggggtattgtaattttygtatttttattttgygggtygggagtgygtttggagygggaygggatttagygggtgayggtaggggyggtagaaatatygtttaattggygg

SEQ ID NO: 11394 - DNA, 1622 bp, synthetic construct
  misc_feature 1..1622: note = Description of Artificial Sequence: Synthetic polynucleotide
  source 1..1622: mol_type = other DNA
yggttttatygggttgtaagggtygggaagttgtgtygggggygttttagaggttagagttagggagggggttygygatataggygggttttttaggygggtttagggttaggatagygyggtattattyggttagttttttgtagttaggatgaaggtyggggatagaygtttagttttagattttttagatagggttgggtagtgtyggtgggtgtttgggagaggyggaggygggygtatttttagtattaggttygggaaggatayggtgtttagtygttggagtttttggtttgygtgttttattttgattttttggtatttggtgaayggttttttygtagggtgggggtagttaggggatttgtygaggaaagttggggatagygggtttggtggygyggttyggygyggygygtgtttggggygygtggtyggttatagaattyggggagggtggaggttttygggtaygygtyggggtggtgggtagttygggayggtagyggygattygttatttgaggaggggyggggattttatygyggttaggtygaggygtygagggttttttgyggttttygttttttttygttggtttygaygtygygttygggtygggattygagtttyggtttygyggggtaggtttaggtttgygygttgygtttgtagtygaggtagaaattygtttygaggygygggygtygggttygggttttaaggatgygygtygggttttttttygyggggatagtygagtttygtyggygttttaggtgttttygtagtgygttygggygyggaygtttttttgttttyggaggggaagygggagggtttttggggtaaygtttygatttygggttttttaatttgggtygatagtyggttggtatagggaggtttgygygggagaggggyggagagagygtagygyggggtatagygggyggttttygtgtygygygygygattggaaayggygtgtagattttaaaaygagggttttatagagggttaygaggggtaggagagagttttyggagaattttagtttttygatayggttattttttggtaaaygagygagaattggggygtagagttttgggagggtygttttttyggygggagyggttygagtatagttttatagtagatgygagygyggygggygttttggtgaygaagtagygggatttgtaggaggtagaggtttggtggggtygtggaygttaygtygagttgtttagatttttttagaagatagtggggattatttaayggtttttagtagaaattaagttaggtgttygttttayggagattgttyggttgtagggtggaggttggatgagaataggygtttttttaggtaggygttygtggtggtaaygttgtttaggaggagggtaygggtttygggaagatttgygaggttaaatyggtagtttyggagaattgagygtaagaggtyggtgatatagagaggagttygggaggtygtatgttttaggttgaagttatttggyggggaygtttattgagatgygaaatataggaagggatagaggttgygtagagggaaaaggygatggattyggttttggaaaygt

SEQ ID NO: 11395 - DNA, 324 bp, synthetic construct
  misc_feature 1..324: note = Description of Artificial Sequence: Synthetic polynucleotide
  source 1..324: mol_type = other DNA
ygatttttygagggaggagatagygtygtttttttatttgtataggtgttttygtygtaggtttygtatatttatttatggtatttatataggggttygaagaatatgttyggtttagttaygtggtagatgtagaygtygtagtygtagyggtttyggtygtggtatagygyggttttygggggttgtttaggtgygyggtagygtygtttygattyggttygggatagtttgtaggyggygttyggttagtttttgygygggygataagtaatyggtaggtygggttagaygyggaygtygttttttgtttygaatttaygt

SEQ ID NO: 11396 - DNA, 1881 bp, synthetic construct
  misc_feature 1..1881: note = Description of Artificial Sequence: Synthetic polynucleotide
  source 1..1881: mol_type = other DNA
ygtattyggtttygaagaaggygtttttyggataaaatygaggaatttgttttgttttgtaaggaattagggtttgttgatttttagattttaaygagaatttttgtttttygtaggygttttataaatttttattggataattttatygygygttattgggttttygggagattygtgatttttattygttttgggygygggttygtagagttttaattygygttttyggtagtygggatttttygttyggatyggtttttaggttggaaatattatggttygtattyggggygtagtygagatttatygygtyggaggtttygggattygtttagatygttgtttggttattttaygtttttgagttttttatatagttagtttygtgattttygagtttygtgattttygagtttygtgatttttaagtttyggaagtygttgtaggtagyggtttagttaggtttygttttttttatyggagttttaygygttaattttagttaggtttygttttyggtygttttaggygtggatttaagttaggtttygttttttgtttggttattttaggygtttatygttttaggygttttttagtttaagtttaatgttyggttgttttagaygtygatagttttatgtttygttttttaatyggttgttgttggygttttttggtttaggtttygttttttattyggttgttttaggtattttttaggttagatttygttatttatyggtygttttaggygttygtagttttaagtttygtttttygttyggttgttttaggyggttttyggtttaagtttygttttttgttyggyggttttagaggttygyggttttaggtttygatttttgttyggttgtataaggygttttttgggttaggtttygtttttagttyggtygttttaggtttygtttygttttttttgtgygygtttygttyggtagtttgtgggaygygatygyggygttagtttygtttttttgtgttgyggyggyggtttttygagtttttttygaygygttttttaggttagygagtttygygtttttyggtgayggattatgtyggyggygggagygggygygggygtagaggygggtttttttagygaggagttgttttygtttygtttttygttgtatygygtttgtygygayggggatttggttaygttttgttygttgttgtagtagatattttaygtttatttggtttttgaggattttttttatggttggaygttygtgtattgggtygygtatttyggtaaggtgggtgygaaygttttaaggygttatttttttyggttgtttagtgggagtyggggaaagygggtttgaggtgygggggaygtggggygtgtygggatygyggggyggaagygggatygayggygtttgtgtttygaggggtttagggygtttgtgyggtagygttygyggttyggagtygyggyggggtagtyggggggygyggggyggaagygaggtyggtggygtttgygttyggaggggtttagggygtatgtgyggyggygygygtagtaagtttttaataaggygggttttaagggtttyggygtttgttggtyggattttgtgygagygygygygygygyggatggtgyggggttttttaggtygggtyggaggygygagygatttygtagagtygggtattaggtygygaagtygtttaggyggttttyggggagtygagttggggttagaggygygyggggaatgttygggygyggtygattttttggtttygtatagtttygttagtagtygagggtygygttgyggaygagtttagtygaggagtaagygtttyggygggattggaaggtttygg

SEQ ID NO: 11397 - DNA, 944 bp, synthetic construct
  misc_feature 1..944: note = Description of Artificial Sequence: Synthetic polynucleotide
  source 1..944: mol_type = other DNA
ygtttatagggygtygyggyggygttgtagagtttatagtagttygtgtygtygtttygttygttagygttttagygaggaagtagygygtagttygyggtttagygtattygtagtagygttygtagttygttygygttatgttttaggyggtygagygtttttaggagtgggttatggagggttttygygaygggttgaagaaggagyggttattggaygatygttaygatagyggtttggattttatgaaagaygaggagtaygagtagatggttaaggagttgtaggagattygtttygagtygtaggaggtgtygygyggttyggagttttggaagtagtagtttatygaggayggggattygtaagtggyggaggttyggggttgggggtygtygggagggygggaygygygyggtttgggggtgggaggygtygggtttggagttygagtygggggattagygatgtagtygggygggygtygyggtatttyggggtttttgtatygtttygaaygttgtagggttgtagggtygygyggggtatyggtttaattyggaggggyggyggttgggttttggtggatggtagygtygttataygttttttttttttagattygttttttaggtygggggyggggyggtagyggggaygygaagttttyggttgtataaggyggggygggagtttttggtygttggygggygtygagtagtygggaggggaagtatagggygtttygagttggygggagggyggggyggtttggtyggygttygtyggggtygyggggggaggggggyggaaagtttttgggygtttgttaggaatatttagtttataataatttygyggaaaatatygyggtttyggtttttagaaatttyggttttgygtaatttttygtagttygygtttttttgggttttaygygg

SEQ ID NO: 11398 - DNA, 1514 bp, synthetic construct
  misc_feature 1..1514: note = Description of Artificial Sequence: Synthetic polynucleotide
  source 1..1514: mol_type = other DNA
yggagtygaattyggtgtttttgttygtttggggtttygttagygygtygtaagtttttttagaaatttaaattttgtaggtygtatttttaattygtattttatttaggttttygtttggygtygatttgttttagtttaattttyggtttygtagattaggtatttttygggaygyggggtagattttgygttygggttttttttygtagtygggttgttyggtttttgygygygtataataggyggtayggygtagttttygggagygygggattygggtgttagtttyggygtttagttatagygatatagatttgggtgtyggggttygttagggagttttgtgattyggggattttygygatgtagagaattagggatygygtayggagtttaggygygtagtttgtagttaggattagtttttygttttygtygttgaagtygtttygagttttaygtttttttygttgtygggttyggttgttttagggtttygttygttygttttagagtgagygattttygatttayggagaagygattttattatyggtgttygatatttagagttaagggagygagaagaaggygaagaaagaggyggagagyggtgtattgttttygttgggattygygatttttagaaattttttygaaatttagtttygtygtygtttygtyggtagggggtatagygggygttyggggygyggyggttgagygatggggygagyggaaagggtttagaygtttggtttttgtttatatttyggagaaagttttgagtattaggygttgggttttttggttatttttttgattttttttatyggygtygagtttgttttattttttttagttttttggtttygttagttagaggggygtttygygttygtttygttttttatttaygtttttygattygattygttttttygaattttygttttttgagatttygttttygattygttttaattggtygyggyggtagtygagtygygggagttgygygttgagttygyggtagtayggggagygttygttygtttygttttggatttaattaagygtttygyggaggggtgyggttatttgggggtaggagaaagyggagtaygttatttttttagggatttaggaagygaggygagttttaggtggaygyggtggtgtggattayggygattagggtttttttttttgttgtggagayggaggtgygaggggaygtyggyggttttttattttttggtygagtggtttttttygttttyggttggattttttyggggygttttttttagagtygagtygggttggtygggggyggttgtttggtttgagtgtygttttattaaagyggaaygtyggaggggaggttatttygagagaaggyggttttyggyggaggtggtttygtgaattttgtagttttttgttygttygttattygagaygtygygtttygtgggttttaygttggatggagggggygtygtyga

SEQ ID NO: 11399 - DNA, 2144 bp, synthetic construct
  misc_feature 1..2144: note = Description of Artificial Sequence: Synthetic polynucleotide
  source 1..2144: mol_type = other DNA
ygygtttggatgygtttttyggattyggttttatataagttttagtttttyggattttgtatttttttygyggatttttttatttttttatttttaggtttagatttttttttgtyggaatygttaygtttttttatttttttattttygttttattyggtttttttttttttggtttttattyggttaggttgtttygttttggtagttttygagggtygttygaggttttygtttattaatygttttygtttggaagaatgygttygttygagygtattttyggygggtgttaaagtttttygttttaataggtgtttttgtttggttaygtatagttttgttatttggggttyggayggagayggygataggatygttttttgtagggyggttgyggtttygtaygttttygttygggtttttagagygttaagggttttygtagtttygtygtygttttygttgtgttatattgtttttgtttttttgttygtttagatgtygygaggttgattttatgtaagggtatygttaagttygggygttgatattgtttatttattygtggtggyggattttaaggttgggagtgagagaygygtatagtgygagatttttttttaatttagagaatttyggggaagttgggtgttygygtygaagaagygggtttaagttgattyggtttagaagggggttygaagttaggygtagygtttagagagtttttttttatttaygtttttattygatgttttttgtttttagaaggttggagaggggttgygtattgttatttaygygttyggttgygagtggtttttatygttygttygtygygygttgggttyggtagtttttyggggtataygaggttttygtagtttttagattttyggtttyggtagygtagagtygggagagtygttaygtttttagtygygygygtaygtygggtttattaaatttgtagtatttttttttagtttttattttttgttatttttttttagtyggtgygttttagtttygtygttyggtagaggttgttataataaygggtaggaatgttttaatatatataaagtyggttyggygtagygggtatttagttttggtygggtttygygttttyggtygtygygtagggtttggaygygygtygyggttttttagtyggtyggtygaygttyggggygtatttataatgagygggatggtgyggttttygyggagttgtttygattttttgtttgttttttgygygtttyggtygtyggaggatgttgygtgggttyggttgttttgttataagtagtagaaagtgtttaggatttaggttayggttaggatggygatggtattggygyggattttttttatggtgggtagaygggygttttaggtgggggattgggtyggygtgttttyggggtyggggygggggygttygtagttttagttgtttgttttygttygygtttagttgtttagttttgtagagtagaaaaaggagagaggtgggggggygggggggtgatagggagagataggatygyggagygatttttayggttttaatgttttttagtttygagygygygygtttttygggygtttatttattygtgygtagggtyggtttygygttttagtygtygtyggttgatttattaggttattgygtattgggagagaagygygtygagtgggaagyggygygggtttttttttygygttygggaattyggygagatagaygttygyggyggaatggygattggttaaagttagtttyggtttttatygttaggtgatygaaygttyggtagttgttttygygyggttttggtyggttttgtygatttatatttattttyggatygagyggttttgagttatygattggagaygygygattttygatttgggttygygtygygagttgtagtttygggttgygttttggygygggatttaaggtgtgttyggygagtttttgtgtaggggyggttgggygggggagagttttgagtttgtattggaatttgtagttgagattagttagatygggttygtttagaggagggattggaagttggtgtatttgatattygaagagygygaaggggaaaygaygt

SEQ ID NO: 11400 - DNA, 379 bp, synthetic construct
  misc_feature 1..379: note = Description of Artificial Sequence: Synthetic polynucleotide
  source 1..379: mol_type = other DNA
yggtgygggttygtttttttttagtttagtttttttgatatygttttttttttggggaygttgtttgygggttygygygttttygttttygatttttttgtaggttttttygggggtyggggtaggatygtatttatygaggattygggygttggagttagtagtagyggtaygagtaggagtagtygtattttagtttgygggagaygtattgggttagagyggttyggggttttygtagttgttttgggygygggygagagtgtgtgggygygtttttttttatggtttataggtgattaggagattygtaataggatagtygggtgygtttyggtgtatygtagagaatatagygtgagggygtttygtygggygg

SEQ ID NO: 11401 - DNA, 637 bp, synthetic construct
  misc_feature 1..637: note = Description of Artificial Sequence: Synthetic polynucleotide
  source 1..637: mol_type = other DNA
ygtygttttatttttaataagtygaagtttttgaaggaggttyggtgttatttyggtgtgatygygtttyggygaygttgggtagggtgtagggagttagttyggtygyggtttagygggaggggagggggtyggtttygaattygggygttygggtygygggtgatttattgggaaygttaggttygygygtttagatyggygggygaygtttagygygttttaygtttttygttygggtygttygygtagaagtagttttygygtatttttgtttttygagayggattygtygggaaggagtttggagtygggyggtyggygggtagtaatttttttttttttagttattatggtyggtgygattttttattygygttygtagayggattttttggaaagtatygggttgggtttatttgattggygttygtaggggtygtygatttttttatagatttayggaaattgtyggtygtaagtygaggttyggtttttagtattygtyggttygttygygtyggttttttaaagagttgttagatttattygttagtagtttttttattygatygttttgtaggtgyggtgggtttttttttygttttygaygygygtgygtattttygtgtygygg

SEQ ID NO: 11402 - DNA, 959 bp, synthetic construct
  misc_feature 1..959: note = Description of Artificial Sequence: Synthetic polynucleotide
  source 1..959: mol_type = other DNA
ygggagtggggygggtaggaaygagggtttgagtttaggatygtaattttygtgaggggttygaggattttagtttaaygtttygtygggtttygtttttatttttttttttatggygagttygtygaggtttygtygtttygttattygtttttagygtygygygggttttgttatygygtttaygttyggttaggyggygatttttygygttttgtttygtyggttgtygggggtttaagaaatttygggggggyggggtygggggyggggtgaggttttygggggtyggggyggggtyggggagggggyggtggggtygggggttyggtttagggygggaaatgggtggggaggggyggggtttgggttggagattggayggaggagtygggyggagatgtaattggaggaagagggygggayggggyggagaaggtttttygtatyggyggagggagagggattaggagggggttgyggygggggaggagagggggttttyggtttagagattgaggygagggtggygggagyggygygtaggtagggttggggtggggygtatatagtgagygttgggggygttggyggtggagtttttgaggtttttygaattagtgggttggggttgygagatygagtygagttgttttgggyggttagagatgtgggtatatagaggttttttttttttttttttygaygtygggtagtgggyggtggtttggttttttttttggaatttttgggyggggtygggtttggagtttgggtttttgttyggagggtggtgttataggaagagttggagttgagagtygggatttyggggtttttttagggggyggttygtttttggtttttaggggtttttaagygtagtgtttttttgttttttttgggtatygtttaatttttttygtatttgagggtygattattttttygatttygygg

SEQ ID NO: 11403 - DNA, 826 bp, synthetic construct
  misc_feature 1..826: note = Description of Artificial Sequence: Synthetic polynucleotide
  source 1..826: mol_type = other DNA
ygtttatttttgyggygtygtgaaagaaggygtaggaggagggagttttgatattttttttygggttggggttttatagyggygaaaagayggagggagtgatygggggtygyggggattttttygggaygggttttygtyggaggagtttyggaaagtygttttttattttygaggtttygtttgygygggygttttattagyggtyggggtggtggyggyggyggyggyggyggyggyggygyggggyggggygtygygatttttgttttttttttgggtygagyggtaggygygttygtatygttttygttttttygtygtagtygttgtygatyggttggttgggttttgyggygtgaggatttyggyggygtygtagtttygygagttatggtttagttyggyggggaggttyggttygggtttaagayggyggtgtagattygygtygttatttaggaggtygaggaygtggaygagttggaggaygaggaggagggggyggagattyggggygtyggggattyggttyggtattttagtttyggttggggtagygygagygaggaggagtygagtygygggtataggtaggygyggyggttggttygggaggtgggtttygagggggygtygggtygygygygagttyggggygttgattgygygygataatttttygggtagagggggttgagttagtttygtygtyggggaagtagtttygggtygagtttttgagttagaatyggttygtggaggtagtyggtgttttagttygtagtttygtygtttaatygaggtttttagggttggyggtygg

SEQ ID NO: 11404 - DNA, 2156 bp, synthetic construct
  misc_feature 1..2156: note = Description of Artificial Sequence: Synthetic polynucleotide
  source 1..2156: mol_type = other DNA
ygttygaggaatyggtttaatygtttttygttgtagtyggtttgtttttttttyggaattatygagggagaggygygtgyggaggtyggygttyggatttygtattygttattgttgtyggygtattttttygaagttttatttygaagggttgggttttattygygygttttgtgygtgtttttttgtttttttaygttttttttgtttggttgttgygaggttttgtaggggaaagattggygyggggttygtattttgtttatgttataggaaaatygtgggagttttttygaygyggygtattttyggaagttttttttttaggagggttgygggaaggtygggattttgtatttagaygaattyggtygttttttaagaggaaagtyggagatttagttgaggggtaaaaatgttagggaaaggygagtttagagtttggtgatggagaaattgggaagttattttttattttttaattttaggatggggaattygtaattgaagtyggagttttagatttggggygtatttttagtttagtttaggaaagagatttaagggygtagtagtgtggatattttttatttyggtttygaaggtttagygagggtttaatttgggttttttgttaggttygtttttygtttttttttagttttyggttygtgygtygttgtttttttaagaagtttaggtaggtaggttyggttgttggagtygtttttatggtaattygygagttgyggyggttttatgaatatttyggggygygggagttygagygttgtyggagggygtttygggggaggyggtygttgatgtaagttyggygggtygttgggtttygttyggttgyggygggagtttygggaygggtyggaygggtyggggtagaggaggygaggygagttygygggtggttagttataaagttygggyggygagatagayggatagttagttttttygygggaygtaygttygggattygygygggtygtgygttttgtatttyggagyggttttttgagygtygyggtygtagagttttttyggtyggygtttattgtttttygygggggyggggygtttggagtygggyggygygtygygtttttgaaygttagagggagggagggaggtaagaagggagygyggggttttygygtttagtygggttygggaggaggtgtagygyggygagttyggggattyggagygggattaggatttttttygyggygygtagtttgtttaagtatgggygtttgaggttgtttttaygtyggyggtaaaggaygygtttttaygggyggattgatyggygggyggatttggagttygttygyggygtygygtttttgttttyggttyggttygatttyggtttttggygttatggataagttgtygtygtttatgygtaagyggttttatagtttttygtagtaggtgggggttaaggygtggattatggaygaggaagaggaygtygaggaggagggggtygggggtygttaagattttagtygtaggagtattyggttgyggttattgttttygttttttttttyggyggtygygggtggtayggagtttyggagttyggttttyggggtagyggatagygaagggtyggttygyggygygggtaagtttagtaygaayggygattgtaggygttttygygggagtttggtttygttgggtagtyggggyggyggtagyggyggtayggggagyggtagtagttayggatatttgtatgatttygyggaggagyggyggtttatygtygagggygaygygtttttyggygaggataggaygtttttaggtttggyggtygagttygagygtttyggygtttyggygtagttygtagtttygtygtygtygttttagtagttatygtagtyggttttygttttttgygagtagttttyggtggatatygttattaaagtggagggaggygyggttgtyggygattagattttttyggaggtygaggtgygtttgggttaggtyggttttatgtagygttagttyggggttatgttttaattyggggttaataaattttttttaaggatgttyggtagttagaaagtygtggagygygaataggagagggttaagtyggtygg

SEQ ID NO: 11405 - DNA, 1441 bp, synthetic construct
  misc_feature 1..1441: note = Description of Artificial Sequence: Synthetic polynucleotide
  source 1..1441: mol_type = other DNA
ygtaaggaggaaaaygtggaatygaatatagtagttgygggatygtattaygtgatttttttttygyggtygttttatagaatttgtgggaaggggggggagggggagtgtygtygtaatttygaggataggttagtagttygygggttygattttagtyggygttttyggggttattatattttttygtyggyggggaaattatattttttataygttygaagtygtygttttttygatayggttygttyggtygtaygtataygttaygggtyggygtttttyggtataygygygaaggtygggtttygtttygttttttatygatttygyggagyggygattatyggttttaattagtttyggatttygggygygttygggtyggtttttttttyggtttagttttygttaatygggggatttatttygttgaattygtttattygggagggygygttttygttttattgttttatattygagggtaatagyggtygtatygtttatttgggtyggggggtttttttttygttttyggtygattgagtygggttggggttttygaggaagygygggtygtygggyggttggaagtgggggaaggagaggagggggagggggtygggatatygggagtygttttttttttttttygtygattgyggttttygtaggttggtygggygttttygtatattygtttagttttttatagtttygygtttygttagttttttttttattttatttttatatatttttatttttatatatttatattyggtygtttttygtttttttattygtttgtygygygygygygygatttygtttatatatagygygygygaygtyggyggagatygtttygtttttttagatygaaygtygttygttygtttgttgaggagyggygygygtttyggtttygtttttttggygtygyggygyggygggyggggggyggyggtyggaggagttgggggtygggttagygygtygagtattgtygagyggatttgatatttgygtygagagtygtttttttagtttttygttygtattygagttatygttggtttygggggaagagaggygatggatygygygyggggagygaaaagggagygygagggygtttygaggaygygtttttttattygtttttaaatygtttttattgagaaagggaaayggatggggggggtggggggygaggtttgtttttaattygaaatygygagattagtttttttygttgtaygtttttttygtttttatattttttgtttaggttttattaatttgygtttggaatttygataygagttttttattttttygggygtagggttttgtyggtatttygaygtttttygtttagttttttygtyggtygtygttyggagttttygtttayggtggttttttttttygg

SEQ ID NO: 11406 - DNA, 734 bp, synthetic construct
  misc_feature 1..734: note = Description of Artificial Sequence: Synthetic polynucleotide
  source 1..734: mol_type = other DNA
ygggtttygttygttttgtttgygggtygatttygygaygtygatyggttygygttttygttttygagygtttyggygggyggagttgygggtgaggggggggttggtttggggggygggggtttygatgayggtatyggagygygtygtattggggatggaaatttgattgtttggttygggayggygtttgtagttaggtaggtgagtgtgggtyggagagygggttaggggygaggatygggtgggtggagggaggygygygtttttttttygygtaggtttgggtttagtggttttgggagtyggtatttttgggagatttgattyggtatgaggagttyggtatttttgttttttagttttttggaagtttttttttggattggtyggygtygttttttygatatttgggggttgaggtyggtatttygggtttgygtggaggggygagygttaaggttgygagagtygggtttygatttgtaattattttttttaatttttatggagtttygtttygygttygtygtttttagttttagttgttttgtttyggtttygaatagygtttgyggggttgttagagtattttyggagygggagygttgtgyggagagtaggggygygyggaagtygggattgtatygggttyggaaygtttaygyggaggggtgygygaaggtttatayggtattgygaggtagagtttatygttgtgtgtttagggtygg

SEQ ID NO: 11407 - DNA, 935 bp, synthetic construct
  misc_feature 1..935: note = Description of Artificial Sequence: Synthetic polynucleotide
  source 1..935: mol_type = other DNA
yggyggtgtttagggggagagggttttagygtygtygttttttaagtygattygttygtatttggttttttttttatagggttggagtttggatgaagttttttatttttgttagattttagtyggggggtyggygtygygaggtttttatgygygtttttaaagttgtygygggggaggggttatttttygttyggggttgagattagtygagtttttygtttttgttyggttygtttatttygggygtatagygttagtyggagtagttttagtagttgygtttttagttygtaygygtttaggtttagtatggyggygygyggttygggygtygyggagtygtygaggagtygtygttygtttygtygtygtttygttyggygtttagtttyggygygattgyggtgagtttatttyggtygggagygtttttygygtttagtygygttyggtagagagtttttagtygtttyggatttygygtagtttygtagagaygygygtgtygttygtaygggtyggtattygggtygttttygtyggygtgttaggatttygtatagaagygttyggaygyggaygtaygtagtygyggttaygattttygtygttygttyggttygtgttyggttttggttagtagggttgttttatttttayggygyggygggagttygagggggttttttgggaaattttttgyggggygtygtggygtaggtgygtttttatttttagggttttattattygyggttatatttggggtyggatygygygttttttttttttttttygtttttgagggagtttttgtttgggtygagggggatttygggggtttgtttagttttggggtgaggggttggtttaatattttataggtttayggttattagtagggygggattatagtgggygygggtygtaygt

SEQ ID NO: 11408 - DNA, 1054 bp, synthetic construct
  misc_feature 1..1054: note = Description of Artificial Sequence: Synthetic polynucleotide
  source 1..1054: mol_type = other DNA
yggggtgggggatattygggttgagttagttaagtygggagtgtgaggagtagygggggtyggtaggaaygtggaygygagattggggagtagtggggttgtttgtgyggggatgtagtttttattaagtataygggtygagggttgattataggtagagtagygttttttggtagygttgygggtgtggatgagggaagttaggtttyggatttatatttagayggtygttttttagtttgtttttttttttttgtgggtttttaaagtgyggtttggtttttttatttygattttgaggtttggaggtggggaygggattgtgggygtyggtaaaygtgagttttygagyggggygggaaaggagtttygygaatgttttttttagtttyggygttttaygtgtaggtttatgattgggagygtttttaatttaaatyggtattgygtygggattattttttttttggygtygttttygtygtttttttyggatttttttyggttttttttttatttttygttttyggggtttttttttgttgagygggggttgtygggatttgggattgyggggttgtttygatttygtagtygttygyggtggaagttagttygggtttggttttgagygygyggttggggyggtygttgtttatggtgttggygygggtggygygtyggtyggyggggtttgyggaggtttaggygtttttggyggggaaggyggygttttygggtttggggagygagggttttygttttaggggtayggaggatatttagattggggygttygtgggtttggtgttgtygtttygggygtyggtattttgygatatttttttttttyggttttgggagggaatygaggtagtttygygttaggttttttyggatatttggggtaaattygttttttagagtttygtgttttttttttaaatttgaggtagygatttttttatttttaagggyggtygtgaggtygaattatgtgtygattttagtyggtttttgtaaaygttgtgatgtyggttttyggaggtygygt

SEQ ID NO: 11409 - DNA, 1474 bp, synthetic construct
  misc_feature 1..1474: note = Description of Artificial Sequence: Synthetic polynucleotide
  source 1..1474: mol_type = other DNA
ygttagygtygatgttgttgttttttygttttttttatttttatatatttttattygggttttygygggtttttygaattaagtttttagtttagtttttttaaatagtttatatagygataygggtattgggtaattgtaattagttttaatyggaagtatttgtttgtgggtgagatttatttgattttyggggtyggtygttataagggygagggttgaggatttttygtgggggatatgggttttttattagtyggaaagttttagygatyggttgggygtttttgggtyggattygygtygtygttygygtattggggttttygaggtgtgatgttatttgttygtagaatyggtttttttygygtygtttttttygygtttttattttagtttttttttygtygttttyggggttaatatggtagyggygtygtygttttattttygtaatygtaygattyggttggtagggtygtyggttyggattttygagatttatatttyggttaggttygtaygttttgygtttyggattttyggyggtttttygtagttttyggggygtygattttygttygttgttataygaggttygggygttttygatagttygggattaygttagagtgaygttatatatyggatttyggygagttgygggtatgagtaaygygygygttttygttttygagtttttttygtygtygygtttatygttgaagattatggyggtygaggygtttatgayggygaaaaaygaagtatattyggggtygtttttggattyggatatgtttgygggtggggagggggtaagttttgtgggtygaggyggtggyggaggygggggygaggaygggtygggtaygaaggtttgygggygggyggyggygaaggygattyggttygttagtygttgygttttaaatattagtatygtagaataaaatggyggtygyggtygygttatatgatttgggtttygtttttgygagtygtattatttygtatygtgggggagaygygttttygggaygttyggtyggttygttgatttttttygggttgtgtygttygtttagygattyggtttyggygttyggtttygttttgtttyggttttygygggtgttttygggygtygtyggtttttggattttygtagygttggatyggtttygygtyggggyggggyggtgtggtgtgtgttttattagtatayggggyggggtttyggaygtttygttttttttgyggttgygygtygtttgtaggtgttgggttttyggygaygtttttttttgtatttttggygtgaagttgtaggtygtggtttygyggttttgtttttaagayggggttttattttttygggygttggttttttaggatttttttattaattttgggygagttaagggttttagtagatgtgyggygygygggttttttttgttatagygttygg

SEQ ID NO: 11410 - DNA, 357 bp, synthetic construct
  misc_feature 1..357: note = Description of Artificial Sequence: Synthetic polynucleotide
  source 1..357: mol_type = other DNA
ygggagatttygagattttyggtyggtgatagtaggygattttttgtttttgttaatttgtgggtttttayggaygtggggaagggaggagggaggttttagttttttgygggggaggggygtgaagaygygygggggtggggggagatgagtyggygtygttatgataaygaggtyggtggttyggttttggggattygggagggagggaggygtygtggtygygygygygggygggggyggggggttaggttttttaggagtagttggggaatattyggygattttggyggttgttttttggtggygtagggagttygygtgtttgygagtgygtgtgtgtgygaagtttttygg

SEQ ID NO: 11411 - DNA, 814 bp, synthetic construct
  misc_feature 1..814: note = Description of Artificial Sequence: Synthetic polynucleotide
  source 1..814: mol_type = other DNA
ygtygtttaagagtttggggtygtggggggyggggttgtttgttatyggtttygtttygtygataggattygtttttttttttaggttyggyggggtygatttygtttttygtttttagtttgtygtaygatagyggyggygyggygggyggagtygggaggyggggaagtagtggtygtgtgagygtgaggagttgtygttatygtttgtttttygtttttttygtttttyggggttttagygtygtgggtygygtayggttttggaagagaygtygtttygtttttattygttttttttatygygtygttttttygttttgttttgygggtttaggyggaattyggaayggtygtttttttttttygtttttygtygtygttttttttttttttttttyggttttttttttagtttygggtyggagyggggtgtyggyggyggtyggttygggyggyggygtttggttatgtygtgtyggggaaggtaatgagtygtagagtttyggggtttyggttgagtagyggyggtattaattattygyggagttggaatgattggtaatttaggtgggtgatyggttygggatttygtttygatttttygggtttygtttygggygggtygaggtttagggtygyggggttgggaggygyggtttaggttttttatttatyggagtygggygyggttttttgggttttttttttttyggttaggggaggaaggtygyggggaggygaggtttaagtgttttttttttttttgtttgtttagttyggggttgaagtygagtttyggggttttyggygg

SEQ ID NO: 11412 - DNA, 847 bp, synthetic construct
  misc_feature 1..847: note = Description of Artificial Sequence: Synthetic polynucleotide
  source 1..847: mol_type = other DNA
ygtggtgagatatygatttygtagagtagagggggyggyggtagaggggaagggttttygtatttattttttttgtaggaggtgtatttgtatttttygtatttgtaggagttygygtaggtgtaggagttatttagagagggygaygttataggaagggttaatgtggaygaattygggtttttaygtttgttaygaggagatggggtgttaagtttttttgtttttygygatataggtatgttygttttttaygaggtgaagaatagggaattaggggttttttttttaagtgtttttgagygaaggygtagggygtgggtttttttgtaggtataagggygygtagtgygtaggatgygagygggggygggggtttattagaagggtaggggtaggttttagggtttatgtygaggagagtagtagttggaggyggtgaaygggtttttttaagtaattggaygygyggtttggttagtggtagtaggtggygatgtttttatagtttygggygggggygygtatgttaagttygttgggygttygtttttgygtatygygttygtttttttygtttgtgygtttgggtttyggygtaygtattgtatttgtygttygtttttgtygtgtgtgtgtattgtyggggttygttygtttaygttygygygtgygtttttatttttatttygtattygygtgtaygatttattygtygtygttgtgygygtattgttagtttatttttygygtgggtttygtaggggaygtgttygtygtagtagtygttattgygtggaagygygtaygtattattttygaaagtggagaaaaaggygttttgygt

SEQ ID NO: 11413 - DNA, 589 bp, synthetic construct
  misc_feature 1..589: note = Description of Artificial Sequence: Synthetic polynucleotide
  source 1..589: mol_type = other DNA
ygtgggtgtttyggaggaaayggtygtagttttaaattttttagtttttttagtagggagttttttygyggagtttygtttggyggtyggaagttattttaagtygtttattyggaagtygtygttttggtaattgggtatygttttattttttttttttagtaaygtttatygttttagaygtttgaggttagtygagtttygattggtttttttgttttttattttgggagaygtttgagatttagygtttttagatttygtatttgaatttgtggygtttggtgttygygagttgtygaatgaagttgagygttttagtggaattagggattttaggggtgagygatygygaggggagagygaygaaaagggyggtyggagttggaggggygyggagttaaataaaaaagggyggtyggagttgtaggggygtygagttaaataygttatttttagatggggggttttaggygagttgtttagtttttttgaggtaggtttttygtttgttygttttttygtagtttttgagttttttttttaygtygtttttyggtagttttagagaygttaygtttgttttygt

SEQ ID NO: 11414 - DNA, 848 bp, synthetic construct
  misc_feature 1..848: note = Description of Artificial Sequence: Synthetic polynucleotide
  source 1..848: mol_type = other DNA
cgcggcgtattttttttttcgtattatatatatatatatatacgatgatatatatttttgtgtttttttcgatgtaagtggtttcgtttttcgttgggttttaggtgtttttgtaggaaatgcggaggcgcggggagtttagggaacgggtttggggttttaagttcgtgatttttatttttatttcgggttttagttttgcggcgtcggttcgtagcggatttatcggacgatgtcgaatatgataagtacgttgtttagtagttttacggcgtatacggtcgagtagagcgcggtgatggcgattgttagggcgagggacgaggcgtttcgcgcgtttggcggtttcgacgtattggcgttagcgttggggtaggcgttagggtaggcgttcgaggcgttggcgaagagcgggggttgtagttcggcgtcggcggagggggtcggttttatggttgtcggtcggtttcgtcgcgtttttttttatcgtgcgttttgggcgcggggattcgacgcgaggggagcggtaaggtagaggtcgcggtttcgacgtcgtcggttgtcgcgtttcggtcgtttcgttgtttttgcgtttcgttcgtttgtttcgtcgttcgtatcggtttagttttcggcgttcgttcgtttttttcgttcggagcgttgtgagttaggagtagtcgtaggtttttcggacgcgttcgtcgcgcgtattacgtggttcggaggcggtcgttagtttgcgttcgcgatcgggggcggacgttgtattatcggttcggagttgggtaggggaggtttttcgttttttttttagggatgtttcgtcggttcgagtgcgatttcgt

SEQ ID NO: 11415 - DNA, 1230 bp, synthetic construct
  misc_feature 1..1230: note = Description of Artificial Sequence: Synthetic polynucleotide
  source 1..1230: mol_type = other DNA
cgcggttcgtattttttttgtttcgcgggcgttttgcgattttttttattgcgttcggtttcgatagaagtttagggagtagtggttttcgcgtttcgtacgttagacgtggggttaggcggtaggtttttagtttaggaatcggggagttttttcggaagggtgtgttattcggagttagcggttttttacgtatttttttagagtgagaacgtacgcggcgtagttatcggttcgttttttttatcgggggttttcggatttttaatttgtttggggttgtttttgtttttcgggcgaggggtttttggggatttaggatatttggttacggggaggcggggtatggggggtagaaagttagatggagcgggtaggagaaggggggtgttgggaggagttaaggagggagagagggggcgtgtatggggcgcggagttaagagttatcgagtttgggcgcggtgtgtaggcgagggttacggttttcgtagtagcggggaacgcggggagtcgaggtatttagcgggtcggggaagaaggtgggggatttcgcggacgtcgaggagagggtattgcggagttagtaggttttgtagggagtcggagaggggttgagtagattttgaaggcgggcgggggacgtatttttcggcggggtagggtgttttcggatacggcgagcgcgcggtatagttcggtagggtgatagttttttagcgtcgcgtatagttcgttcgttgggggtttaggggtggcggttgcggtagggggtttcggggtcgggatcggagcggcgggcgcgattttcgagtcgggagttcgggcggcggggttcggggtggtcgtcgttttttttttttgttgtagttttttgagtcggcggagggttatggtttcggcgtcggacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgt

SEQ ID NO: 11416 - DNA, 1094 bp, synthetic construct
  misc_feature 1..1094: note = Description of Artificial Sequence: Synthetic polynucleotide
  source 1..1094: mol_type = other DNA
cgcgggagtttttcgagttttattggttttttttttcggtcgtcgttacgcggggcgtcgcgtttttacgggtttagacgtttagttaatttttcggttttgtaaaagtttttgggggtgcgcggggttgggcgggggtgcggcgtggttttttttagggtgggttttaaagtttttattttcgttcggggcgttgatatcgtcgattcgtaagtttatgtcgcgttcggagcgtcgcggggttagtacgttcgggcgggcggttcggaggaggcggcggtacggttggggtattttcggtttcgattcgcgatgaatggggcggttcgggtttcgtttttcgtagtttcgttcggaggtttcgtttttcgagtttttcgtttcgcggttttcgttagtacgttgttcgggcgttttttaaattgtttacggagtcggatttcgcgttgttaacgtttcgtttcgggtaaggttgcggttttcgtcgggtttcggcgttcgttgtttcgtacgttcgggttcgggaggaggaggtcgggggagtcgggtcgggcgtcgcgagcgttgggagggttcggtttcgtcggggagcggttttcgagggcgtaggagcgggagtcgggtcggagattttcgcgtagttcggtgatattttcgtttcgcgttttagttcggggtttttaggtatcgcgcgcgtttaggcggcgtattcgtatttattttcgtttcgaggttcgtttcgttcgttacgtcggtcgtcgttaacgagttttcggttcgcgtcgttttagcgttttgtagcggaggcgtcgtttttatttcgatcgtaggttcgttcgggtcgttcgttcgtcgggtatcgagtcgttttgtcgcgcgttgcgtttcggggcggggtgggaggagagggagtagtcgttattttgtttaggtcgtcgcgggttagttttgtagttagttttagttttgggtcgggtgttgggaaggtcggacgtcggtcggcggtcgcggggtttgtttttcggaggttggggcggtttaggttatagatttcgtcgttttcgtattttttttttagttatttttagcgtcgt

SEQ ID NO: 11417 - DNA, 1979 bp, synthetic construct
  misc_feature 1..1979: note = Description of Artificial Sequence: Synthetic polynucleotide
  source 1..1979: mol_type = other DNA
cgtttatttttttcgcgtgttggagaattaattagtaaggtagggaatgcggttcgtgggcgtttggtttttttaagcggtttaggtttttagagcgcgaggtttaggggttttggagtcgcggtcgcgacgcgttcgagggtcgtttttttcgacggtagagtaagagttatcgcgcgggagtttcgagcgatcgtttcgttgtttcggtatttttttttcgtagtcgtttagagttttttatgtttcgtgacgttcgttagggtagcgcggtcggaggtcgggtcggacgtggttcgagatgttcgggggtaggtagaagattacgggtacgcgataggtaatcgtcgtttcggttttagaggtggacgttttgtttttttgcgttttaatattagattttgtttttagacgatatttttgttgttttcggtatttggaaagattaatcgttaggttcgagaatgtaagatttatttttttttgcgacggaggtagttaatttagttgttcgttatttttagtgtcgtatgcgtttttacgtaggattttgtttaatcgttatcgggacgtttttttagtttcgttttcggatcgttagagaggttgttaatttcgttttttttttttattttattagcgtattaatttacggcgttgtgacgtgtatagtttttgcggtcggtcggggcgggttaatggcggtggcggatacggcgggttaatgggcgggagcgttttatgcggtcggttttcgtcgtagtcgtcgttgggttttggagttagaggtcgttttgagacggtgcgcgatggatcgagggttttagtcggggaggcgtcgtcgtcgagttcgcggttagacgttttattagtagcgttcgtatcgggagtcgcggttttcgttcgagtcgtgggcgcgttcgaggggcgggttcgtttttcgtcgtttttcgtagttttgtcgggttcgagttcgcgtcgtcgtcgtcgtcgttttgtcgttcgggtcgcgcggttcgggaaacgcggtcgcgggttgtatgggtagcgttcgcgtttcgtcgttgagtcgtcgcggagtcgcgtagttttcggagtacggtgagaggcgtcgttggtttgggggcggtggtcggggcgggtacggggtattcgcgcggttttgcggtttgtaggtttttttcggcgacggagttgcgtcgcgggttttcgggcgggtttggggggtcggggtcgggtgggcgggggtttttgggggttcggggcgatcgtgagggattaataatgggtttcggagcgggtttacgggttcgggttcggggtagtcgggggtttttgggggttcggggtggtcgtgaggggtttatagggggtttcggggggggtttgggaggtcggcggagtttgggtcggtcgtaaggggcggacgggggtttcgggcgggtttgggtggtcgggggttcgcggcggttttgaggggtcgattgggggtttcggggcgggtttgggggtcgtgggggttcggggcggtcgtgagaggcggatagggggtttcggggcgggtttcgggggttcggagcggtcgtgaggggcggacggggggtttcggggcgggtttgtaggttttggggatttgaggttgtcgggaggggttgttagggggcgttggtcgggcgtcgggttttgcggagttggggcgtcgatttttgattcgcgagaggggcgttttcgtcgtgttggtcgtagttgttatttttagcgtttttattattatcgttgttttgaaatgagagtaggcggttttcgggtttcgagtcggagggggagggcgaattggggatttgggggcgtcggggttgtaggaggcgcgcgtaggtcgaggaggggtaggaatgcgggtagtcgtgtggggggtgttagggggagggtaggcgggcgggtgtggggggtggttgggaggaaagcggtggcggtggcgg

SEQ ID NO: 11418 - DNA, 1930 bp, synthetic construct
  misc_feature 1..1930: note = Description of Artificial Sequence: Synthetic polynucleotide
  source 1..1930: mol_type = other DNA
cgcggggagatcggggcgcgcggtacgcggcgtttttatttgtggatgtttatttttcgtggagggcggtgggttttgtcgtaggagattttggcgaagacgtcggttacgatgacgaaggcgattatttcgtaggtgatgtagacggtgaagttggttttgttttttttcgggtcgtatttgttttcgggtttcggcgatattattttggtgttgggcgtttgtatttatatcgggttttggtagttggtgtattggcgttggtttagtttttcgtggcgttttttgtagtagaagcggtagtagtaggtatcgtagtagtataggtagtcgttttcgttgttgttatattcgaattttttgtcgtattggtcgtttacgtcgtagtagttttagtacgtttcgtaggtgacggtcgcgttggtcgtcgtcgttatagtcgtcgcgggttgttttcgtcggtttttcgttttcgggatttcgggcgttcgggcggtgtcgtttagttcgcggtcgtttcgtgttagggcgttttcggtttttcggttttcgacggtagcgtcgtttgtatttagggttcggttggcggcgcggtcgcgggtttcgtggacgttgggtagtaggtttagggattttagcgagagtagtagtagtagtaggaggcgtcgtagcgttatggcggggtcgggcgggagggcgcggggaggttttcgcggtaggtcgttttttcggcgggtcgggttcggaggattcgtcgcgcgggtcgggttggaggcgttgagcggttagcggtttcggggcgatggcgttatcgaggcgcgggcggtagtggcggcggcggcgcgcggtgcgtacggatcggttcggcgcgggttgttcgggtttttaggttgcgcgtcggtttcgcgttttttttgcgggttcggcgcgttttttgggtagttttatttttcgtcggcggtgattgcggtttcgcgcgcggttcggtttaggtaggattcgaagcgcggtttcgggcggcggcggcggcggcggcggcgtggtttcgttcgggcgggttttgcgggataagacggggagtcggttacggggtggggcgattggcgtttcgggagtaggaggagaatcgcgggtaggcgggcggggagggtgcgcgtagttttcgaggagagagattcggagtcgggaggggcgtagagttcgtttttaagacggggtttcgcggttttgcgcgtttggaatcgagagcgtacgggtcgtttttttaggcgtagttcggtcgttcgggttttttagtcgttcggtttcgtagcgcgttttcgtcgtaggttggttttttgggacggagtcggttgaggttggggttcggcggcgagtcgggagagcgcgcggcggttggattttatttatttattatgttcggttgcgattgtagaggcggcggcggcggcggcggcggcggcggcggggcgaggcgggaacgtagttgtcggagcgagcgagcggagagtcgtcggttcgtcgtttgtattagtgtcggaacgtgtgcgagagtgagcgagggagatatacgtatttatatattcgtatatacgggagcgtcgcgaggggaggggggataggggaggggagggtagtcgtttttcgttatttacgtttgtacgttcgggcgtttagggtgcggggcgggggggattttttttcgtttttttcggatcgtagtagttgaagtttcgcgttacgaaagtttcggatagtagttattcgatacggcgaattcggcgggcgaagagggggtcgggagtagggcggaacgttcgttttgtagtcggttcgcggtagggattgattttttttgttattgttttttttagttttcgcgattagtttttattttatcggagttcggggtagcgcgttgtttgagcgg

SEQ ID NO: 11419 - DNA, 3177 bp, synthetic construct
  misc_feature 1..3177: note = Description of Artificial Sequence: Synthetic polynucleotide
  source 1..3177: mol_type = other DNA
cgtaggtggggtaagttcgggttatcgacgagatttgttcgcgttttcgtttttattttggtgtttttttttttttttggtagttttttttttattcgtttatttttcgggtttatttcgatttatttggcggtgggtttttttttttttcgattttcggcggtgcggttcgttttttttttgatttcgcgtttggtcgtcgtgtttcgaaggatatgggttatagatcgtgcggagatattagtttcgcgggcggttgttttggtttaagtagaagaaaattatcggggttagcgtcgggtacggtagttttttcgtttcggagttcgcgttgttcgggtttttttttgttgatttcggtttcggtcggttttcggttttcgataggtcgttgagtcgtatgaagtttcggggttgtttcgatttttcggcgttcgttttattttttttttcgtttattttttggttagtcggggtttcgggcgattcggagaggggtaagcggcgttttttagaggaggtgtttttacgtaattcgggggtttcggcgggggtatatttggtgggttttagggcgtaagttgagttttcgggagggttagtttagtttagttttttttgttcgtaggggtatgttgttcgcggggcgtcggggcgtagggaaatttcgttcggcgcgagtttcgttttttttgcgtttttggggtttttcgggttagtcggtcggtttttttttattttgtttcggttttttcgtttcgcgtttaggtttcggttgtcggattcggcgttattttcggcgaagtcgtttcgagagggcgaacgaaaaggggggtagcggcggagggcgggggttcggggaggggcgtttttttttttcgcggcgtagttggagtcggatttaaggggttagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttgtcgttgtcgtagttgtcgtcggcgttatagttttttttttcggtcgagacgcggagcgagcgagcgaaagcggcggcgaggagtttcgcgtatattatagttggattttttattttaattttaagtttcggtttcgtttttagatagtttcgtagttaatcgtcggacgtcgtcggtttcgagtcgcgcgtttattggtcgttcgtcgtggtagtgcgggcgggagcgtagggagagaattatagttggaattcgatttttattttaaaatttaggatcgttttttttttttttttttgtttttgggttcgttttcgaaggttggagttaattagattgttgtttagatcgaatttatttttttattggttattggggtttttgggatttttttggagggagttcgaagaattagagtattcggcgcggggttttggcgtagggtcgtaggttttaggtattttttgtttacgatttttgatttgggtagtagtcggaggacggagtttagttttgggcgggtttggggaagaaaggagataggcggtacgggggtgagggttgttattagggggttttagagcgaaattttaggtttttatttggttaattttttattttggagttgagtttggttgcgggattgggggagggaaggagcggagttggatgttttgggggtggggttttaggttggaggggtttagttttggagaaacgggcggagttcgagaaaggttagggtaggtatggtttgggcgtggtttttataaattttttgggtttattggttatattttcgagttaattttgagatttcgattttgatttcgtaattttaattcgttggatttgattttatattgacgtttttgggttttatttttttgtttttagggattttttgaagggcgtggattttacgtaggggtttcgtgtttgaatacgtggttttaggtaggtcgcgttggatcgtagagttcggatttttaggaggggttgcggagtagagcgaggatttttaagaaggaatttgtgggggtttcgagtgtgtgggagggggcggaagtatagagttgggttttatcgattcgatttttaaagtttttattatcgttattttttaatttcgtgttttagttttttttaagtttttatgtggtttagggaaagagtgttcgcggaattggaatttcgcgggtttgtcgtttttatttatttattttaattttatcggtagcgggttttcgtgggtttgtgttttttacgcgtgtatacgtacgcgtagatttcggtttttgtttcgtttattttttcgagttttggggtttagtcggttttagtttttttttgtcgtcggcgttattttagaaagttgtgggtattcgggagcggagcgtcgcgggtgtgttgggcgtcggtggaggggggaatagcgaggattagacgtcgggaagtatttttttaatatttgcgagaggtagatacggcggaatttagtgggttagttagtttttttttcggagattttggggcgtttgcgttattgcggagaggcggcgggatgggtcggatgatttttattattattttttattttgttgaggttattatttttgggcgttgtttatttttttaaggttgtattatttacgtagttttcgcgtatttttcgttatcgtagagggttggggtcgttttagttttcgtttcggtcgatggggggaggggatgggggaagtggtagagtggttgttgcgtcgtcgtttttttggttgttttttcgtcgaatttatgtatagagttgtgtaaatgaggtcgggcgggtttatttgtattttatgttaatgagtagattttttaagtgttttttttttttggcgggagtttttgtttttattttgagtatgcggcgtttgagttttgaatttcgtgtcgttttttgggaaaggggggttatttatggttgtttcgcgcgtttgatatttttttttttttcgagaggtcgtagtttgtcgggtcggtttgtttttttcgttaggatagaggtttcggggttggcgcga

SEQ ID NO: 11420 - DNA, 2195 bp, synthetic construct
  misc_feature 1..2195: note = Description of Artificial Sequence: Synthetic polynucleotide
  source 1..2195: mol_type = other DNA
cggtagagaggacgttatttacgagagagagtgatcgcggatttttatcgagaggtaggcggtggaggggttttttttggagatttcgattatggagtggttttttttttttttagttcgagtcgtagcgtcgggtttttttatttttttagtttttagtcggttcgggtttgaaaatttttagcgatcgagcggagttggcgcggcgtttttagttcgtaggatgtttagttttttcgtttttgttttcgtttatttttcgtcgtttcgattcgattttttcgggcggcggagcgggaaggtagtagtttttatttgggattcgtcgtcggtttcgttttagcgtagcgtttggggttaattttagttttaggcggggggcgggcgggggtgggagggacgcggcgcggggcgttgggttaggttcggttttggttgggatggcggggttcgggtcgggacgtagggtttgtttttttttgggatcgaggttgagttaggcgcgttgggttgttcgttttcgcgcgggtttgtttttaggtagggttttttgttttcggcgagggtgggttggagtttgtattatcgttatattatttttatttagggcgttaatcgggcgttcgtcgcgttttaggtacgtgcgtttcgtttatataggaataaagtttgttcggtttttttcgtttcgatttatttttaggttgagtcgattcgtatttttcggttggtgagggagatgggagtttttggttttgtcggcgtgtgggttgttgttgttgattgttacgttttcgtatgcgggcgcgcgtatatttacgcgtatttattttttgggttcggttttcgtcggggtaattggtgtgagggtgtagttttgcgtattttttatcgcgttttttagagagcgcgtttacggatacgcgcggggttattttggcgcgttttcgtgggggatatttagtttttgttattttcgttttggttttttcgtgagatatattttaggtatagttcgttgggagcgggtcggagcgaggcgtatatttaagatagagttcgtttttgttacgttttttgcgtttttttttttttttagtttgtatacgtggatatatcgtatatcgaggttcgttttttgtacgtacggtttttttttgggatttttattagttattaagcgtacgtgggatcgttattaagcgttttttttacgcgtgggtcgagtttagattattttggatcgtgggtaaaggtttttttcggttcgattatttcgcgttcgggttttttgtgatcgttttaggttttgtttaattcggagcgcgtttttttttttcggcgttttcgttttttgtttcgatttgttttaattagtttttacggttttgtttttcgaggtatagtgtttagcgcgattttttgggtttttgcgtttcgggatacgttggttttgatttcgagttcgttttttttaggaggttaggtttttattagttttattttttattttttgtttcggggtggatttgtgggttgttattttttttttttcggttttaggaatttgttgaagttggatcgtagaaattgggaagcgaatttaggttggtatttatttagttcgataaataagagatttttcggtcgttttttttcggggttgttggtttcgcggggggtggggtgcgtagttttgggggttcgtagcgaggtttagttagttcgcgttagaggttcgtaggggttgaggcgtatagaggagggagaggttgttgggtttggttagggttttggagacgcggagggagggtagggcgtcgagtttcggggtgtcggtttttatgacgtcgaattgtttgggggatcgttagcggtgcgtcggtcggagttagttggtggcggggcgggcggttcggagtgtttgtttaattttgagcgttcgcgagggggaggggaggtagttggttacgggttagggggtagtaaggtggaggagcgggggttgggaaaggggagggtatttttcgggttgtttgtttgcgtgtttgtcgcggtttacgataatcgggagtttaaattttatgaattattcggagttgttggagcgataaattttaggttggttttttttttcgtatatcggtttttcggatttttggagggaatgtttgtttagcggtcggagttggcgg

SEQ ID NO: 11421 - DNA, 2063 bp, synthetic construct
  misc_feature 1..2063: note = Description of Artificial Sequence: Synthetic polynucleotide
  source 1..2063: mol_type = other DNA
cgtttaaagtagaggcggtaattaggcgttcgggttacgttatttgataataggatagatgttgtacggttcgttttttttatacgtattatttcgtagttcgtagtatcgttagaaaatttatttgattttagagtcgtagagcgtttaggggttttttttcgtttattcgtagtacgtttcgggtttttttttttttttaaataacggtatcgggtttttgtattaaaatacggcgggttcgcgtttgttattattagtgtaaaatttgcggggggttgttcggaaaggatcgaattttatcgttgtatgagttttaaaagggagggggtatatttatttttagttttttattttattttcgtttgattgtgatgtatatcgggcgtttgtatagtttcgttttatattagtatatacgcgtttcggtttcggtcgtttttcgtcgttttttttaaattcggtcggttcggggtttggcgtcgtacgcgggtcgttaggggttagcgttcgtttcggttcggttcggtcgaataaagggttcgcgaatttttcggtaaagttgcggttgcggcgaggagcgggcggattgtcgcgtttatttgggtttcgttttcggcggcggcggcggtttcgcggggtttcggtggcgcgggtttggcggcggcggcggtacgaataatcgttcgagggtttcgggagtgcgcgggcggcgggggttcgtttagcgtcggcgttacggatttaggtttcggcgcgggcggcggcggcggttgcggcggcggcgcgggcgagtgggcggcggcgcgtttcggtaggtttaggttcggtttcggtaacgtcgcgacgcgtttttttttttacgttcggcgggatgcggtttcggcggggttcgggttttaggcggcggcggcggcggcggtggtagttgcggacggttgggcgcggggtcgtttcgtttttttcgttttcggttcgggcgggtttgcggttattgcgacggtgacggcggcgggagcgcggcgggcgttgggattgttttgttagggggcggttcgggcggcgtttaagattgcgcggcggcggggtcggcggcggcggttacggttttcggggtcgtcgcgttgaggtgcggagttgttatcgcggttattttgttgttttaattgataagaattttttttttttcgttttagttagacggggcgttcgcgttttttttttcgtttcgcgttggtttttaataggaagtcgtttcggtttttagtacgtgatttttatcgtatttgtatatcggagggcgaattggttaatcggtattttgtatttgagtttttttttcgcgcgtttttttcggtttattggtttttcggttaggttacgtttttttttttttttttaatattcgttcgcgttgtggttttttgtatcgcgcggggagcgcgtcggggtgcgagcggtgcgcgtttcgagtggtcgggacgcgcgttagttttgggagtttgtattgttcgggggggttacgtggagatttgcgtggtgttttttatcgtcgtcgtttgtttttcggtttttgggcgttgtggtttcgcgttagggtgttggcgggaggggtgtcgattcggttttgcgcgttcggtgggtttttcgggttagcgtttcgcggcgttcgggttttatgttgtaattgcgttcggcggcgttcggcgttcgtatcggcgcgcgtttcgttcgtgtcgtgtatacgttttgtatcgttttattttgtatacgtatacgtatacgagtttttggggttttggagtatcgtgttcgtttcgcgtttttcggttcgtttttgcgtttagtcgttttttagggagcgtttagttgcgagtaaaataagtttcgttgcgaaatagtttttcggggagatagtttttttttcggagtatagatattatatttttatcgcgtaagttttcggttcgggtcgaattcgggcgtttcggcgtttacgtattttacgattttttttcggtgtttcgtacgtcgtcgtgattttttattttacggtttttcga

SEQ ID NO: 11422 - DNA, 816 bp, synthetic construct
  misc_feature 1..816: note = Description of Artificial Sequence: Synthetic polynucleotide
  source 1..816: mol_type = other DNA
cgtagtaaagagtttcgggcgttttgggggagagcggttttaagtttcggaaagtgggtagagtttttttttttagggttgagacggtaggcgcggggtttttttcggattcgtttcgttaaggggatagtgtaggtcgtgtcgcgatttagattcgacgttttcgcgggtttcgcggcgttcgggttgttttcgtcggttgggagcgttcgagtggttttcgggaatttatcgtgaagtaggagggtcgggaataggtatttgagtaggaggcggcgcggttaggatatttttagttttgttttggggtttttcgtacgtcgcgtttcgatttggtgttcgggtaattgggcgcgcgttttgtttttcgttttcggtcgggtgcggtcgggttaggtcggggttttaggcggttgtcgcgcgttttatgttcggcgggttaggcgcggggttgcggggcgcgcgttttttgggcgtcgtcgggcggttgtgggcgtttcggttcggttcgcgtttcggtttttttgtcgttcgtttcgattttttcgcgttcggtttcgcgtttcgtttcggtcgtcgtgtgcgtcgttttgagttgtagtggtcgttatcgttatcgtagttgtagcgtttttttatatttttagcgcgtcgtcggtcgggtagtttggtcgcggtacggaggaggggttttggagggggcggtcgggggaggcgacgtcgagttatcgttttcgggtagtcgtcgtcgggggggagcgcggagatttgaaagggcgcgtcgggtaacgttttttttttttttatttcgggcgt

SEQ ID NO: 11423 - DNA, 368 bp, synthetic construct
  misc_feature 1..368: note = Description of Artificial Sequence: Synthetic polynucleotide
  source 1..368: mol_type = other DNA
cgtgtcgtttgcgttcgtgggttatatatattttttttttttttattgttttttgggcggtgtggattagttgtagagtgtgatttgcggttagggagtgttttttcggagttttcgtttttagatttttggtgttaaagacgttttgtgagcgggtggggtcgggcgttttagttacggcggtcgtcgtttttttttttcgtaggacgggatagcgtttttgtggatcgcgttttagatgggttatagcgaggtggtgcgggtgatgttgttgcgcggagtcgatcgcgacgttgcgcggaacgtgagtgttcgagtcgcgcggttaaagagcgaagtttttcggcgcgtttgtgtggagaaaacgg

SEQ ID NO: 11424 - DNA, 1411 bp, synthetic construct
  misc_feature 1..1411: note = Description of Artificial Sequence: Synthetic polynucleotide
  source 1..1411: mol_type = other DNA
cgtttttcgcgtttttttcgcgcgcggtttttggagtttttgaggcgcgcggttagtttagttcgggttcgtagtatcgggagtagttcgtcggttaagcgagcgcgggtcggggtcggggtcggggtttgggggcgtcgttttcgggagtttttttgcggtttttgaggagcgagggcgacggcgaggttgatcggggtcgaaattatgaatcgaagtttttataagttttagattttgcgattttacgattgtagcgtagtggaagttaagagtaaggtaagtttttcgttcgtttcggcggttttgcgtttagttttttggttaatgaatggggcgtttcgcggagggggattggggcggcgtggaggcgataggcgtcggcgataattttttagttcgggcgtcgcgcgtcgtttcgcgggacgcgtattggggatttcggtcgtttttttcgtttttcgcgcggatataaagttcggtagtcgcggcgtttagagggtcgagggttatcggatagttcgggtagattttggattcgtttcgcgggagttgtttttttgttttacgagtgagaggcgatcggggcgcgttatatattggaggggagggcggttttttcggggcgagttgagggttaggggttgttcggattcggggtcgtgggggggttttgggggttcgggtcgtgggatggttttggttaaggcgtttttaaggttgtaaaggaggtttgttatttgttaggaggagatttgtcgtcggtttcgagttcggcgttttttattcgttcggtattaaatatttaggtattaggcgcgttttttcgcgtagatttagagtacgtattcggttttttttcggtttagatttagattacgttttttcgggcgcgttttcgggttagatattttattttatttttacgggcgcgtttttattttagatttttttattttcggacgcgttttcgttttagatttagtttattttttcgggcgcgttttcggtttagatttagatttttttcgagcgcgttttcggattagattcgtatttagattatttttacgggcgtgttcggtttttttcgttgtttgcgttcgggcggagcgtgttcgaatttgcgggtcgcgatgcgcgtttgggtaattggttggtaggatttggcgtttttgttttttgcgggggtggttttttcgtcgtagatgttattgtttgtgagggtttttttggtggatttcgcgggttgaggaggtgttgtagttgttcggggttttgcgggagggggtttttcgagtttttcgttggttattttttgggagttgagcggttttttcgtttttttttttttcgtatttcggtttttagagttgtgggaaaggtttttaacggcggagtgggagttcgt

SEQ ID NO: 11425 - DNA, 1487 bp, synthetic construct
  misc_feature 1..1487: note = Description of Artificial Sequence: Synthetic polynucleotide
  source 1..1487: mol_type = other DNA
cgggttttgcgattcgcggcggaggcgtatagtaggcgtttaaacgatcgtgggtttagggtttcgcgttagcgttttcggggttttttggagagaggtagggtttcgtcgtttcggttttcgtaggaattagttggagaaaggcgggcggtttggggttgaattttttttattttttatttttttcgtcgtttggagtagatacgtcgtcgtcgcgtttttgggaacggttagggaagtaagtagaagtcgggaagtcgcgaaagaggcgagaaagtgcgattttttttttagattttcggtttttcgtcgaaatttttgtcggtcggttaaattttagataatggaagttttacgtttttatttttatttttttttataagttcggtcgcgggtttttttcggttcgggatttcggcgttagtttcggagtcggagtttgtacgatacgttttttttcgtcgttttatttttttattcggagatcgtttatttttttcgttttatttttttatttttcgtttggtcggtttcgttcgattcggaggcggcgtttttttttttgttttaggtttaggaaggaggacggcggaggaagtagggggttttggttgcgggcgtagggatgtgggtcggcgatcggcgttcgagggcgtaaaaaggcggttcgaggattgcgcgcgggcgggtagcgcgggaagtcgggaagaaaggagggcgcgcgggggaggaggttgcgggtgcggggttcgaggtcggggcgtttattttttcgcgtcgttcgcgttcgtcgtttagttttcgttgtaggttttgcgcgcggtttttcgtttcgttcgtttgttgttgtagggtttggattttgcgttttatcgtttttagggagttgaggtcggttatggcgcggaggcgtagaggcgtacgggtagcggcggacgttcggttgggttcggtttcggcgagagttgtatagtcgcgtttcggttttttaagtttttgtttgcgcgggggtcgttttcgttttttttcgtttttcgggtcggttgtcgtcggggcgatgaggttattcggtcggatcgtcgacgttagtatcgttgggggagggtttgacgtcggtatcgttggttatagttgttggaaagtgttttttttcgggatttatttggagaaagcgttgggaggcgtcgttttttttttttttttttttttttttttttgcggtttttttcgttttttcggtttcggggtttcggtttggtttcgtcgcgggttttcgtatttttgtatacgtacgtcggaggttttttttttcgtgagttttagttttttttgcgcgttttttaggttttcggaatatttatttagttcgttttttgttttttttagttttttttggaggtgcgttagttttttttttatttggggacgatagagcgaggaacgggttagtttggggggggggttacgttttcgaggtgtaggggcgg

SEQ ID NO: 11426 - DNA, 602 bp, synthetic construct
  misc_feature 1..602: note = Description of Artificial Sequence: Synthetic polynucleotide
  source 1..602: mol_type = other DNA
cgcgtatcgttgttgtattttttttaacgtattcgtaattttttttaacgtattcgtattttttttaacgtatttatattttttttaaggtattcgtattttttttaagttattcgtattatttttttttttattttatgcgaagattgtagtttcgtagttttgcgattagcggtcggaagtagttaagatgttattgtttttagtatgtttcgcgaggcgcgtatagtataggtttttttttaaggttattatttttattttcgttgtatgttgggattgtagttcggtcgttttgtgattaacggttggaatcgtttaagatattattttagttagtatggtcggtaggagcgtatcgcgttgtttttttttagggattcgtatcgttttataattttgttttgtgttgagattgtagttttgtaggcgtataattaataagttgggtgtagataagagattatagtttttcgtattttaagtaaaggttttttttttacggagtttttttacgcgtttattgcggtttcgtcgtgttaaggggagtttggttgtttacgggttttatttgttagcgagaagatagtttggtcgggcgg

SEQ ID NO: 11427 - DNA, 628 bp, synthetic construct
  misc_feature 1..628: note = Description of Artificial Sequence: Synthetic polynucleotide
  source 1..628: mol_type = other DNA
cgttttatcgagaatagaaagtgcgttttaggtattattcggatttcgttaaattatattatttagaaggtagtgttataagggacggaagtcgattttaagttatagacggaaggcgtagaggggcgttttcgtagcggcgtgggcgggattttcggcgtttagttttcgttcgtcgttaggttgcggttgttgtggttgttaacgttatattgggtagaacgttagataggggttatttttcgagatcgagtagagacggatagtgaggaggataggatttatttatacgtttttatgttagtcgcgattttatttttataagcgtttgtaaaattttttttggggttttggcgatagttttgtgtttttacggcgcgtagaggcggcgtcgcgaattttgtgtgtattttatacgacggcggggattgaggtttttcgtagtttagagtcggagttcggggtcggtcgagttcgtaggatcggttttttcgtcgatttttacggttttatttagttttttgggtttatggcggcgtcggcgttggtgagtggagggtttcgtagttcgcgcgagttcgggttatcgttcgtatgtatttattcgttgtaatacggcggatgtcgg

SEQ ID NO: 11428 - DNA, 215 bp, synthetic construct
  misc_feature 1..215: note = Description of Artificial Sequence: Synthetic polynucleotide
  source 1..215: mol_type = other DNA
cggttgcgtattgatcgtatttgttatgttttattttttttaatcgaagttgaaggtcggtttcgatgtttgttattttttataattttatcgtagtcgatagttttataaatattatcgttcgtttagttttcgttttttcgggtcggttgttatttcgcgttttcggtttggttttggtttcgtcggttgtattgtacggttcgttttttcgt

SEQ ID NO: 11429 - DNA, 2638 bp, synthetic construct; identical to SEQ ID NO: 7166
  misc_feature 1..2638: note = Description of Artificial Sequence: Synthetic polynucleotide
  source 1..2638: mol_type = other DNA

SEQ ID NO: 11430 - DNA, 2172 bp, synthetic construct
  misc_feature 1..2172: note = Description of Artificial Sequence: Synthetic polynucleotide
  source 1..2172: mol_type = other DNA
cgcgtaggttgtgtacgtgtttgtgtgtacgtgtttttcggtgtgtgttttagttttagtgtgttggcgcgtgttcgagtatagatatatcgggggtgtttgggtattcgtatatggttgcgggtggggcgtagtggagaggaagtttatatatgcgtgtgttgagatatggtcgtatttttgtgtttttttagtttagacgtaggggagattagtatcgagatattcgagttcgggagttttttagcggcggtcgggcggagtttggttttacgtggggttggagagtacgtaagtttggagtttcggcgttcgtttttcggttgtcgtcggtttttgtagaatcgagtggtcggatggtagttcgcggggaggttcggttattcgttcggttcgttcggggcggggagaagaaggagagttggagagagaatcggtcgcggcggtcggagaggcgagcggagtgtaagagaggcgagcgtttttgttcggcgttcgggcgcgtttttcgtttttttcgttcggttcgtttgttcgttggttttttttttttttttttttttttttttttttggttttgtttttttttttgattttcggttggatgattgaggtattttagacgtgggttgaattagagcgagcgagcgagtttaggggttgtagcgatttttcgataagttatttagaggcgattttgtgcgcgcgcgttttttagtggttttcgttcgttttttgattatgttgatatatttataggataggtagtagtatcgatgcggcgttgcgacgttatagttttcgatattttttttttataatttagttttattttttagtattcgatttgtgaaaattacgtttatgtagtaatataattggttcgaaagcgttaaagagttaattaagaggttttcggtttttcgtagtttatagcgtagttcgattttttagagtcgtcgagtagacgttcggtgaattttagaggcggcggagggtggcgaggagttttcgttttttttcgtttttttttttttcgatttcgttttttttttttttttttttttttttttttttttttttttttttgttttattttttttttttttaaattttttttgttttgcgcgtttggatatagatttaggaagcgaattcgtttacgttttaggataaggaagagagagaggtacgggagaagagtttagtaagatttggattgaaatcgagatatttttcggaggttcggagtagaggaaggaggaggagggcggcgaacggaagttagtttgtaatttaagttttgatagcgttggtagaagggggtttaaattagatttttttttttttaaaggagagagatttttttcgttttttcgttttttgttaaagtcgggtttagtatagttgtagacgttattagtgagaaagagggagaggaagatagatagggggcgggggaagaagaaaaagaaaggtaaaaagttttttaggagaattttttatatttgtaataaaagatttaggggttggagagagatttttgggacgtagggttggagtgtttatttcgagtttagcggtagggttcgggcgcgagtcgagattttgttcgtttttttcgtttttgaaatcgacgtttaggagcggttttttaaaaacgtaaggtataaggacggttattcgcgcgattatgtttgttgatttttcgttttgttttttttaaaagcggttttttattttttaaaagatatttttttttttttttttgaagtgtattagttgtgatttttgtttttttttttttttttttttttttttgttttgttttttttttttttttgaattatgtgttgttgttaaataataataaaaaaataataaaatatagtagttgcggatttgttttcggttggagtttagcgtttcgtttggagtggatgagtttttttatgagagattcggttatttttgggataagtatggtttattattcgtttttattttatcgggcgtcggatttcgttatgagcgcggtgttgggttattagtcgtcgttttttttcgcgttgacgttgttttttaacggcgcggcggcgttttcgttgtcgggcgttttggttaagtcgattatggattaattggtgggggcggtcgagatcggtatttcgt

SEQ ID NO: 11431 - DNA, 2548 bp, synthetic construct
  misc_feature 1..2548: note = Description of Artificial Sequence: Synthetic polynucleotide
  source 1..2548: mol_type = other DNA
cggagttgtagtagaagcgttttcgatttcgtttaggtttttagtttatttttttttgaaggtcggtagggggcgttattatcgttggttttttcgcgcggtttcggttttcgtttcgggaatcgagtgtttgtagttcgcgattttggggaggtatagggttagggtatcgtttcggcggagaaagtggttgtgtcgcgcgggtggggtcgggttagggttgggttgggttggagggcgcggggtatttgagtgaagtcgtagttttcgggcggggtgtagaggagattttttgagcgttggagcggggagagttagggcgggggttaggcgtcgtagtttcggacgaggttcgagtagtttttgcgcgtttcgtagtaggtttagtagcgtgtgcgttagcgagcgtagttttgcggatcggataggagtcggagcggcggttagaggttggttaggtttttttttttttgtttttcgttcgggttcgggtgaatagaattgatcgtatcgtcgtcggcgttgtaggtattgttggtgcgttaggcgcgtataggcgttttgggatttcgggtataggcgggtatagaaggcgtagagtcgggcggcgtttgtttgtagtttttggggggggttttaggttagaagttttttgtagttgggttcgcggttggaggaggttgttgcgggcgggataggggttagtttattttttgtttggggttttagtttttttatttttttttcggaaggagataggttttttcgaggtagaagggagttgggaatgggtatgggtcgggtggaaacgggtttgttttacggttgttcgttggggtattggggacggggtattggaaagagggcgtttatcgtttatttgtttttggagttagtttttgaatattgttacgcgggtgtagatttcgggtttttttggtttttcgtagtcgtttttttaggaggtgatttcgaataggatttttttagggcgggggttaggtttagaataggttagggggtttttcgagttattttgcggggttaagagagaggacgttgtatttatttgttttttatgacgtttgttttacgtttggtaggtgtgagtttgttatttgtgtttattttagggatgaggatagagaggtttagagaagtcgagtgatagatagacgtggaaggaaaagaggtcgtagtggttttgggaaggtttagtcggtttttttttattagattgggtttatatttggtacgagttaacgtttttcgttaggtattcggcgtagagtatggtgttggggcgtagttcgggttttagggtttttcggtaggtgtcggtgttgagtaggggaatacgggttttttttattgttttagttttaggttcgtttgtagggaaggggtggaaggtttaggtttggagggtaagagtttcgttttgagggttttttttttattattttttttgatttttttttttttgaaagagtaggtagtatttttttaaggtaattcggtttttttatattttattatttcggatttttagttttttttattacgcgtcggtttatttacgtttagtattttcgaagagggcgttttagttcgcgatggcgtaggcggtttcggtagggggtttttggggtttttggggtaggtatacggggcgcgtcgattttttcgggtttatcggcgtttatagttgtattagggttaggtcgttgtggaaggttcgcgggttaaattgaggagggggaggcggcgtagggttaaggaagtacgggtgggggtgcggtgtttagttttgggggtttggggattgtttttttattttggggtggggtaggatgcggtttattggtatttttttcgtttgtttttttcgggatttttttgttagcgttatagtttatagaagtttattcggggcgttgcgggtcgagcggtagttgagacgtaggaaggataggggtatatttcgtaggtttttcggagattttgttttttcgttcgtatgtcgggttttttttatttgggggtacggagggcgggtcggggaggggtttcgttttagagggggcgaattcgttcggtcgtgttatttttttcgggttggtattttggcggggcgggcgcggcgttttgagatggggaagttcggggtcggtcgtcgttagggggtagtagagattatttttttcgcgcgtcgttcgtcggataattcggtaggtgcggggtttagcgtcggggattttagttgggtaaggtttgggggttttatttattttataaagtagtgcgttgtcgtgagtatttaggaggtcgttattaggacgtcgtcgtatagaggttgttcgtcgagttgtagttttattagttagggttaggtttcgggcggcgtcgcgttgttttttacgatgcggtcgtgggttcgcgttatattggtagtgttcggacgtttttcgtcgtacggttttagaaaggggtaaggggtgttacgagggatatgttttggttattttcgttttcgaggtttattcgg

SEQ ID NO: 11432 - DNA, 919 bp, synthetic construct
  misc_feature 1..919: note = Description of Artificial Sequence: Synthetic polynucleotide
  source 1..919: mol_type = other DNA
cggtggggtgtgaacgggcggaagtttcgtttagtgtttgtttaattatttttagtttgtggaggtcgagcgaatgcgggtgtggggttcgggtcggggtatatttacgcgttgcgttggtatcgggattggatgtagatgagtaggcgtaggtggtttcgggggcgcggcggtttttttttcggcggtttttcgagcgttgcgggggagggtgggacgtggttaagcgggcgggcggcggggtgggcgatagagcgggcgatttttttacgtttcgggttttatttacgtgtagcgtggcggcgagagcgtagaagttagttacgggcgttttgtattggtcgttggttaagtttaggttcgggtcgcggcggaaggtattttcggcgtcgggttgcgaggggtacggatggttatttcggttttcgttcggtcggatttattcgttttttcgcgcgtcggtatttattaggtagtagacgttaagttcgtgtagcgcgcgtcgttttattaacgcgtttcggcgtaggcggtagaggaaagcggtttttacgcgcggcgttcgcggtttcggggttaggggcgcggttagtagtgttagtacgttttttattacgtcgtcgtcgtttttttcggcggtggtcgagatcggggcgaggttcgtagcgatcggttcggcggggttatacgtatagggttcgggtttcgcgcgttttcgttgtcgtatcgtatttggtatagagcgagcggtggtcgcgcgttagggattttttattcgttcgtcgcgtgggtttagttttgaacgataggtgttagcgagattaggggtttgtcgggcgtaggggtggggcgagggcgacgttttttcggtttgaagggtttcggagtttttgcgttttgattttgtagcggttttcgt

SEQ ID NO: 11433 - DNA, 2488 bp, synthetic construct
  misc_feature 1..2488: note = Description of Artificial Sequence: Synthetic polynucleotide
  source 1..2488: mol_type = other DNA
cgggtcgagttcgaggttgttcggaggtttagggtttttatttcgcgatgttagttttgtttttttttgcgtttcgggtaagggtttgttcgtttgggggatcgtatttggaattcgcgtggttttttttttcggcggtgtcgtttttacggatagtgcgtgttcgggtttgggttggagcgacgttttcgagattattttattattttataattgtggttcgcgcgtcgttaggattcggttcggtgtgggttggcggagtataatgatcggcggcggggcgggggcgggtacgcgggcggcgggcgttgggggtcgcgtagatgtttgggtcgaataggtgagcgtttttcggatattcgggtgttcgtggggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgagagtcggttacgtgtttggtttttttagttcggggtttcgtttcggtcgttcgggggagtcgaatttcgaggttcggtagtttcgttttataagtattcgcgtttttggggattcgaaagacgtatgggggtcgaaggttgttcgaaggggtttcgggcgtcgagagtttttgagggtgtttgagttattttatttgggttaagttttttttttttggtttgatcgtagatagttcgtcgggtgttttttttttttagtttttatcggatttagagatcgtagttttcgggagcgatgggtaggtatagattttagcgtttttttttcgggtttagtttcgtgtaaggatttttttcgaagcgttttttttttaagagcgcgttttttatcgaagcgtacggcggcgcgtttagcgcgtttttatttttttttatttggtttagttttttttttttttttttttttttttttcgcgttttttttttttttttttttttttttttttttttgggtgtttttttttttttttttttttttttttcgtgtttattttttttttttattcgttttttcgttatttttttttgttgttttttttattttttttgtttgcgttttttttgcgtttttttttttttcgttttcgtttcgtgttcggtttcgttttttttttcgttttttcgtgttcggtgtttttttttttttttttcgggtcgcggcgtcgtcgtcgttgtcgtcgttgttcgtttgggttttttttttggttattttcgttttcgggtcgggtagtgacgcgtcgcggtggtgttagttttttttttcgggtagtcgcggcggtagtagtagtagtagtagttggagttgtggggttgttatcgtcgttcgtttcgtttattcgcggatttcgatcgtttattttcgtttcgtttttagtttaggtacggagttcggttcggatttcggcgatcgggtcgttttcggggttcgggtcgtcgtttttttttttcggttgttgtcgtcggtcgttgagttgcggttaggggggcgaggggttgggggcggttttggggaggggggcgtagggggagttttttttgtcggggttgagggagggggcgcgggggagcggttgcgttttgggtcgagtgggttggggcggggggcgggtgagtgtgttcgagagtggagggggggcgatgaaggttgtattgtgggggtcgcggggcgtttaagaggtgtgtttggttttgagcgtttagggtcgcggggcgtattttattttcggggtgcgcgtcgcgggttttggggggcggtgattgtgcgcgtagcgtcgcggtattgtgttacggtcgttcggtgtgtagcgggttcggtatcgcgtttcggcgagggaggcgttttttggcggcggggcgggggtcgggttcgggttgtcgcggtcgttacgagaagggaagtggattgtgtttggggatgtgaggacgggaagcgttgagtgttagggaggggtttttcggcgcggcgcggggagttgagacgcggtttgtagagttgagtttattttagtaggttcgggtttttttcgggaggggacggggtgttttttttaggtgtatcgtttgatcggaagtcgcgggcgttggcggtttttggcgaaggggttttttttaatgaggggatacggcggggcgggggtagtcggtcgtttcgagggcgcgcgtaggggttaagttggatttatattttcgtttttttttttttttttttattttgtttttaaggttggatattttggatagggaggaggggggagtgtaattcgtatttttattttagtcgttcgggagtagaagtgattttgtttttattcggagttgcgtttgttcgagttcggtcgtttttatcgggttgcgt

SEQ ID NO: 11434 - DNA, 513 bp, synthetic construct
  misc_feature 1..513: note = Description of Artificial Sequence: Synthetic polynucleotide
  source 1..513: mol_type = other DNA
cggtcgggtttgttacggggttttgtgtagttttttttattttttcggttgttagcgtttcgtttcgtttttttttagtttttaagggaggaggggagagttgtagagaggaggaggggtcggggaggtcggttttataaaggcggttggaataattttgttcgttagatttcgtcgttcggattttttgagttgttcgttattttacgtgatcgcgtcgttttttagttttatcgttgagtgagttggggcgcgtttttatttcgtttttagtttttcgtcgagtcgcgtggtgtattgaagtcggcgtggggaggagagtcgatgaaggagaacgttaatatgggggttttaggtagaatttttaatgggagagatttaggatttgagggagtcgggagattcgggagtttacggtttggtcggttattttttttttttttcgggcgcgaggtttatgagatcgtaagttattttttaagaatgcgcgtgtagtcgttgtcgtggtaacgt

SEQ ID NO: 11435 - DNA, 1766 bp, synthetic construct
  misc_feature 1..1766: note = Description of Artificial Sequence: Synthetic polynucleotide
  source 1..1766: mol_type = other DNA
cgttttttgtttattcgcgttaggtcggttttttttcggttttttttgtggcgcgagggatagcggaaattacggtagatagtatttttttgagtttaattttttttttttcggaggaagtcggttttttttttttatgttattttcgggttatttttggataatagttgttatttttatttgagtcgaagttaatttttcggggagttttcgggcgcgtataggtagttcggtttgttttgcgattgagttgcgggtcgcggtcggcgtcggtttttttaatggtaaatgtgtgtggttggaggcgagcgcgaggttttcggtaaaggtagtcgagtgtttgtagatcggggcgagttttgtgaaagtagataaaagaaaatatttattaacgtgttattacgaggggagcgttcggtcggggttgtcgtatttttcgcggaatatttggttttttttagtttcgagagaggagaagaagaaagcggaaaagaggtagatttacgtcgtttttagttaagtggatttgatcgatggtttttttgaatttattacgatatttgatttattagcgatgttttttggtttgtgtgttacgtatatatacgtgtatataaggttttggttcgtttttttttttcgtttttagtttttgggcgaattttatatttgttttaatttttcgtcgagggcgagtaggagcgagagtgtgtcgagtgagtgtgcgtttgtgtgtttcggcgagggtgcgcgttcggcgtcgggagcgcggttagtcgagttcggaggtatcgggaggtcgagagtcgtcgggattttagttttgcgtttattgtttcgttcggagttggatttcggggtcggggtcggggtcgtgcgtcggggataggtagggtcgggtcgcgggtcgcgcgttttttaggtcggaggtaaaagcgttagcgcgcggagggttcgaggagggtatcgcggttgggtttttcgcgtttcgggttttagtcgttcgcggttttcggttcgacgtttttcgtttcggagcgcgttcgttttttttgcgtggaggtcggcgggtaggcgagcggggggcggtagcgtcgtgttaaggggttggttggggtagcgtggtcggtcgggttggggcgatttaagagcggttcgggcggggtgcggagtcggattttggttggggcggcgcgcggggagggggtcgggggcggtggcggcggcgttggggggcggggaggaggtaggaggaggagtagtagcgttcgtcgggggatgtagtagcggtagcggcggcggcggcggcggtagcggtagcggcggcgcggagttttttgcgtttagcggttcggtcgggttgcggtagaggcggcggcggcgtttcgtttcgggtgaggttgtcggggtcgtgcgcgttggtgagtggggcgtggggggtaggtgggtggttgggggacgcggggttcgggcgggggttcgcggcggtcggagtttttttcggcgtgagttcggtcgcgagcgtcgtttaggtgagtcggggttggttcggatcgttcggttttagttttagcgttgtttgcggaggtgggttcgggcgggcgggagggaggtttcggcgtcggtcgttcgtagagggatgatttgtttgatttcgttggttggcgggcgggcgaggatttttcgtcgcgtttttgattcgcggatacggtatatcgagtataggcggtttcgggtaggggagcgcgtttgggtcggttattcgt

SEQ ID NO: 11436 - DNA, 6511 bp, synthetic construct
  misc_feature 1..6511: note = Description of Artificial Sequence: Synthetic polynucleotide
  source 1..6511: mol_type = other DNA
cgtagggtgaataggttcggttaggagtcgtagcgtcgtttatttgtatttcgtttatttggtgaggtatgtcgtggagttttaggttttcggttaggttcgcggtatttagggcgtgtgcgtggggtagtagtaggtcggagcggcggtaggtatttttgcgggcgtttatcgcgttcgtttttagttcggagaggtggggtagtaggtcggtcgggcgttcgtggtgcgagggtagtttcgtttttttttggttttggcggtcgggttaggtttgttgttggttgtttgtgggcgtcggttggtgtagggggttgatggcggcggcgtacgttttttttagatgcgagtaggggtcggtcgattgggagtaggttagttgttggtagggagggggaaagtagggtggcggttgatattcggcgattttagtgtgggagaggggtggcgcggggttgtagaggtgttgttcggcggaggagaggtgggggattcgcggatttttattgttgttttcgtcgtggcgattttggagggaaaaaaaaaaataggagatttcgttagtgcgaaatttcgttattgcgaattggtcggtatcgtcgggttacgtagagggtttcgggggattaatcgtatttcgttcggcggggtttgtttagggtcggaaggtattcgggggtaatgcgtttcgaggatttcgttgtaagtaaagagtgcggggagggaggagagtttggtgaaagatttgggggaacgagtttttaaagttcggcggcgaaggtttaggcgttgtttttaagttcgaggcgtttggaggcgttaagttcgaattttgggttttgggttagaaaagttcgtggtcggagttcggggcgaaggagttagagttcggggcgaaggagtcggacgttcggtgtagagttatttcgtggagttcgtttatgacgtagggattgttggaggtggtagcgcggtaggcgcggatagagtgcgcggcgcgggaaatgcgtatttttttcgttttcgggatttttttttttacgttttcgggataaagattttcgagcgggcggcgttcggaaagtagggttcgttattttgcgtcgttttgggaagtgaagagggagcgcgcgtatagggcggttttttttgttggtcgggtttagtcgaggggagtaataagtgggggcgttttgtattgttaagggtagtgttttcgtacgtcggggcgtagagggggtatgaagaattttggaaattgggtagttttgttcgcgtacgttttttcgtttttgggcggttcgatttagtttttaaaggatgcgtttttatttgtttaggggtttcggggcgtcgggaatttggaggaatatggcgttgtcgttttttggcggaagcgttcgggtttgcgggtaggggtagttttttagggttcggaggcgtagtgaattttcgcgagttcgtagttcgagtttcgcgttttcggcgtttttgagttcgtttagcgttgtttgcgtttttttttttttttcgttcgtcgtttttttttttttttttatttttcgaaattttagtttaatttgttcgataggttggagtattcgcgagtttttacggttttatttggtttcgggtatttttattattattttttagtttttattttttttgaaagttaaatttcggttgttttcgtgttttttcgaggaggtagcggggtaggtgataagtcggttttggaggagtgttcgttaaggtgtcgttagtaggtagttttatttgatttttttggatagagatttcgtgcgtaaaagttacgtttgagggttgtagacggggtattttttcgagaaaacgggaagtagggttgtttgtcgtttaggaaagcgttcggtaagttgtgtgggtgggatttgttattttttttttaggtttcgttttcgaggggaggttatttaggaaaaggttttatataggaaaggggtttcgtagaaatggattaaggggtgttcggagaagtggatttcgttttatcgagaggttagggtttttatgttttcgttttcgatttcggtttagtggtttttgtttttcggattgttttcggcggggcggggttgtatttcggagttttagtttatttcgtagtttttttcgtatttgatattatcggttattttttataatatggcgttcggcgttttttaaaatagtcgttagttaaatttaggatttttttagtttttaagcggtaaatttaaaatcggggttacggtgattaggcgtttgtcgtcgttttcgtcgcgcgcgggttttgttgttcgggttattggatacgtatcggcggttttgcgagcgtagatgttgtcgtcgcgagtgttaagatcgtttcgcggacggggaaagtcgcgttcgaatagtgtgttttggcgatagtcgggggattcgagcgttttaatgagaaggaaattattataattttttttcgggggtcggcgcggaggtttaggcgtcgggcggggcggtttttagttagttttagtttagtttcgtttcgtattcgggtttggcgtagcgtcgagttttacgttgtgagggacgaagcgcggagttagtgggcggtgtttcgttgatagtcgaagatttgcgaggtttgggtttttcgacgcgttttttttttgttatttttatcgtaaatatatttgagattggtagagttgggggaagggatttaaatattgaaatttatttttttttcgtttaaacggtttttattcgtttttttaaaagacggatgttatttggagttaagaaattgcgtatttggggagcgatttaataatcggggtttttttattttttaaaaatatattttattttatttatattttattgaggtttaaggtttgagttgggattatgtagttggagttttagtgcgttagagacgtttagtttttttcgtgggtatagcgcggtttcggttttcgggcgggaggagagaggaagggatttttggggagtttgttttaagggtcgtagaggtagtagacggttttattcgtttaggagttgcggatagcggcgtttcgtcgttgtcgttcgaagtggtatttttcgcggttggttgaggttagggggaattcgcgcgtattggattagtttagcggttcggttttgttttgttttgcggaacgtcggttttgtagttgtttttggcgggtcggttatttagaagtttttattcgttttgggaaagaagcgtcgggtaggaataaaattcgagcgttacgggtaaggtgagggtgaggaggtgtaggaagttgggagagagtttgtagagagttttcgattggagaggtagatatttaggttttatatgtttagatagaaaacgaaatttttttttatataaacgttgtttttttttttttttcggtatttgttatttaaatttgaaagtaaagtgtaatattaatttttaaaatttaaattaacgaaattttttggtttagttattatgtagtaattgatttttattgtaaggggaatatcgttaattttcgagggcgtatttgttgggacgttttaattggttttttgggttggatttaaatattttgtggggattagaggataagattatttttatttgatattgaatacgattttgtaataattaatgtttattagtacggtgttcgtatttgtagtagatatgatttttttatttacggaatggcggtatttattgtttcgttgttttttttcgggttcgtttgaattttagtatttatttagatttaggtgggtttaaaagaaaataataataataggcgttttttaagggaaattttttttcggttttagatagtagttaaattttaggtgatttttcgatcggacgcgggaataaaatttggaagttgaaattattgagatttttcggttaagtatatttgtagggttttgtattaaggagaatagtgtataaaaagatatataggattttgatatttcggttttaaaataggtttttgggggtaaaataagttatcgtagaagtagcgtttttggtattagcggcgggggagggggatatttgttagaagtagaaattagatttaggttcgtaggtattttagagtataggtttaggaagatgggttttagattcgttagaggtgcggcgtttttttcgggcgtttgggattttttgacgggtgtcgttgggttgttcgatattttgggttttttagttttcggttttattttttgattcggtttgaggtgtagtttgaataagttgttttgtttgtgttggtaagtttattttttgtacgttggggttcggaatgggtaagaaggtgtttattttttattttaggttttggttttttttttttatagtaatattagttaaagttgttcggaggaatcgatatgttttttcgtttgggagcgtttacgtaggaggcgaagggagtcgatgggtattgagggttcgcgtagtatcgtgtcgtgggtttaaaggatttagaggattcggaatcgtttggtaaaggttatttatttttaaggagtttttttggatttcggcgttgttttttttttaatgggtaagcgttcgaattggagcgtaattttcgcgttttttgtacggaaggtagttagaataaattttttgttttttcggtacgggagatttttttttaatacgtatattttcggtttttgggtcggtatttaggtacgcgcgcgtttttgtgaggaagttttaatttttttttgattttaatttttttgtttagtagagtcgggaatcgaaggttttagtatttaagatagtttttttttaacgttttcgttttttgtttacgtgaagacgcggattgcgtggtcgcgtttaagatagtcggtatcggtagaaggggatttttttggaatttcggaggtttcgtagtcgtttggagaagaggatggaaggttgtcgggggtttttttttatcgttttttagggagtttaaatttatttattttttggaagttttggatttacgtttttatgaaatcgtaaattaggtttttgtaatagcgggagcgttttaatagcgcgttatttttaaagaggcgcgaggtggtgtttttggaaatagggttttcggttttaggtttgagttattcgttatttttgtttttattttagacggaagaaggcggttaggcgggtagagtaagattcgggtagatttgcgattttttttttcgttttagggaggggattttcgagtagaagatggaggttttcgagcgttttcgtagatttcgcgttacgcgtcggacgtttgtttcgtttttcgggataacgtgagcgtcggtagggattttagtaagtggtagattcgttaggattaagtaaggtggaaaggtcggggtttgcggtaaatttaggaggagggggtatttacgttcgttatttttttttcgcggtattggtatttattggatcgatattggcgttaaagggtattttgaagtatttatgtttagtaagggtatgttttggggtattatagatattaagttatagttattttaaaataattataaaaatgattatcgtaaataatagattgttttaatagggcgcgaagcggtcgtcgtatatagacgtttttggttttagttttattagatttagtttattgttcgtttttttgcgtttcgcgttaggtcgtatgtttttcgtttagaattttttgagttttaatttttttttttaaataatttttttttttaaataggtaaagtgaggcgaggagttgaggggtttataggtttttaagttttcgaggagggttcgggtttacgttagtttcggttcgttaaacgagatttcgtgggtatagtttttaatttgataattatttgttttattttatagtaggtaaaagtgaatttttagtcgtttaattatttgaaagttataaaggtgtttagggttgaaggttatttttttagcggttttattagggagttcgttagagatatgtttgattttttttttgttttgtttcgggggggattttcgttcgtcggaggttttatacgtttggtcgtgggatggtagatttttgttatttttttattaatatttcggagtttattcgtacgtattttaatcgttcggagcgtaggttcgaggattaaggcggtagtttcgtgttttttgaggtttttttcgtttcgtgttttgggtcgttatatatttttcggttaagttcggcgtttttaatttagaatttggtcgtttttaggcgtggagtaggttattgttgttagacgttgcgcggattcgtttttttgcgttagtattgggcgataggtagttcgggtagtatttaggagttattttgtacggttttaggcgttcgttttatttagcgttatttttcgtttttcgtagcgagttttttcgtagttttttttttttgttagttttcggggtcgt

SEQ ID NO: 11437 - DNA, 6511 bp, synthetic construct; identical to SEQ ID NO: 11436
  misc_feature 1..6511: note = Description of Artificial Sequence: Synthetic polynucleotide
  source 1..6511: mol_type = other DNA

SEQ ID NO: 11438 - DNA, 338 bp, synthetic construct
  misc_feature 1..338: note = Description of Artificial Sequence: Synthetic polynucleotide
  source 1..338: mol_type = other DNA
cggaaatttttaattcgcgatttcggcgggtgtatcgtcgagtttttcgggaagtgtagttttagcgcgagcgggacgttgggaaatgtagttttgcgcgtttacgttttcgatcgggtcgtgttcgtcgcggttttgcgaggttcgaggggtaagggagcgtgtagcgggggcgggattacgaggcggcggggttgggggcggtttttgtgtttgcgtcggggatcgcggtgatttcgttgcggatcggttcgcggtgattttagcgcgaacgagttggttgtcggttggggcgagaaaggtttgcggatcggtttgggcgtatgcgcggaaggcgg

SEQ ID NO: 11439 - DNA, 936 bp, synthetic construct
  misc_feature 1..936: note = Description of Artificial Sequence: Synthetic polynucleotide
  source 1..936: mol_type = other DNA
cgtaggcgcggggtgttttgagttttttaatttttagagggaaggagtttatcgtgggggatcggttaaagttttattttttgttcggtttagggtaaatcggtttttcggtagtttagttcgtttagtttttttcgagaggatataggggattcggagttcgtaggggttagtattatttttcgtttcgggtttcgttttttatttttcgtcgtttcgagacgtttcgatttttagttcggaggtgagggtttttttttatgtacgggcgtttgatgggggtaggggtggggacgtacgagagttttaggtttcggttcggatcgttcggggttttaacgtttttttttcgggtttaggaatagcgttttcgtaggaagtatttgtttcggagggggttttcgggatgtatttcgtcgtgttcgcgttcgatgttcgtttttttagggtttcgcgatttttggggatttttcgtttttcggtttagggggtatttatttcgtacgtggagttcgggtagcgtttttagacgtatttagcgggatatcggagaggacgtcgacgtagtgtaacgtttcggtcgaagcgtcgaataatatgcgcgcgtcgcggaggaggtgcggggcgtgttcgtttaggtagcgggtcgtttcgacgtggtagaagtttaggaagtcgtagttcgcgaaggataagttttagtcgcgttttgcgtcgtatatggcggcggcggcggggcgggggcgcgggttaggatttgggtcgggatcgggaatcggttcgggttttgattcgtagtagtttcgttcggcgttcgtaagcgttttttattttgttttagtgtttcggttagggtatttttagcgcgacgttagtttcgtttttttcggattatgtaaatgagtcggcgggaggtttaatgagcgggtaggacgt

SEQ ID NO: 11440 - DNA, 2184 bp, synthetic construct
  misc_feature 1..2184: note = Description of Artificial Sequence: Synthetic polynucleotide
  source 1..2184: mol_type = other DNA
cgttacgacggggattttattacgttgttttttatttacgttattcgtttaatttacgcggagggttttgagggttttattacgtagttttgaaggggtagagttggggttatataggtatcggaagtttacgttgtggttttaggagaaggttttggatgtggtttttatgagtgaagggtggatttatagcgttgtcggaataaagggaaattataggtaggagggaagcgcgtttaggattcgcggttatcggttttttagattgttttttggggttaggtcgcgaggagatggaaagcgggggtattataggttcgtttgaattcgcgcgtttattcggttatatcgattttaaatttttgtatgcgggtaggatttttggtttttttgcgtttattttagttttgttggtcgtcggggtatttgagggatggttgcggggggtcggagggtggaaggggcgtcgggtagtttcggtggggaggggaagaggtttttcgtgtattatggattttcgtattcgggaagggaggcgttcggggttggggagggaggaaaaggcggttgtgttcggggagggggtagcgagatttcgttcgggttacgggttgtaggatggagcggacgggaggaaggagttttgacgtcgcggattttacgtttgtcggtcgttttttttttttttgttttttttttttttttttttttcgtagaggtagcgcggggattcggtcggggtggggttagggcggtgcgtttcggagtttttaatttggattttatttcggaggcgtcgcgatcgcgttttcgtcgtttttaggaaggtgttcggatcgcgtcggcgatcggaggattttgcgtttcgtcgttttttattttgtttcgtttcgcgtttgtcggcgatttcgcggggtcggttttcgtttttatttgtagttcggggcgcggcgtttttgagggaagcggggttttgggatttttcggtttgggcgtgggatattttacggttcgtacgaattttggtggttcgggtttttgtttttttagaatagcgtttaggtttcggagaaatttttcgaagtcgtgggtttagacgttttcgggggatttcggtgggacgggtagggcgggcgtcgcgggcgaggggacgcgtattgttttcgggcgaattagaaatattttatatcgggtatttttttaggaatcgtttatttatttttattgttttttattaggttttattttattattttttttttaggtatttttttcgttgtatcgtttttacgcgggtatcgtttttattcgggtatttcggttttgttttgttttggggtggtcgtagttcgcggggaggaagcgcggcgaggcgtttatatcgggaaagtgttttcgtgattttgcgaggttatatttcgggtgcgtcgttgcgggttcgtgggttcgtgggttgtagtttttcgtttttgtcgggtggacgagtttcgggttcgcgtggagttgttcggttaaggtcggttcgggaggggcgcggcgtagggcgggtaggggcggggttttaggttaacgtttagttttagatttagtttcgtcgtcggatttatcgtgtttttgtttttttatttttgagaaatcggaacgtcggcggtattttttttttcgggtcggagtttgcgtttttcggattgcgcgtttttgtttaggcggcggtcgggggtgggagcgcgtagcgggttaatttttttaaagggaattgtcgggagggcgtttagaagggaaagattaggaagcgttgggtgttgagttggagtttggtttttttttgggggatcggggagggggttgaaggtggggagaagatcgtcggggttgttaggggggtattgagggagcgtttagggggagaattttgggtgggcgacgtcgtaggggagttgtttggtaggggcgagggtttcggggaagtggagtttttggtcgagagttgtatttgtggtcggggagggaaagggttataagggtagtgcgcgtcgggagggaagtttaggtcggggggaagggattgcgcggcggggataggtgcgtcgggtgttggatagtgagtaggagttcgtcggtgtttaggttacgaaggtgttggagtcgggggagttggaacgtaagggggttaagggaacgcgt

SEQ ID NO: 11441 - DNA, 413 bp, synthetic construct
  misc_feature 1..413: note = Description of Artificial Sequence: Synthetic polynucleotide
  source 1..413: mol_type = other DNA
cggtttgacggcggggtcgagtaggggaagtggaaggatggagggagaaagggagagagttttagtcgtttcggttgtggtaggaggagttttaagagcgtttttcgagttcgtttcgtatttttaggtttagttcggcgtaggttttttttttcgttttttttattttcgttagttgttgaaatttttttatcgttttttcgcgggtaatagtgttcgttaggcgtcgtcgcgcggtgtttcgttttttacgtcgttcgttcggaaagagttcgtagtggttcggggcgtcgcgttttgatcgacgtttttggggtttgggagggcggcgttgagagttgggagaggcgttgagtttttcggtttttacgggacgtcgggaaaggagagcgagcgtaatttttacgtttcgg

SEQ ID NO: 11442 - DNA, 403 bp, synthetic construct
  misc_feature 1..403: note = Description of Artificial Sequence: Synthetic polynucleotide
  source 1..403: mol_type = other DNA
cggttcgcgtcgtcgtgttttttattcggttatatagcgattttaaaagtttagtttttatttcgcggagatttcgatagttttgggaggttttttttaaaagggaatttggagaaatttgttgttgagtacgattgagttttattttataaaatatttattatttcgtcgttattttttaagtttacgtttttaaatatgcgaattttaaggtttagttcgggagtaagttaattttaggattcggtttatcggcgcgtgttttgaaaagaatgtcggaggttagatttttttttatcgtttagaggtttcggtttagcgtatatatttggggttcgtagggttttcgcgcgtcggaattcgatttgcgttggattttttttcgggcgtaggagttaagcga

SEQ ID NO: 11443 - DNA, 675 bp, synthetic construct
  misc_feature 1..675: note = Description of Artificial Sequence: Synthetic polynucleotide
  source 1..675: mol_type = other DNA
cgttttatcgtattttagtggagtgtcgcgaagttgtaattcggttttaaggcggttcgtatttttattcgtatataaaggtaggtcgtagtttcgtacgcggggatagggttagtaaggggcggggattttcggggtcgtcgttttcgtagtttcgcgtgtgggattttggggcgggtcgttattttgtggtgcggtcgtcgtttgttaggagatatttagtaatttcgtagcggttattttttataagaaattttcgttgtaatcgttgcgttatattatcgcgttttttagggataggaaagttttttcgtgtttggtgaagttttaggggaagtagttattttgtcgtcgtatacggtaaaattttttattgtcgtagtcgttcggttgacgtgataagggaggtgtaggttaatacggcgatttcgcgttttttggcggtagtgtcggagtagcggcgttgtttttgatttattcggtattcggttttcgggatcgtttggcggttgtgaatgtagagttggggcgacgtggggttcgttttttgggattgggtgtgagtttgcgtagtgagttatatgggggttatggtttggcgtgggggcgtggtcgggtggggtcgttggatttggtgttggaaagttagggaagtagtcgtgcgtttaagaacgg

SEQ ID NO: 11444 - DNA, 580 bp, synthetic construct
  misc_feature 1..580: note = Description of Artificial Sequence: Synthetic polynucleotide
  source 1..580: mol_type = other DNA
cgaagagttcggttaataaagtaaacgtttcgttttcggttttttttttttttgtaggggaaacgaattgaacgtttgaaacgaaggtggcgcggtttggataaatttgatttttcgatatttttcgtttttgcgttcgttttcgttaagcggggaggagcgatcgttataatggattttttcgtaggttttgtgcgcgttgggaatttagttgtcgtcgtttcgtagagttttttgttttcggagggcgtttattttcgggtcgtttattattcgcgtagtatcggtagtcgttgtttcggtagtttttagtcgtttcgttcgtttgtggttaattggttttagttatttttcgaaatgttagtcgattttattgggtattggaagatgttggttaacgagaatttcgaggagtatttgcgcgttttcggtaagcgttgttcgttgcgttttgggcgtttcgtcgagtagtttcgggtcgttttttagagttttttcgagacgttgtttgtttgtttttatttcggcgagtcgcggttcggtgttttcggacgttagaaagggcgttttcggttatcgt

SEQ ID NO: 11445 - DNA, 858 bp, synthetic construct
  misc_feature 1..858: note = Description of Artificial Sequence: Synthetic polynucleotide
  source 1..858: mol_type = other DNA
cgggaatatcgttttttcgttagattttcggcggtttttttttttttttttaaatttatttttaaagttaagtgtaggttttttcgttttagttagaagcgttgcgtgagtttttatacgtagtcgtaggtagttttttaaatagcgttcgcgttgagtaaatagtttagacgtggggtttaggagggcgagttgaggcgatcgtatcgggcgcgtagcggcggcgggttagtcggcggttaatagttagggcgcggttcgtttcgtcgttttttttcggggagtttataaggttttcgtagcgtttcgggcgtttgttgtttcgtgtttttatcgacgattttatttagttgcgttacgcgtcgtttcggttgtcggtcgcgcgttttgttcgtcggttttcgttcgtaatcggcggtttagggcggattcgggtttttgcgttttcgcgagaagcgcggcgttgcggggtcgtgggcgtttgagttcgcgcggttttcgagggtcgaatatggggggatgtacggtgaagttttagttgttgtttttggcgttcgttttttatttttggaatttttgtttgggtgcggattcggagaagttttcgagtatttttataggtgagtatttcgcggttcgtcgttgtttcgcgaggttcggtcggcgggggggtagtttatttatttattagttttttcgcggggttggttaggtgagtagtgggggtttgttttttttttttaggatcgtcggggttttttttagaattgcggtcgggcggcgttggtttttggggaagtgtaggggtattcgttttcgttgattttttggagttttcggtgaatttagcgtgttcga

SEQ ID NO: 11446 - DNA, 5715 bp, synthetic construct
  misc_feature 1..5715: note = Description of Artificial Sequence: Synthetic polynucleotide
  source 1..5715: mol_type = other DNA
cgttcgtatcgcgtatataggtagtggacgttcgtttatttgttcgtttgttgggcgtagggcgtttttggggtggggagggcgtttttgtggggggaaaaggggcgtttttgtttcggagggggaaaggacgtttttgtggaaggaagggggggtttttgaagcggtgtggtgagaggacgttttcgaggaaggaagggggtgtttttgtagcggtggggggagaggacgtttttgcggaaggaaggcggcgtttttgcgggggttggagagacgttcgcgcggtttttcggtttagggatcgttggttcgcgggttcgtttttttttcggcgttatggaaatcgtatttttttcgtttgtcgttttcgattttttttttttattattttttaaacgcgattttaatttttcgataagttgataagtgaatggcgtagaggacgtttcgtaaagcgttcgcgagcgggtgggatataggcgtttttttcgcgtttttttgttttttacggaagggcgcgcgtcgttttcgatttggagcgcggtgttcgcgaattcgcggtcgcgggttttggaattttttcgcgtttcgcggttgcggggggacggagatgcggtcgggagacggggacgggaaacgggggacggggatggggcgcgtttatttcgagcgcgggagcggtcgttttcgtttaaaatggggatttcgcgtttcgagagtacggttcggttcgtcgtttatgtttttattgtaaggtcgtagttttcgtcgtcgatttcgatttttcgtttcgtttagtcgcggtttcgttcggcgtttttttttcggtggaagtttaagtttaattaattgagttcgaggcgggagggaagggttttgcgcgtcgtggttcgtttcgtttttttttcgcgttttttttttcgttttgggtggtatttttttcgtcggtatttataataagtcgttgattaatgaggtcggggtcgttttatttcgttcggtcgggtcggggttttcgcgggagggggaggggacggcgggaaacgcggttcggggagaaaggggggcggggcgggggcgcgcggttcgttttcgcgagcgtcgcgtcgattggtcgagcgcgtcgttcgtcggggggcgcggcgttaatgcgaggtagcggggcggggcggtcgcgttgtgtgtgtttgcgtaacgtcgagttatatgttgttttgttttttttagtttagttattcggtgcgcgatgtgttatttattgtgcggcggggatcgcgacgagttcgggtcgtcgttggtagtagtagtagtaatattagtagtagtagtagtttcggcggcggcgcggatttcgagcgttcgggcgtatttcggtttttcggagcgcgacgcggcggtagtagtttcggtgcggtcgcgcgcgttttaggttcggtttcgcggttcggggatttcgattttcggtttagcgagcgcgtttttcggcgtcgttcgagagttcgaggaggtagcggtcgtaggtagtcggggaggggggcggttatcgttcgcgtcgggtatttttaggagttttagagcgcggagggcgcggcgtcgtcgagcggtgttggttttcgcgggttttttcggattttttttatcgtttgggttcgagggacgcgtgatcgggcgggcggtcgggcgtaagggtgggagggagtcgttttcgttcgcgtttttttcgtttttcgttttaatttttgggcgtcgggttcgggtcgcgcggtttgaagcgttcgcgatggcgagttcgtcgcggtacgggtcgttcgggtcggcgagcggagacggttttaattttaataataataataataataataattatagcgtgcgtaagtgcggttatttgcgtaagtagaagtatggttataagcgttttttcgtgttgcgcggattcggcgcgggcggcgacgaggcgacggcgggcggggggtcggcgtcgtaatcgtcgcggttcgagtattacgagagcgagaaaaagtggcggagtaaggtaggcgcgtcgaaacgggtgatcgttttcgattgttgtttgaatattaataagcgcgtcgacgttaagtataagtatttgatcgttttttatattaaggacgagtatttcgtcgtggtcgtcgagaacgagtaggagtaggagggttggtatcgcgcgtttatcgatttggttagcgagggtcgcgcggtcgtcggagacgcgtttttcgtcgtcgcgttcgtcgcgttttgtagcgtttttttgttcggcgttttgggcggttttgtcggcgtcgtcggggtcgaggatagttacgggttggtggttttcgttacggtcgtttatcgtgaggtgtggtaggtgaatttgaagtttaagggtttgggttagagtaagaatttgacgggggtgtatcgtttgtgtttgtttgcgcgtattatcggtttcgtgaagtttaattgcgagtagtcgtcggtgacgttgtagtttatgaatattcgtcgttgcggttattcggatagttttttttttatcgaggtgggtcgttcggtcgttataggtttcggcgagttgtggatgtaggcggacgattcggtggtggcgtagaatatttacgagattattttggaggttatgaaggcgtttaaggagtttttcgagtttcggtcgcgtagtaagagttaatcgtcggggtcgtcggttacgtattttattagcgttttcggcgcgcgtcgttattattatttggttaatttgttttttagttagacgggtttggtgcgtcgttcgcgtatcgatagtttggtcgttatttcgtcggcggttaagtgtagttcgtgtcgggtgcgtatcgttagcgagggcgacggcggcgcggcggcgggagcggcggtcgcgggcgttaggtcggtgtcggtggttgggagttttttgagtttcgggtcggtgcgcgcgtttttgagtcgttcgtatattttgagcggcggttgcggcggtcgcgggagtaaggtggcgttgttgtcggtagggggcgcgttgtaatatagtcgttttatgtttatgttcgtggcgtattcgtcgttcgtcgttattagtttcggttttttgtcgtttagtagcggttacggttcgggtttttattcgtcgtcgttcggttcgtattcgtttttgtcgtattcgttgtattacggtttcggttagcggttttttagcggtagcgttttcgtttcgggtttttttagcgatttcggttttatgtttttggacgagtacggttttagtttaggcgatttgcgcgttttttgtagttatcgaagtaatacgttcgagtttatcgcggagacgttttcggttcgagacggcggcggcggcggtgagttttacgggtatatgattatggataggtttttgagttattgtggtcgtttttatcgtcgggtttcgggggacgcggtttaggatttggatcgagggttgcgtaagaggatttattttttgattacgttagttcggtagcggtcggtgttttagtttttttttgtttcgttggatgaatatattttgatgcgggttattttttcgggtagcgcgggtcgtttttgttcgttttgtttcgcgtttttttttaaggtggtttattatttttatttagaggattacggagatatcgagatcggtttttataggagttttagtagtaatttgggggtagacgacggttatatgtttatgacgttcggcgcggttttcgcgggtagtgggagcggtagttgtaggagcgacgattatatgtttatgagtttcgttagcgtgttcgtttttaagtagattttgtagtttagggtcgtcgtcgtcgtcgtcgtcgtcgtgttttttgcggggtttgcggggttagtatttatttttgcggcgggtaggatattttcggcgagcgggggcggttataaggttagttcgttcgtcgagagttttttcgaggatagtgggtatatgcgtatgtggtgcggttttaagttgtttatggagtatgtagatggtaagttgttgtttaacggggattattttaacgtgttttttagcgacgcggttattacgggtatttcgttcgatttttttttcgtagttttgtatttcggcggggagtcgtttaggggcgttttcggttgttgttatagttttttgtttcgtttttataaggttttttatatttgtggcggggatagcgattagtacgtgtttatgagttttttcgtggggcgtattttggaggaggagcgtttggagttttaggttacgttagggtttagttaggcggttagcgttttcggggtcggttttacgtagtttttttattttgtagtgttttcgttcgtgcggtttagcggcggtcgttcggagggttttttgggttagcgcggtcgggcggtgaggtttacgcgtttgtttttggaggggttgtttagtttgtttagtatgtacgagtatttattgttatcggagtttaagagtttcggcgagtatattaatatcgattttggcgagttcggggttcgtttgtcgtcgttcgcgttttttttgttggcgtcggcggtttcgtttttttcgtttttgttcgttagtagttcggtttcgtcgttgggtttaggtatttcgggtattagtagcgatagtcggtagcggttttcgtttttcgattatatgaatttcgattttagtttttttaagttttttaagtcgggcgtttcgagcggttatttcgtgggttttttggacggttttttgtttttcgaggtttttttttcgtattcgtcgttgttttcgcgttcgttcgcgttttcgtcgtcgtttttgtagtcgtcgttatcgtcgtcggtttcgggggagttgtatcgtttgtttttcgtttcggtcgttgttatcgtttagggttcgggcgtcgttttatcgttgttttcggatatcggggataatggtgattatatcgagatggtttttggtgtggtcgttatttcgtcgtaatttatcgcggttttttcgaagttagaagttgttcgcgtggttagttcgacgtcgggcgtgaagaggttgagttttatggagtaggtgtcgggagtcgaggtttttttgtaggttagttagttttcggatttttatcgcggcgttaaggttattcgcgtagattcgtaggggggtcgtcgtcgttatagtttcgagatttttttttttattacgacggttattttcgtgttttcgtttttcgtttataattttaagcgttataattcggttttcgtggaaaatgttttttttaggaaaagtagcgagggcggcgtgggtgtcggttttggagggggcgacgagtcgtttatttttttacgatagttgtagtcggcgttttttttggtatcgtagggtcggtcgtggatttcgggttagttcgggggtttggtcggttgttttgggagcggtggatcgtttatgcgtagagagatttttgtcggtttttagaatggttttaattatatcgttatcgacgtgagggaggagttcgggttgttattttagtcgtagtcgtcgtcgtcgtcgtttttttagtcgggagataagagtttttggggtcggattcgaagtttcgggggttttattagcgttgtgggcgtcggtagtatcggcggcgggtgcggggggtcgggtttcgg

SEQ ID NO: 11447 - DNA, 858 bp, synthetic construct; identical to SEQ ID NO: 11445
  misc_feature 1..858: note = Description of Artificial Sequence: Synthetic polynucleotide
  source 1..858: mol_type = other DNA

SEQ ID NO: 11448 - DNA, 247 bp, synthetic construct
  misc_feature 1..247: note = Description of Artificial Sequence: Synthetic polynucleotide
  source 1..247: mol_type = other DNA
cgggtattgtttgtcgttagtataacgaagaaatttatatttacgaagattttagattttacgtgattatattatttaattattagcgttggtttggaggaattcgttgttacgtgatcgttcgtgtttaatgatcgaggtttacgttttttagatcgttatagtcgttgttatagggtttgagtttgggcggcgtttcgtttcggtcgtacggtgcgtcggcgttaatttttttcgaaggtttcgg

SEQ ID NO: 11449 - DNA, 224 bp, synthetic construct
  misc_feature 1..224: note = Description of Artificial Sequence: Synthetic polynucleotide
  source 1..224: mol_type = other DNA
cgtcgttaagaaggaggaggagcggtaggaggcgttgcgttaggcggaggaggagcgtaaggttaagtacgttaagatggaggcggagcgcgaggtcgtgcgttagggtattcgagataaggtgcgcgtcgggtcggtttcgtttgcgggaaggcggttttgagtttagcggggatttagatttcgtttgggtggaaggggttgttcggaagaggggcgggcgt

SEQ ID NO: 11450 - DNA, 1174 bp, synthetic construct
  misc_feature 1..1174: note = Description of Artificial Sequence: Synthetic polynucleotide
  source 1..1174: mol_type = other DNA
cgatgtggcggggtttgggaaatgcgttcgttggagtatatcgtagtttcgcgggttttcgagcggcgcgcgcgggtcgaggatttttagggtttttcgcgggtttttcgagcgtcgtcgtatcgtttttgttcgcgttcgggatcgtttcgtgggtttttttgttagggtcgtttgcgtcgagaggtagtttaggttttgtcggggacgtacgggttttatttttgattttttagtcggagttttttgaggatttgtaagtatataggttggagtcgagaggttaaattaggttttaggggatttttttaataaaattttaaattttatttaggttgttcgtaggttaagcgattgtaaggattttgagtcgaagtagcggtgtcgggtcgattcgaggttcgttttttatcgtttttttttcgggtcggttttgtgtagttggggttttggaattcggtttttttcgggttgtcggttttggggtttggtgttcgttatttttttttttcggaggtcgttattgtttttttattttatttttagttttttcgtttttttttacgtttttttttcgcgtttttttttatttgaattttttttttttttcggttggaagaaaagtcggtaatgagaaattagtttagtgttagtcggaggaggggggtagataattttagagatatacggtaatggagagagaatttattttgtgtaaagagggtttcgagttattagggaatttttggattgttttaggttgtcgtgtgtgatgtttattacgtcgtgcgaatattatttgttcggtattgtgtttttagttgttaggttatttgttgtacgtagtaatatttgattgtttggttttacgttcgtagcgttcgtttagacgcgcggggcgggggtcgcggaggggcgggcgggagttttgattaagttatttgcgaggggagggggcgcgggcgtagcggcggtcgggtacgaggtcgggttgatattattatttgttggggcgcgggaagaacggtagttgttttgcgttgtttcggcgagggacgtttggaaaaggttgaagttttgggcgtttttaagttcgttatttacggggttttcgttattttagtttgttcgtcgtcggtcgttttttgtgattttttgttttttggttcgtcgt

SEQ ID NO: 11451 - DNA, 8657 bp, synthetic construct
  misc_feature 1..8657: note = Description of Artificial Sequence: Synthetic polynucleotide
  source 1..8657: mol_type = other DNA
cgagacgcgtcgattttttcgggaagcgcgagcgcgcgcgtgtttgcgtttttgtgcggatttgggtttgtcgtgcgcgtgtgtgtaaaggtgaaacggcggcggagttttaaatattttattttcgaattattttttgttgaggaattaaggttgttaggtcgttgttgattttgaagagggttttttttaattgcgatttttttaaggaattcggttttgtttatttttaaggaatgttttttttttttattttttagacgttgtaggtttttcgcgttgcgtttttttttaggttggagtcgtagttggcgggacgcgtcgtttttacggtatgtcgggtgagagtcgtttacgagcggtttagcgtggcggatttcggttttgagtcgcgcggacgtttggttacgaggggttttcgattcgggcggggagaggtgcgatttggggggagggggcggggcgcgtaggaaggaggaggagagagaaaagggcgaagttagcgcgagattaggaaggagaggagggtagagacggagtcggcgagatgttggagaatttaggattgtgggtattttgagcgggagagaaattttaggaagtacgtcggaggcggggtatttgtgggaggaaggtaaattttgtagagcgttaaaggatgtcgggagggataagttagttatggggagattttttagaaattcggagttgaaaatagggtagttaagtaagtaagagttggttagttgaatacgaggtttttagaatgtaaattataaataagaaagaaagaaacgaaagaaaaagaaaagagcgcgcgtagggtttcgggtttaggcgtttagagtagttcgtgcgggggttttttcggtttatagtagtcgtcgtttcgcgtttttgaagtggcgttcgcgtggttattcggggattttttaggtttcgggggtttatttgaaaatttcgagaggttttgtatattttgttaggattggagttgcggggattttttagttttttacggatgtttttttgtacgtgttttttaggaaaatatttaggtttcggaagcgtttttgagagtttagaaatgtcggttgagcgtgaaatttagtttaatttatttatagagtattagatttagaaacgacgtttgaaagagatgtgggttttatgttgatttaaattttgttttatttataataacgtttttgtttttaaagaaaagaaaaattttttagttaaattttttatgttttcggttttttgtttttgtttcgttttttttttcgataaacgcggggagttttggaacgggagggtcggtgatcgcgaatacggtagcgatgtgatttgatgtattgaaattatttatatttttaatgttattttattaaaggaaatttatataaaagcgtttgttttattttaattgttaaaaaagtttgttatattttcgaacggtaattgttttttcgttagatatcgaaagtttataaggaattataatgagaaaggattaggagtcgtttaggttttattgaaatgtttcgatgtcgtttttttttttttttcgaattaagtcgtcgggggaggaggtgggtcgcgtttatcgttgtcgggattcgggtcggtagatacgggttatagcgttttttcgtcgttcgcgcgtacgatttttggtttgcgtcgttttttttcgttttcgcgatacggaggacggcgtcgcgttcggcgagcgtttcggtttttttagtcggtcgcgttttcggggagatttcgagttcgagttttcggggtcggttgtttttcgcgttcggtttcgtaggaaattttcgttcgttgaaatttgcgtgtttacgtagattcgttttaaattttttggttgttgtagggataataaagaaaaatagaaatagtgttaattttttttttattttttagggtatatttaggaaagggggtagggtttattaggaatttgaaattgtttttatcgtttgggttattgtgattaggggtcgcgtttgtaaagtagttattgggttttttttgcgtgtttgtttatttttttttttttgttcggacggtaattgaaaagttttagaagttaagtgtcgggttttttttagcgattttataggtttgagtatttcgtttcgtttttgagtaaaatattttaggttttttttttcgggagtcgcggttttgtagttttcgtggtttcgagacggagtttgggttgagttcgttatttttttaggtagtttcgtcgggatcgtcgcgttaagattttacgttggtagtatgtttttttatgattgattttttttttttttaagaagaagattaagttaattttaatttaagaagaaggaatgtgatttttttttttaatattagagagttttaaagtaaaacgtagtttatatattttaataataatgacgagtgttaagtttttaatgtttttgcgtaggtattttaatttgttatagttattattaataaaaacggtatgtagtaagagtcgattgtttaatagtgtaaggtagacggtttttattagtaataggtagtagcggtatggaatatatagattttagtggaggagtataattgttaaggggaaaatatatataggacgggaagaggttatttttaaatttttaatattgagttaaagagggggaagggtaggcggcgtttttggagatgtattttgggtgaggggatttttttcgttattgtacgtgtttggttatatatttaattgatgttagaatcgattgtatttagagtagatattttagttttaaattgaggatgtttgtataataattggttgtttttttttttgtttttggtagaggttcggcggggggaggggggtgggttaagggagggggagggaggatgagttttaaatgttaatgaaattatagcgggaatcgttttttagaaatggaaatattttaggttagtgttttttggtgataaaaattatattcgattttttttttatttaaattgatttgatcgtaaaggaattttaaaggttgttatttgatttgatagtgtttgtgtttgttatttagcgtgtgggttttttatttatttttttttttggaggaatttttttttaggaagcgtaaaaatgtcgtagattgtcgacggtttgtttaattcggttgttttttttttttttttgttttttagttttatagtaattgattaaaaatatttgttttggattgaattaggatgttttatgtggagtcgtaataaggttgaaatttttcgttgggtcgttgtagggggtttagtttgtgggaacggggtgtttgtgggtggagggagaggtggtcgtgggtgtgtgtgcgtgtgcgtgtgttgagatggtttgaagaggatgtgtgtaggatgggggtgtggtttgtaggaagagtggtgggggagtagtgtgggcgaaggggtgggtgggataattggtagggggcgagtggttcggttcgggagtttttggcgggaggggtaacgtgtttggatcgcgtttatcgggagtttgtcggtttaggaggagttatttttaagtatagtattgtagtttgtaattggtttttttgtatttggggaaagatagtttgatgtcgtgagtgttttttttgcgttttggattagattggtaattcgggtttcgtttttttcgcgtcgttgtagtcgtattatagggaggtcgtaatatgttttgcgttttgagattattaaggttgtttcgtaggttgtagggttagtaggggtgtaggagtcggttgtaggtttgagttgaggttcgttttaggttattgcgtttttttttttttatcgtatttattcgagacggttttcgaggatagaggtatttgttgggtgggtgtttttaataggttagtatagatttgatatttttttatttttttgagcgttttttataggtgatttttcggagtgggtagttagacgtttttttcggttattttcgagtggaaaagggttggagaagcgtgatggggagagggttttaggaagttggggttttaggaattttcgttaatcgtttcgtttttgagtttcgtaaggtaatcgtttttttattttagtcgcgcgttatttgagttatttgtaatgtttattgtatcggcggcgttaatttgagtttttgttcgttttcgacgtgattgggaggttttaggttttgttagaggcggtttgttaggtaataattatttttttagtgttttgataatataaatttgaaagaggagttaatttagaaaaataaaataaaataaaattttttaggggacggcgtttttttagttgaagttttggcgttatttttaatagtggaaagtcgtaacgtttagggtttcgggggttgcgttgcggatttgggggtagaaagtttattttagggtttttttggtaattcgtaattaaggcgtttcggatttaggtttatgttgggcggagtggatcgcgaggggtaggcgattagacgcgaggttacgcggggagtttcgggttaggaggtagagtaggttcgggatcgtggaagtgagagtcgcgcgtattgttcggaggaagattcgagtcgcgggcgttattattttgatttttttatttttttgcgattttcggattggatataggggtcgggttttttcggggtgtatagcggggtaggttgtgagttttttaattggattcggtttggtttgatcgcgggcggtttttgtttagtttgtgagggtggagaagggggtgggggcggggtagtggttggaaggggcgggggtcgggtaggggcgaagacggtggtcggggacggtgggagtcggtcggagtcgggtaggggacgtggtttcgagtggatgggagtgggaggggtgcgcgtcggggtacgtagcgcggtcgggttgggttgtaggttcgcgagtcgcgggttggggtcggagttgttagagaggcggttgcgttataaaagtttgtcggtttttttcgtcgttcgttttcgtcgttttcgttttttttcgtttttttttcgtttttttgttttttttttggtcgcggttcggaggttgtagcgggcggagtaggggaggggcgggttttcgaatatgtagatgagcgcgtgatggatagttgcgcgttttaatgtttttcggaaattcgagcgttttttttttaattttttattttcgattttagatttttttaaatttcgatcgtcggtttggcgcgcggttgcgtttatcggtttcgcgttgttgtcgtcgttatcgttatttcgtcgtcgtttcggttcgcgggtcgtttaggttagtattcgggtcggtttgttttcgtcggtcgttcgggtgttcgtcgtcgcgtcgcgtttcggtcgggcgtggatggagggcgtcgcgcgttttgttcgttgttcggcgtgacgcgggtttcgcgtttcgcgtttattatgttttattcgtagggttatttgtattaggcgttcggttcgttggcgttttattcgtgttcggtttacggcgcgtcggttttggcggtttcgcgtagcgaggagttggcgcgttcggcgtcgggttcggcgtttagtttttattcgggttcggcggtttttacggcgtaggcggttatcggtttcgggagttcgttgtagtattcggtcgacgtcgtcgtcgtcgtcgtcggtttttcgttttatatggtaatcgggcgcgggcgggacgcgggatttttgggcgtcgggatttagacggggtttaggcggagcggggttcgggttcggcgggcgggggtcgtcgggaatgtggcgcggttggcgatttaggagtcgtcggttcggttggtcgtttcgtaggttgagtcgggtttcgggtggggagggtagcgcggtaggcggggacgtttttgagttcggtcgggattcgcgcgtttttcgcgcgttttttcggttcgtcggttgattttttttgagagtttgggaagtgcgttttcgtcggggtcggggtttggcgtcgtttgtttttggttttcgtatcgtagtttggggaggcgttcggagcgggttgtgtgttcgtttgtattggcgtggggcgcgagggttcgcgttattgcggtttttgagtcgacggtcgggcggttcgtatttattcgcggggtttagggcggtgggggttatcgagttaggtttaggagtcgagtatttagttgcggtttcggagttcggttcgaggcgtttaggtttcggttttattttgtttagcggattatgtttttaaatatcgtgtttgcgggcgcgtgattcgttaagggtcgtttgagtttttcgtggttcgagcgtagtttttgtttcggcgatttgggggcggttcgcgagtttcgaggttattgagttgggttaggttcgggtcgcggcgaagtacgttacgggcgattgaggttattacggggttgtcgcgattgtcggttttcggcggaatttttgggtagcgatcgagtcgttggggttttggcgaaggttgtaaatgtttcgaatttaaacgttaaaggatgaattaaaatgttaattacggcgtatttgaagaattcgaaacggtgattggtttttgagttgtaaattggatttgtttagttttagagtagtgaatagtgaattgggggttttggggtgtttttttaattatataagggaggggaagagggagtagggggaggtagtcgtattttaagtatttgtagaaatttagatattaaagagttatttgtgggtttgtgtgcgcgtacgtgtaagggtttgtgtatattgttacgagcggtttcggaatatttaggggaagatgggttattttaggaaagtgaaatagtttagaaattcgagaataaaatttcggtattttttgtgattaatagttggtttcgaattatattgcgttttttttgtttttttgcggcgggaagcgtagttttagagttagatttacggggggaacggtggtcgtgggcgggcggaggggtggtattttttggttggttgttcgcggggttttcgtatattttatttataggtttttgttggttttagggcgtattttacgacgcgtatattatcggtatgatcggcgttattagttattattcgtacggtagcgcggtttattcgtattagtttaacgatttcgcgtatcgtaagaacgttacgcgggacgttacggttatttttaaggtttggtttaacgagtatcgtaagaatttttattttattaagggcgagaagattatgttagttattattattaagatgatttttatttaggtttttatttggttcgttaacgcgcgtcggcgttttaagaaggagaataagatgatttgggtttcgagaaataaaagcgaagatgaggacgaggacgagggcgacgttattagaagtaaggacgagagtttcgataaggcgtaggagggtacggagatttcggtagaggacgaaggtgagcgggtagcggtcggcgtaaggtttcggggcgttttttttttaggcggggcgtagagttaaggcggggaggacgttgttcgtcggatattttaggttcgggtcggagttttagtcgtattatattgttttggggtcgtcgggatttgagcgagcgatttttcgggtttttttcggggaggttaggtttcgtttgttacgtggtcgggtgggggcgaggtgaggggtttcgtggggagggtttagtgtcgtaggatagggggcggagggggttttaggtgtttgcgttgttttttcgtgttatttatcgtgttcgcgtttttatagggattagtttgtacgtggattcgtttacggattattcgtgttcggtcgagtcggacggggagaagttttcgtgtcgcgtcggggattttttgtgcgaatcgggttcggagtgtaaggataagtatgacgatttggaggacgacgaggacgacgacgaggagggcgagcggggtttggcgtcgtttaagttcgtgatttcgtcgtcgtttatcggtttggaggcgtcgttgttgagtttttcgttcgaggtcgcgtttcgcggtggtcgtaagacgttttagggtagtcggacgttttcgggcgcgtcgtttttcgttagtaagtttaagttgtggtcgttggtcgagatcgttacgtcggattttaagtagtcgagtttgggttcgggttgcgggttatcggggttgttcgcggtcgtcgcgtcggttttaatcggggtatcgttaggaggttcgttttattttgtttcgtcgttgttgggtcgttttttttattatacgtcgtttttttacggtaattatataaattacgggaatttgaacgcggcgttgtagggttagggttttttgcggtataattttgcggtcgcggttttcggcgaggttttgtatatcgcgttaaaggcggttagcgacgcgggtaaggcgggcgcgtattcgttcgagttttattatcggttttcgggcggcggttacgagtttaagaaaggtaggcggttcgcggtcggcggcgttcgggaggggagggagagttagtttcggggaggcggagcgttcgggagattcgagggagggttcgg

SEQ ID NO: 11452 - DNA, 1059 bp, synthetic construct
  misc_feature 1..1059: note = Description of Artificial Sequence: Synthetic polynucleotide
  source 1..1059: mol_type = other DNA
cggatcgtttttttttattttatttttcgggtttttattgtcgcggttttgttttattatttttagttgaggggtagttcggagttttatggttttttttttagagcggtcgttttttcgggtttttttagagttttcgaagagtcgcgtgaggaaacggggatttgttcggggtagtagatttttagcggtgaagacgtagagtatcgggttgacgttagaattgaagaaggttaaggtcgtagttttcgttcgcgtcgtttggtcggtttcgtttagtttcgttaaggtttttttcggtggagttagcgttgcgatcgtttgtagaaggttgattgcgtggtagggggtttagagtaagtcgaaggtaagtacgatggcgtttattagtcggtttattcgcgtttcgtgtcgttcggagttttagcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgtcgttagtagtaggaaggttgtgtttgtggttcgcgaagttttttagtttagtagtgtttcgttttttgggggacggtagtagatcga

SEQ ID NO: 11453 - DNA, 1663 bp, synthetic construct
  misc_feature 1..1663: note = Description of Artificial Sequence: Synthetic polynucleotide
  source 1..1663: mol_type = other DNA
cgtaacggggcgggggtagacgtttttagttttagaatttcgtcgggtttatcgtttagtgtggacgatcggcgtttttacgagatttatcgagggtatatagtttttattttagttcgttttattcgatttagacgatcgttagcgcggttagcggttagcgtatagcgagttgtttgggtaattgtggtcggattttagggagtaagttggtttcgggttttatttagttttattcggtttttatcggtttttttatttaggagttggaggatggtttcggggcgttttagggggattgttggttttcggagtttttagttagacgcgttttgttgtgtgagtcgcgtgcgcgtttaatttggaggtagtcgttttcgtcgttgataggtgttgtttagagggcgtcgggtgcggtttttggcgtagttggacgcgtacgtttcggtgcgtgtagtttttcgagttcggttagagagaagagggagttagggcgcggtttgggggacgttagtggattggagtcgcggagtttcgagggaaaaattttgtaggcgtcgcggtcgggattcggttacggttttagtttattttagtaggtgcgggaggaagaggtagcgtcggagtttcgaggttagagagtttcggcggcggcggtcgtttttttttttcgagttggtttgaagtcgttgggtattttcggtttttgttgttgcgttcgtcgtcgtcgtcgtcgttatcgttagcgtcgtggggattcgggaggaggtgtagtcgaagagggaggagaagtaggaggaggaggaggaggaggaggggagaggaggagtagggggtggaggatggagtttcgggttgtcgcggcgggcgagttagagtcgtcggcggcgtttttttttttttaggttcggttttggaagaatttgtagttgggggtgggtaggagtaagggcggcgggggcgggcgcgttgggggtttagagcgtcgtattgcggatatttcgtcgtttttttcgttattttcggtgggtatagggaatgtatcggttagggggagtggtgtaggtagtaggtggagcggttttaagaagcggaagtaagtgttggatcgagttttttttttttcgtagtttaatttgtgttgttcgtcgtcggagtttttggagttcggcggcgtcggtagagtcgagtaggggtttacgttacgtcgtcggattcgcgagtatttgtttttcgtcgtaaaggggttcgcggcggtttcgggagtagcgggagggacgttttttggcggacgttttttcgatttagttttttttttttttttcgttttattttttttgttttttttgttttagtttttttcgaggggggatcgcgttcgagatgagggtgtacggcgttagggtttcggggcgtatttgtgttattagaagagtttttttttgtcgggtatcgtttgtttggagtagttgttggagtcgtcgttttttttcgtagagtcggcgcggagtttcgcggagtttcgggtttcggagacgggcgaggagtacggtagtagttaggtgagtgtcggtggcgcggtcggagataaggtgcgcgggattacgtttttttttttaggcgtttattattcggggagcggggggcgggggtcgggaggcgg

SEQ ID NO: 11454 - DNA, 2065 bp, synthetic construct
  misc_feature 1..2065: note = Description of Artificial Sequence: Synthetic polynucleotide
  source 1..2065: mol_type = other DNA
cggagtaggtcgacgagagatttttgagaaggttggtagattatcgcggatttttgtttttttacgtggagttatgggcgaggcgtttaagaatttgttgaaggagttcgatttttttaagtttcgggttaggttttggagtatgaggtcgttagttaggacgtttagaaatgtattggtggtggaattgaggatggtggcggttatttgtacggggcgtttggtagtaagattgttatttttattatcggtcgtatttggtttcgtggtgtttcgtaggtttggatcgttaagaaggcggcgtagcgcgtacgaggagtcgggtcgtaggtattggtaggcgcgacgttcgttgtgattacgtacgtgtatttgggtatttagacgtattattagtagtacggtagcgttttcgtggtcgtgtagtgtagttaggtgtagcggcgtgtagtcgtcgtgggagcgtgcgtttacgtcgattggtgcgttattgcgtcgcgcgatttttattagttgtagcgttatttcgtcgtcgtcgtttttggcggtttaatgtagggtcgtgaagttagatatgaagtcgcgtttggtcgttaagtcgcggtcgcgtagtagtagttcgtgtagttggtgggtttagcggttttcggtagttcgtacgagttattcgtgttcggacggttttaggggtatcgcggacggcggcggcgcggcgggtaatttttcggcgttagggtttagtagacgcgggtcggcgcgcgataggcgttttaggtgcggggagcggttcgggtttaggtcgaggtttagatcggatttttttatcgagagtcgttttagtagtagaggggagtttcgcgggttcggttttttcgatagttgtcggcgtaggtcgggttttttcgttcggaggcggagcgtggcgggggtcgggacgtagcgtatcggtagtatatagggtttttgttgcggcggttttttcgttgtttcgggttcgggtttcgcgtttggcggattagagtagggcgatgtcgttttagaaggggttttaggcggtggggtcgcgtttgcggagggtttttcggtggtttgggttagtttaagggttggaagcggtgggtcggcggatcgtttttcgggcggttgagcgggttcggaggtcggttttttcggggtgttttgtggttttgttggtagatttaggttttttggcggttttattggtcgcggtattcggattaagggcggagttttcggggtagaggcgtttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttttgcgggcggcgcggtttcgcgggtcgtcggtatcgagtagcggtttgaagcggtttagtagttcggagttgcgtattttttcgtcgtgtttttgtaggaagtttagtatcgtcgtttggtttatttcggtagtcgtagcggcggcggcggcggttagcgttatggtggggttttgggtttttggttttcggggcgggtgggcgtcgcgtcgtcgcgggacgcgcgggagcggggtttcgggaggcgcggtcgcgtttatttggtgtttttttcgcggttagtcgggcgtgttttcgaagttggatttcggtcgcgttagtgtcgttgggtcggggcgtttcggggcgaagggcgtcgggggtcgcggggagcgtttatttttagcgtttcgtcgggtttcggttttcggggtaggtttttgtttttgtattttgtttaatgggcgtttgtttttatttttcgcgtcgcgttcgttttataggtgatagttgttttcgcgatgtagagggaatcggagtagaaattttcgtcgtttttcgttcgttttagaattaaaggcgtagcgttttagttttggtttcggttgttaggtgggtgtgttttttagggacgtcgcggttcgt

SEQ ID NO: 11455 - DNA, 3487 bp, synthetic construct
  misc_feature 1..3487: note = Description of Artificial Sequence: Synthetic polynucleotide
  source 1..3487: mol_type = other DNA
cgcgcgtttttagttcgtttttggaggtagttcgcgggatcgtaggttggaggcgcgtcggcgtgatttcgatcgtcggagtcgggaggaggagtcggaggaggttgcggggggtttcggtttaggcgaaggaagggtaagaggttgttcgatcgggggcggcgtcgggaggtgggtgggtttaatatttaggtcgggggaggggtttaagagatatcgggaagggtagtcgagttttaggggcgggtggggtggtagttgtgtgtagtaggggatagggttgggtttttggaagttagagtgaagtttttttggttgtttcgtaggtaattttattttttggtagaatagttgcgaatcgttaagttgatttttttcgttttttggtcgagaggagaggatgttttaggatttagggatgggcgggaagaaattatggggagttataagtttgtatttaggcggggaggaggcgggcgggcgtcgtttcgtaggcgtaggcgagtgggtgggaagaagggagggagagggaggaaggaggtgaggtcgggaagatgttattgtcgggggcggggcggggtcggggattcggtaaagggattgtagtagcgttaggtgggggcgggggttgtaatgttatttatttgagagttaggtgtgtgcgttttaaacggggttcgttataagtcggtatttttttggtattatttatggtgtagggttttaggtagagggttggggattgcggattcgtttttgaagcgggacgcgaatcggtagagttgggagaaggtaaataagggttacgttttttgtcgtcgtttcgcgggcgcgtattcgtcgtttcggtcgtcgtcggtatatttttatttttttagcgtttttttttagttggattatcgcgcggtttcggaggtggaggttgttttcgattttagtttttatttttggcgtcgaggtttcgtattttttatatttatttggaaagggtgtttttcgtttttttaaaaaaattgtttaatttgtgtagagtttttaattttaggagtcgagtatgttgttttcgcgtgtagcgttcgcgtgtatcgggtcgggagagggggcgatagggcggaggcggtggttttcggaaggtgtttgggatcggatcggttgtacgtgagtttagcgcgaggttatgtgtatcggtttagttcggttcggcgttcggacgtgttgcgtattaataaaatgaaattcggggagataggagggtagatagttttaggttttcggagttttcgttcgggtcgttcgatttttttatcgtatttatttttcgtcgtagtttttacgttcggtcggagttcgcggggaagttgtagttttggcgcgttttcgttcgttcgcgttttttcgtcggttcgggggcgttttgtcgtagttattaataaagaaggtcgttaagtttatttttttaaaagttgttgttgtatgcgttttttttagttttttcgtattgtattttttaaaatacgattgattaatatgcgtaattttttttttttgtgttgtgtatttttttttttttcgcgttggttttttagaataggtagttagtaggagagagagggagcgagcgagtaagagagagcgagggagcgaagagcgttggtagatttgttgtaaaaacgttaaataacgtcgtggagatgcgtagggtttattcgtcgggggttggattttattttgtttcgcggtgtttttttgacgggcgttgttttcggttacgcgtcgttgtagggatcggcgcgggaaggatgttttcgaagtcgggagtttttggggtcggcgcgggagggcggggggcgcgtatttattcggggtcgcggcgagggaggcggtcgggttcgcggcgttttaggttttacgtttttcgtcggggacggtcggttcgtaggatttaagtcggtgtcgttaggagtgggcgtaaagtaattttatggacgttatttattttttttaaaaaatagtttttaattgcgatggtcgcggtcggtattatttattaattttttgtgtatgtttttgtttttttttaaattaagatttttttgtgatttttttagaaaaaaaaaatgtgttggggtgggggtggggtgggggcgggtaggaggagcgagggagggggagtagttattttttttttatttattcggattttcgttttcgatattttcgtcgtcgtttttttaatttttcgtttagttgtttggtttcggcggggagtttaggtagcgttgcgggtttcgtgggggaagggtgttttttttcgtagttttattattacgtttgttggtattttgggttcggattttttatggattttggggcgtttttagttcgttttgtttttagggtcgggttcgagcggcggttgcgttcgtgtaagttttattaggtttgtttatattttatatatttatatatatatttcgtttttttatttttttatttatattttttgtttatatttcgttttttacgcgttttagattcgggcggcgtttttcgtaattttaaaaaaaaaaaaaagcgagtttatatttaaaaaaattttttggcgttatattaatgacgtatttaaaatttgttatttttttttgcgttaaaaagacgtttttttgtaaataatagtttggaggcgatattcgcggagggaacgaggtttgtattgagtatttcgtttttcggggttttagcgttggaagattttcgttttaggttttgtttttgaatcgttggttttaaaatgcgaatcgaataaattgcgtggcgttttgtagtattagaagtgagtagaaagtgttggtaggaggggagtggaggggcgaacgcgagttttggggagggggcgcggttttttttttcgtatttattttaaatggaaaattaatatttcgggcgggggaatttgaaattgtaggcgattttaagaaaagaggggcggttcgtagagagggtttttattgggttcgtcgtttttttttttttttcgggtgttttttggcgtttagcgttgtttcgtattttcggggggtggagaaggtagtgatgagcgggtgggtgggtggttgtatattttggttttagtaggattttgtttcggggcgatttttttttttttgttttttttttttattatttcgaaaggttaaaaatcgaggggtaatttttaaaggttggtatatggcgaggaagcggggcgtttttttttttatttttcgttttttcgttttttttttttcggttttatttttcgatttgattttgtggtgtataaatagtacgttcggattttcgtagtttttggaagaagagtttgcgttcgttaggcgggcgggttgtcgggttgttagtcggcggtggcggggttttgggtttgttttcggagtcgcgggttatatttatttaattcgttgcgttcgtcgagtttattttttttcga

SEQ ID NO: 11456 - DNA, 847 bp, synthetic construct
  misc_feature 1..847: note = Description of Artificial Sequence: Synthetic polynucleotide
  source 1..847: mol_type = other DNA
cggtcgttttagtaaagtttttaatttagtcgatatgacgcgcggcgtagttaatgggaggcggagttggcgttttttggtcgggggggggtcggaggggtgggtttcgcgttttcggtgtttgtcgtgtttattgaatggagagagcgagcgtcggttagtttattcggtcgtttcgtgttttagtcgtagtcgtcgcgttttttagtttagttttaagtcggattttttcgggcgttacgttttattgcgttcgttttaggtttttaattcggttcgcgggttagcggggttagggggcgtttcgtatttgggtatttttagcgatgcgtagcggggtagcgtcggtttcgtcgatggagttgttgttgttgtcgtcgtcgtcgttcggagcgtttcgtttcgttcgcgtttcgtgcgtttgagtatcgagttcgtttttttttcgcgttaatttcgtcgttcgttttttaggtcgttcgcgtttttcgcgcgttttttcgggttttacgcgttttgtttcgtagaggtagttttttttaggagcggggttttgtatattatggttttcgggtgggtaggggtcggcgtcgtcgtgcgcgttcgtttggcgttggttttggcgttggcgagcgttttgagtgggtttttagtcgtcgtttgttttattaagtgtatttgtttcgttgttagcgtggattgttacgggttgggttttcgcgcggtttttcggggtatttttcgtaacgttgagcgtttgtgagtatttttgttttattttacgcgggttatttatttgggttttatcgagggggttttaggcgttagattcgtttttttttttcgg

SEQ ID NO: 11457 - DNA, 909 bp, synthetic construct
  misc_feature 1..909: note = Description of Artificial Sequence: Synthetic polynucleotide
  source 1..909: mol_type = other DNA
cgggacgggggcgagattttgggtttttaggggtattgaggggtcgtttatgtcgggggatatggttatttgggggcggttttcgttaatcgcggagtggggaaaaggggggagggatggaggacgaacgttcggcggtgtttaaaggtacgacgcggagtaggaattatagttttggtttttagaaagcgcgcgcggttcggggtagaatttgtcgaagttttagttcggggcgtaagggatgtgggggttattggaagacggggcgcgggtcgttcgtggggaggagattggattcgaattcggtttattttattcgagcggcgacgttagcgttgattttaggcgtgtttcggttttcggcgcggtttcggtttaatcgtgtacgttcgcggaaggtttcgtattcgcgttagaagtggtttgttcggggttatcggttcgtaagttttcggtgttttcgaggtttttgtttcgtttcgcgcggttgtagtcggcgggaggggttgagaggcgggtcgcgttgggatttaaggcgtcgttttttcgttagttttttttttttttcgttatcgggtggtcggagattcgggggtattgttggggtattttaaagtatagggttagtttgagtgcgtaaggttttgaaaagacgggggggcggcgataaggagtagggaggggggttggaggaagacggtaaagtgatttcggaagggtttaggcgttttaagtttatcgaagacgggaggtttttagtggcgtttggggggattgtgggaaaagtagtttaagaaggggaatttggagcgaggtgggggagaggtcggtatggttttttttaggagcgttagcgttagatagagcggtgataggtcgtatcgggagtatttcgtttatattgaacgg

SEQ ID NO: 11458 - DNA, 2150 bp, synthetic construct
  misc_feature 1..2150: note = Description of Artificial Sequence: Synthetic polynucleotide
  source 1..2150: mol_type = other DNA
cgtttttcgtggtcgggaaggttaggtcgagcggggcggttagtcgggtcgggaggagggggtttttcgggtcgcgcggtcgtataaagcggggagatttgttgttgcggcggtatgaggcgcgttttttttcgcgagttagcggagcgcgcgcgttcgttttcgtttttcgtttttcgttttagttttcggagcgttattcgcggagcggtttacgttagtcgtcgggcgtatcgcgttttagcggtcggggaggtgcgttgttcggttttcgtaaagttattgtgaatggggagcgggtgacgttagcgtcgaatgttaataatgtagcgattgagagtgtgggcgtttcggggagagcgtaagtcgcgcggcgcggagtaaatagcgtcgagtcgtcgtcgttttagtagtagtagtagtagtagtagcggtagtagcggtcgtgtacgttcgggttgcggtcgtatagcgttaacgtgagcggtcgtcgttttcgttatttcgtttgtttattttcgtcgtcgtttcgttttcgtttttttttcggttttttttcgtttttttttttttttttttttggcgtattcggggggttgggaacgagttgttatgtgatgcgcgtttttttcgcgagttttcggtgatttacgaattgtttatttcgtcggttgtcgggagggggttgcgagtcgggaagacgcggggaagaggaggcggaaaaggacgtaaagtttttcggcgaggtgagtttcgggtttcgggtttcgggtttcgtcgttgggcggggtggcggggtaagtttgcggggggagcgggcgcgcggggcgggcggggaggcgtggggaaacggcgcgggaagggagtttcggtcgtcgggcgcgtagtcgtttttttcgcgttttgttcgtttttatggtattttttaggaacgggaagggggtgggagtcgagtcggcggtcgcgtcgcgtcgaatgtgtgttttttttttcggttgtttacggcggtcgaggcgtattgtattttgttggcgtcgaagggtgttttggaatagtagagggaggaggagtagagagtaataagttaggtatggggagggcgggttgtaggaggcgcgcgttcgcgcgagtcgtagtagttgttagattcgcggttttgttttcggttcggcgaggttcgggtgtttcggtttttagtttgcgattttagttttaggtcgggcggttttttttttaattttcggcgtgcgtatttcgggttgtttcgcgaggattttggtcgcggcgtttttgcgtttagttgttagtcgtcgtcgggtggttcggattatcgcgatcggcggggaattaaagtttaagtttagggtcgtaggaagaggcgagttgggggtttcgcggcgtagatttggatcgaattttttttagcgaaagatcgggttgtcggaaagcgtttcgcgtagttaagatttaagggcgttaggtttttgagagggaaattttgtatttttttttttatagattttttatgaagttaaggtgtaatatatatatatatatatatatatatatattttatattttagtttttaagttttagaagttttatttaggagattggtttatgaaggggatattgtttttttcgttttcgcgtcgaggcgtttcgtggtttcgttgtgtttcgtttattcggcgggtgttcgggagttcggcgtcgttggagacggcggcgggcggcgtttacgggttattttaggtgtttacgaggggagagattggagcgagtatttcggcgatttcggtttggttaagtatttgtaggaattcggatcgtgaggggaagcgtgtagggtcgggagtgagtgtgtgaaggggtggtatatttttggtttttggggtcgcgggcgtatggggtatttttagtattttttcgcgcgtaggcgagtttggtaatttgagggaagtttcggcgcggtcgttgtcggggtggtttgtttgtggttcgatgaggcgcgtttcgtagtttgttttttcggttatcgtcgtcgtcgtgatttgtggtttttaggaaacgagagggatcggggcgttttattcgcgagacggattcgtagtttttcggcgggttcgcgggcggcgagacgcggcgt

SEQ ID NO: 11459 - DNA, 506 bp, synthetic construct
  misc_feature 1..506: note = Description of Artificial Sequence: Synthetic polynucleotide
  source 1..506: mol_type = other DNA
cgttttacgacgtttatgttagggttttttagattagcggagaaattagtagttttggatcgtaagcggcggggttagggaggcgataacgggaagtttttgtcggattttggatatttaggatttagtgttgttcgggcgttttttcgtagtagttttagggcgaggaggatggggggggttttcgtaggggttatattgtcggagttttacggattcgggcgggacggtgaggtttttatattgagtcggtggtaaagttttcgcgaggatgaaggaggaatttcgtgttttttattttattaggtttcgtattttttggttttttttgttttaggaatcgtttgttttttgtcgcgatcggcgagttttttcgggtttttttgaaatagtttcgtttcgaggttttggatttggaagtttaggggtatcgttcgggagcggggtatttattgtgggttttcgttagttagtatttaggttcggagttcggggatagcgggcgt

SEQ ID NO: 11460 - DNA, 1503 bp, synthetic construct
  misc_feature 1..1503: note = Description of Artificial Sequence: Synthetic polynucleotide
  source 1..1503: mol_type = other DNA
cgcgtttttgggtatttagaaataggtttttttcgggaattcgttttcgatcgggcgtttttataatatttgaagttttttaggacgttttttgagttgggtaaggcgagaggatttttttttagagtttagtttcgagtaatgttcgagttcgcgaggtggggttgggggcgataaggaggcggagcggggatttagttatcggggatttttttttaagttagtttttaaattattcggcgttatgtatttatagttcgcgcgtagttcgtgcgttttggattttatttaagtattaggttcgattagggtcggttcgaaggttatcgtttacggttagggtagaggggcggcgggaaaagggtttagtggattttcggtttaggagggtcggttagttgttgggtcgcgggtatttaaagttgcgggggttcgggttttcgattttacgtttagcggggttttagtattcgagggcgcgcgttgcgattcgtagagtagcgggtgtagtaggttggcggggttgggatcgcgagttttgtttgtaaagtttaggcggggtagacgttagggagggggtcgcgtttacgcgggtagtttcggcgttgataggtagcgacgtattttttcgtaattcgtttattagtagtttaaagtgtgtattgggtttttagtgaaatgtttggttttgaaagtttagttaatatcgggtttagcggagttattagggtcgttttttgtttcgtagaattaggttttggtttcggttacggtgggggtttcgtattagttcgataatttcgaggttacgcgttcgaaggattttttgggataagaagtggagtggggcggttaggacgcgggtcgtggggatcgcgagggaggagggggcggtcgttcggatttatttcgtggggttttcgcgcgcgggcgtttcggcgtgtcggattatgtcgtcggtagtttcgggacggggaacggaggcgtttaggcgtcgggtcgcgcggaacgcggagtttcgggcgttcgtatgtttttggttttggttttttggaagggttaggtcgtcgttgtcgtcgcgttttggggttttcgtttttttttattttttgtatcggagcgagcggggtttttaggaagaggttggttttggtggttaagggtttttttgttaaaagttattcggtagcggttcgcggttcggagttttttggggtatacggaggttcgggcggtcgcgttttcggggtcgggtttcggggcggggggtgttggggttaaggcgtcgtacgggcgtttaatttcggggtgtcgtttttataggttgtggttggggttggggcgcgggaggttcgcggggtttcggagagggaaatttagagaaaagttttttatttggtttggggtcgtaggggaaggaagacgtttttcgtttgtgtcggcgtcgatcgcgggtcggtaggtggggaggtttagagttggcggggagttcgttttattcgg

SEQ ID NO: 11461 - DNA, 907 bp, synthetic construct
  misc_feature 1..907: note = Description of Artificial Sequence: Synthetic polynucleotide
  source 1..907: mol_type = other DNA
cggtttacgtgttttttattttggttcgtagaggtttgagtgttgtttcgggtagtttcgggtagggttgggtagggtttagcggattttacgggtcgttttttttcgtttttttttagttatttgtttgtcgttttttttcgtttttttttttttgaggtgttgtttcggttttcggggcgggggtagtcgcgggtagtttagttcgtagcgtttttagaggtgttcgagttttttgaacgtttcgtaggaaagtagttgtgttgcgtggagtttttttttcgtttcggttttttcgttcgtgtttttgtttttttcgttttgcggcgggaggtggcggtgtgggttttcggggaggcgcggcgggttggggaggtggggaagggtgtgcgcgtgttgggggtgggggggaaagatttgtcgtttttttttttcgtttttttagtttttggttgttatgtagtttttatggtagcggtatttttagatttaatttttattttcgtttagagttaattaaggtaaaatagtgaggggaggagggaagagcgtggttagggaagggaggggggagaggtaggaaatttaattcgaagttgtaagtgtagcgtttattttgttaaagtcgtagtatagatttcgaagtcgtagcgtcgttttttttttttttcgttttagttcgagcgggaagcggtagtagttttttagagttttggtttggtagggaggggacggcgttcgagtagttatattgtagtttttcgggtttttttttcggtcggcgtaggtttcgcgtttacgattttttttgggagtcggatttgttttttttatcgtcgttattcgtcggtttttgcgttttttggttttcgatatttcgtttggtcgtttttttgtgtcggttcga

SEQ ID NO: 11462 - DNA, 1925 bp, synthetic construct
  misc_feature 1..1925: note = Description of Artificial Sequence: Synthetic polynucleotide
  source 1..1925: mol_type = other DNA
cgggtttttcgtcgttttggggttgagtttggtgtcgttgtttatattgaataggacgttttttttcgtgagcggcggaatcgttattcggtaaagcgggtgttcgaatagtttggttaggagggaggcgttttcgtcggggtcggggggcgattcggatcgacgcgggtcggggtttcgtagtagcggtcggtgcgcggggtcgtggggttttagggcgtcgggatttcgttttcgtaaggcgcgttcggtcggttcggtcgcgggcggtagtttttttagcgagtgggacgagaggttggaggaggggtcggagttgaagttttgtaggatgcggagcgtgtgtttgttgggttagttcgcgtcgtcggcggcggaggaggcggtcgggggtttttcggggcggtttcgaatttgggtttagtcgggcgcggttatttcggcggcgggttgcgcgtacgaatagtcgggttttttcgagggtcgcgcgtcgcgtcgttttagtttgggtagtaggtttagggcgatgtgtagcgcgtaggttattaggaatattattaggatgagtacgcggaatcggcgtattagtattatttttatggtcgcgcgggtcggttcgggtttggagcgcgttttgttcgcgcgtttttttagttgtagttgggtacgagcgcggcgtcgtttcgcgggttaaggtttatcggtgtcgggcggttattagtttcggggttgttttcgggttcgggtcgcgtgtagggcgttcgtcgtcggagcgttgggttttcgcgttatttcgggttcgttttcgttcggttttttcggagcggtcgcgtttttagtcggggagtttaggggttttggttcgcggagtcgggcgcgcggggggcggttggggtcgtagtagggggaggttcggcgttcgtagtcgtcggcgcggggtttatcgggcgtgtgggtttatttcggtcggggcgcgacgggtttgggcggtggcggcggtcgtaggcgtttcgatttttagcgcgtttttttttaggcgtcgggcgggcgggcggggaaggggcggttttttcgggtcgggttttgtttttacgtcgcgttcgggagatcggggttggggggaaggggggggcgaagggcggaaggggtgggcgcggggagcggtcggcggggtttcgggtaggtgtagcggtcgtttcgagcgtagttttcgtttggtcgagtttttcggcgtttcgcgtttcgggcgggtagatatcgagcgtcgcggagtcgtttttcgcgttagcgtttatagattggcggagtcgtcgttttacgagttacggttgggttcgggtcggttgcgttttcgtttttttttttttttttttcggtcgcgtttcgcgacgtttttgagtttcgggttcgttaaggagagggttttttttgttcgcggtttgtagagggaagcggcggagatcgggagggcgcgttcggttttggttaggttagtagttgcggtcgagtggggggtttcggtttggtcgttttttgggattttttttcgttcggggtcgtcgtcgttagttgtagtttttcggtttttttttagaggagcgcggggtcggggtttaggttaagttttttttcggagtcgcggggcgtttgcgtcgtcggatgagtttttcgtcgggcggcgatttcgtgttttacgttcgtttcggtaaggaggaggcggaggcggtttcgcgagagaggtttaaggagcgattgggtttggatttaggggacgttagggtagcggagttttcggtatcggtttcgttttttttttttcgtttattcgcgggacgcgttcgttttaattttttaggcgtcgggttcgttgggggcgttgagaggggttggtgtgtcgggggcgtttttttgtttggggtcgacgg

SEQ ID NO: 11463 - DNA, 1287 bp, synthetic construct
  misc_feature 1..1287: note = Description of Artificial Sequence: Synthetic polynucleotide
  source 1..1287: mol_type = other DNA
cgcgtggttcgggaggttttcggaggagggaagggtttattttagcgaggggtataggcggagaaggtgcggggcgaggcggtcgcgggtttttggtatttttttttttacgtttaggttaagttggcggtgttgttggtgacgttggtggtggtcgcggttttttatttgcggatggagtagaagttgcggcggggcgtggtttcgcgttagtttcgtatttcgcggttttagtataaggtgcgcggtgacggttatttggaggaggataattcggacgagagcgacgcggagggcgagtatggggacggcgcggaggaggaggcgtcgttttcggggtttaggtttggtttcgagttcgttggattcggtcgtcggttttgttcgtacgaataggcgtaggggggcgacgggtcggaggagtagtgaggggtcgtttggttttcggatttagtttcgtttttcgtcggttttagtttattacgttttaggtcggggggatttttttcgagtttcgcgttgttttcgaaggtttttgtttttttttttttacgttggggacgttttttttagagttcgggttattttcgggttttcgtagttttttttaaggcggagtggagttttgggaatttttcggttaagtataggggttcgaaaatatagttgatatttcgcgggtttttagtacgcgttttagcgtcggagtagggttagggtttttttgcgattcggtttcgttttagatttttttagttttcggtcgcggattcgggtcgcgtgtgagcgttttttgtattttttatttttagggttcgtcgagagttacgattttttatagaaaatgagcgataaagagattttgtattgttttgattggagagttttaggtcgcgggggacggagcgtttttgggatgtacgttcggttggttcggtttttgggcgcggtggtgagaggttttgatttagggggatcgcggggtgtggggagtgcggagttttattgggggcggggcgaggtgttcgtaggtttcgtttattagtttttttttttttttgaggtttcgtttttttatgtttgtttgtttttgttagttttagttaggagaagggagcgggggagcggttggtagagatagaggagggtgtgacggcgttgttggttttttatgggtttagagggcgagatagatttcgaaggtatattttttaggggtttgtgtaggtattttcggttttttagcgattattttcgcgtcggatagggtttattttcgagttacgg

SEQ ID NO: 11464 - DNA, 2906 bp, synthetic construct; identical to SEQ ID NO: 7254
  misc_feature 1..2906: note = Description of Artificial Sequence: Synthetic polynucleotide
  source 1..2906: mol_type = other DNA

SEQ ID NO: 11465 - DNA, 2146 bp, synthetic construct
  misc_feature 1..2146: note = Description of Artificial Sequence: Synthetic polynucleotide
  source 1..2146: mol_type = other DNA
cgaaagcggttttgagagcgttttcggggttttttcgaagtgtttaaattattagcgtggttagcggtttcgattttttattacgttttttttcgcgggtttaaagggatttgggtttcgtaaatttttgtcgagggagacgttcgtcgatttcgtcggtttacggggcgttttgtttttttcggggcggttttttaggtaggttgagagcgaacgggatgagtatatttcggacgtttaagggggcgtttagcgtttcgaagtcgtcgttttggtttgcgtcgtcgtcggtttcgttttttcgggtaggttggaagcgttaggtgttcgcgcggtttacgtagtagatggcgtcgtttagggcggcgtagcggaagggttgtaggttcgtggggtcgtcggggaggcgtaggggcgcgacgtacgggttttattgtttggttaggtagtggtatcgggatacgttgatttcgttcggtttcgtcgtttgcgtttcgtcgcggttgtcgtttagatcgaagcggtagatgaagtcgtcgagagttattatgtcggtcgagcgttcgcggttgttgttgtacgggtatttttgttattcgtcgcgtcgcgggttatatttgagtaggcgatagaagagggagttttcggatacgtagatttcgtcgtggtaggtggtggttttatgcgttacggcgaaggcgtttcggggtagcggcgttacgggggtttagcggtcggcgcgcgggtcgtagcgttttacgttgagtaggtattcgtcgtttacggcgtagaggtgatcgtttagggttagtagtcgtagttgcgagcgcgtttggcgtaggggttttacggcgttttagttgttcgtggtcgggttgtagtagaagatttggtcggacgggcgcgcgcggtcgtcggggttcgcgggcgttacgtcgttcgttacgaagaggtagttgtagaggacgtataggtcgtagtttcgcgtcggcgcgttttcgggtagtcgcgttagttcgcgttatttttcggtcgtcgcgtggaagtagtagacggtcgcgttttcgcgcgcgttcgcgtttttcgaggggttttgaggtcggttgttcgcgcgttttttcgtcggttcgagcgtcgcggttaagaggtgggcgcggtcggcgcgtaggcggcggcgtagtagtaggtttcgttttgcgttcgataggcggtcgaatacggcgggttcgcgtagtatttttagatagtggtcgtttatgaagtagtaggcggcgtcgcgtagttcgtttagtcgttgtcgtttggtcgcgtttaggatttcgtagtagttggttaggtttagttgcggttttacggcgtcggtggcgcgttgcgcggcgtcgggtagttgtaggcggcgcgcgtcggttattatttcggttacgttgtcgggtcgtacgttcgttatgcgttcgttgtaggcgtcggcgaggagtagtcgtagcgtcgttaggtttattttttgtattcgtagtacgtttcgcgacgcgcgcgcgcggaagtagtcgttgcgcgtcgttagtatcgttttgtgcgcgcgtagtcggcgtttcgatatttttagtattaggttcggtttttcgtatatcgtttcgaatttcgggggtacgggcgcgggtttttcgggtttttcgggggacgcggggtttttaagttaaacgcgcggttcgggggacggcgtcgcgggttttttcgggtacgcgcgttttttaggggacgcgagttttttcggggacgcggcgttcgcgttgtcggttttttattgtcgttttattattcgcgggttatcgttggagggcggggaggtggtcgcgtttttcgtcgttgaggcgagggattgcggcggggattttttttcggagttgaagtatagggacgcgtcgagattgtagggtgtttgcgtcggggacgcggcgttttcgttttcgtttttttcggtagtttcgggtttagtttttgggtagaggacgtagggggttatcgcgtgttttatggtcgggttgtgttgcgttgcgttcgcgcgttttcggtttcgtagtttgtaggtttggttaaggtcgagttttatttcggggtttttagttttatagttttttttggtacgcga

SEQ ID NO: 11466 - DNA, 865 bp, synthetic construct
  misc_feature 1..865: note = Description of Artificial Sequence: Synthetic polynucleotide
  source 1..865: mol_type = other DNA
cgggagtttttttttttcgtgcgtcgttgttcgggacgagaaattcgtggggtatttaggattaggatacgaggttttagtttgggtaggtggataagttgtggggttttatttttcgtaggcgatggttttttaaagtttgtataaatcggtttcgtcgggtcggttatgttcgttttttttttcggcgtgggaagtttttttaaaagtggaggggagcgagtgtcgcgttttgttaatttcgattgcgtttgggtttttttcgcgtcgggtttcggagtcgttttttttgattttgcgattacggtcggggattttgcgcgcgttcgggaatgtagagtttttagcgtcgcgtagggttcgtttcgatttcggtcggttttgggtaattcgtttcgcggttagtttttattttaagatgtggttcggtttttattttcgcgggggggaaatgtcgggcgatttttatattgatttttttgcgtatttagcgtaaattacgaatttagagttggagttgttcgtagatttcgcgtagttagatttcgcgtttttatttcgtttcgtttcgtttcgtttggcgtattaattttcggtcgaggaggggtcgcgtggcgtcgcggggggcgggtcgcgtacgtttttcgtagggaggatttagggatagttagggtttcgggagagttcgcgcgtatcgttcggtttcgcggcgttagttatggcgttcgtgcgtggtttcgttagggatggggcgacgcggttagagtcgtacgcgatcgaaattcgtattttggagtcgtagagcgcgcggttttgttgtttagcggttttttggtaagtgacgtggggaagaaacgtagggcgt

SEQ ID NO: 11467 - DNA, 865 bp, synthetic construct; identical to SEQ ID NO: 11466
  misc_feature 1..865: note = Description of Artificial Sequence: Synthetic polynucleotide
  source 1..865: mol_type = other DNA

SEQ ID NO: 11468 - DNA, 1463 bp, synthetic construct
  misc_feature 1..1463: note = Description of Artificial Sequence: Synthetic polynucleotide
  source 1..1463: mol_type = other DNA
cgtaatttggggttcgtagacgcgcgtggatataaaaatatacgttttcgagatttatttttttcgggttatattgtggggttgcgttcggggtacgggttatgtttgaatttttttttatcgtcgcgtttcgggttcgcgtttcgtcggtcgttcgtattgggtttcgcgtcgttttcgttattatatcgagtcgtttagtattttttttttttgaaggttggtttcgttcggggtgttttttttttcggttttgtcgtcgttgtttattttttcggttttttttcgtcgggtcgggtagggttggggcgcggggttgggcgagggcgcgttagtttattggagtttttttcgggcgtcggggttttttcgggcgggcgtcgcgggttgtggggttggagttggagtcggggtagtggttgtcgggttcgggttgggttggggttttcgcggcgagtttgcgacggcggcggcgggcgatttaggaagtgtaagggagagacggggtagggcgcgggtcgggagcggggtatcgagataatcgggtttcgggagggcgatttggagagggagggcgggagttaggggaggaaggaagaaggaaggaaggaaggaagtaaaggatggggcgaggacgcgcgttttaggagtaagcgcggagagttggggttgggggttgtagtcgttggaaggaggggacgggggtgtttagagaggaggaggaggaggaagaggaggaggaggagcggggcggaggagcgcgggtcgcggttgggacgttgggattcgagagtcgttgagtacgcgttttaggtaggttttgggaagttcgggatggaagtagttttttttttttcgtttttttttttttttttttttttttttttttttcgcgtttttttttttttttttgttttttttggacgtgggttgtcggttgtagttcggagggacggggcgcgggacggagtttttcgcgggaggaggggtcggcggtcggatggcgcgcgtcggggaggggtagcgggtcgcgggcggaagcggcgattttagttttcgatttagcggttggtcggagggcgagggttcgggaggtcgagggtagggaggtcgggtttcgtcgtttttttggttttcgggggtttcggcgtttgcgcgtttcgggatttcggggattttgtttcgtcggggtttggatcgggatttgggatgtgtgcgatttttagtttgtcggtttttatcgagggatttgtatttttggttttaagtttatttttttcgagttagattcggttttttttttgttgtttgaatgatagtatgagaattcgagggatatcggggatagtttatttcgggtcggtttttttaggatagggttttaaatttatttttagcgcgggttttgcgacgcgttcggagtttttttcgtttcgttttttgagcgtttcgcggtttttcga

SEQ ID NO: 11469 - DNA, 1437 bp, synthetic construct
  misc_feature 1..1437: note = Description of Artificial Sequence: Synthetic polynucleotide
  source 1..1437: mol_type = other DNA
cggtttttcggagttgaggtttgcgcgattggatttaggggtagaatgagtgcgtcgggaattttaaaattttagattaagatataaggggagtcgacggttcggaaatttcgttgcgggtgttttaagcgcgaggtcgttcgggtagggtcgtttagggatcggggcgttgggtgcggggtacggggttttatttttcgcgggttggggcgcgtagcgcgcggtttttttaagaaagttcgtcgggcgagtttattaaagtttaaaaattcgtcgtggagaagggcgcgggggaagaggagagagggagagcgttgatttaggcgagagagaggggaaaggttcggtcggaggtcggcgtttcgcggtcggggtcggggcgagtttacggtgggcggtggggattggttgcgcgttttttcggagatcgcgcggcgggcgggggagggggttggtcgggttttagttgaggtcggtttcggtttcgtttttcgtcgtcggcgttcgttttttttttcggcgttcgtttttcgtcgtcgttgtcgtcgtcgtcgtcgtcgtggcgtattcgtcggtcgtagtgaaaaggcggaggcggcggttttttcggtttttattgtttttttcgtcgtattttttttttatttttcgtattcgttaaatttgatgtgattttggttcgacgcggaggttgttttttttattgtttcgtgggtttttcgttattcgtttcgtattcgcgagcgtatcgtttttcgcgtttttttttatttttcgcggggtcggcgtcgcgttcgttttcgcgttttttttcgtcgttttttttttcgtattatgagtaatttgaagtcggacggcgagtacggcggtagtatcggtatcggtttcggcgcgggtttcggcggcgttttggaggaggaggtgggtttgtggtttcgggatttgtcgggtgaagcgtacgttaggcgggcgcgggagagggcgagcggggtttgtcgcgtttcgcggggtcggggtggttatcgttttcggcgttttttcgtcgttgttttttcgttcgggtaggagcggttcgtgttcgcgggcgggagcgtgcggtttggattgtttcgtcggataggtattgttttttcgttttttcgggttcgaggcgggtcgcgcgcgtcggtcgtcgttcgggcgtttcgcggtgggcgagatgcgtcgcgttcgttttatgtttgtcgttcgcgcgttttttgttttttatttcgtagtcgttcgtcgttttttttcgaggcgtattttttgcgtggttaggatttcgtttcggcggtacggagcggagcgggattagtacggttcgagggcggtatttttattttattgtttttttcgttttgatttttttttcgtgattttggaggtttgggtcggtcggtttttcggtttttgcga

SEQ ID NO: 11470 - DNA, 717 bp, synthetic construct
  misc_feature 1..717: note = Description of Artificial Sequence: Synthetic polynucleotide
  source 1..717: mol_type = other DNA
cgaggagaaaggtcgttaaacggagcgagagtttttatttttatttattttagtgttatggtggtatatgtcgattattatttgcgaggttttttcgtagatttgttttttcggtttcgtagcgcggacgattcgtagcgttttacggttatggttttttttataggggtgagtttgtttttcggatgggtggtgaagggtgattttggatttgatttttgaatcgtagcggtttgtacggggatcgcgggcgtgttgattttatgtgtttcgtttagttgttgtagagtcggtttatcgtacggtttttgcgggaggaggttattttggagcgattttttatttggtagggagatttcgaatttattgtgcgttggttgggtttgttgggtttgggttatttcgcgttgaatcgtaggaaggtgtgagagaaggggaggggtggagaggggtttggttcggtcgcggcgaggtttgtaagaggttgatttcgagttttagtaggtgcggtacgtgagtacgttgttgtcggcgtttttgggcgtattgggcgaaggcgacgcgcggttcgtgggtgtagcgttgggcgttttgaggaggtttttgttgcggtttcgggcgtttgtgcggtttttgagcgcggagttgggatcgcgttttttttcgttattggacgacgtgagtaaacgtttcgttttcgggtttcgtttttgtcgt

SEQ ID NO: 11471 - DNA, 1713 bp, synthetic construct
  misc_feature 1..1713: note = Description of Artificial Sequence: Synthetic polynucleotide
  source 1..1713: mol_type = other DNA
cggtagcgaattaagttgcgtaggcgttttgtttttttttttattaatatgttcgattggtttacgattgattatattattggttcgcgtaattttagtaggtttttgggtttgtagttgagtcgaagtttttttttttgcgtagcggggcggggtacgatggtggcggggggggaggggggaattgttttattacgtatgcgtatcggggatggcgatagggtttttttttttgtttttttttatagttttttttagtcggggggttgagtgtttttttttttttttttttgttttttttttttttttttttttatcgtttagcggggtttttaattgatagttgtcgtcgggtttcgttcgtgtatcgtttttttttgttcgtgtttttcgtaggtagaggggggcgggagggggtgtgagggagaggaggagtcggagtcgtcgttgcggtttttttcggggaggggagaggagaatttttttttttttcgtttttttttagtttttcgttggttcgggagggggtggggcgtcgaggtcgcggcgattcggtagggtttggtcggtgaagagtaggcgggcggggtgcggaggggtgaggtcggcgagggtcgtgcgcgcgtcgtcgtcgggggggaggggagaggagggtatttaggttttttttttttttttttttttttcgcgcgttatgtaatttcgtttcgtcggcggtgagtttaagattttcgcgcgtatcgagtcgagtcggcggttgaggagagttaggttcgatgtggcgggggttacgcgtcgcggtcgagtcgtgaggaagcggttcgcgtttacgcgttttttagtatttcgagcggttgttttatatcgtttagtttaggtttgtcggggtatgagtgtgttcgggacgtcgggagcgatggagtcggttggggaggaagagcggtcgttatcggcggtcgaaggagaggacgacgaggaggaggtggtagcggcggtttagattttagggtcggtttacggaaggagtgttttttcgttggaggacgcggacgattaggaggaagagatggaggcgatggtgatcggaggcggttgttgtaaggagtaggagttgatttacgagttatagtagggttatcgtattttgggcgagtttttgtaggagaagtatcggggttttatcgttttttttttgtagtttttggggggcgttgttatcgcggaggaggaggtggcggaagggtcgcgtagcgggggtcggggcggtcgcgttttttcgtagtagttcggatagggtatgtgtttgttgtagatggaagagaagttcgttagcggttagtacgggggtattatcgagttcgtggcggattttaggttgatgttggagacgtgttatcgtttgtacggagtggattattggatttttaaatagggttagaagttggagatgatgttggagtagaagttagcgtttttttttcggtaagcgagttcggttttcggtgggattgatagattgatataaatatatatttatacgtgttcgaggatgggttgggttaggggtttgggggcggcgttgataggtgttgagtcggtgttggagaagttcgggaggaggagcggcgttgggcggggatcggaggggtgtggtgggtgtgggtcgaattcggtttgcgcgtagattgagaaggaaattcgagtttgtagcgt

SEQ ID NO: 11472 - DNA, 699 bp, synthetic construct
  misc_feature 1..699: note = Description of Artificial Sequence: Synthetic polynucleotide
  source 1..699: mol_type = other DNA
cgcgcgaatcgttttattttggatttttggaatcgtgtttaggtattcgggcggcggggttcgtttaggtcgcgttaggtagttttgggtcggtgggtgtcgggtttttttttttttcgttttatttggcgcgttcgtagcgtcgtcgtcgtcgtcgtttttttttttagcgggcgttcggagtatttcgcgtcgcgtttttttcgtttcggttttcgttcgtcggagcggggtttacgtcgttggtagttattaagtggttcgttaaggaaatgtaggtgagtgcgtgaggtcgagcggtagttgttggagacgtggggtgtgtgtttgtgagtgcgagcgagacgaggagggagcgttagcgagcgagcgagcgagtgcgggagcggtcgtttcggtttttcgtttagtcgcgttcgtagtcggcggtcggagcgcgtgggggtagcgtttcgtttcgatagagtttcgttttttttttgtcgtttcggttgttttttcgaggagtcgggagtcgtttatcggtttttttaattttgcgttttttttttagttcgagttttttcgttgtttttttttttttttttttcgagtttttttttttttggcgcggcgtcgttagttagtttcggcggggagagtgtaggtattttgtttttagaataattagtaggatttaagtcggtttttcgagcgcgt

SEQ ID NO: 11473 - DNA, 1191 bp, synthetic construct
  misc_feature 1..1191: note = Description of Artificial Sequence: Synthetic polynucleotide
  source 1..1191: mol_type = other DNA
cggagcgggcgaggacggttagtttttgtagtgtttaggtttgtacggaagcgttttggtataatttagttgaggatatacgttttttttcgcgtagtcggagggttgaatagtaaagtatttttcgggggaattgtgtgttagcgtagtttggagagagtaggtttagggggtagttttattataggagataggatacgttttagtttgggtaaattttcggttttttttggttttaagttagtagtcgtcgttcgcgatttttttttttttttcgtcgttatttcggtcgttttgttagtttcgaatttgttcgcgtttggtcgcgcggttttttagtttacggggttggcggcgcggttgggatgggatcgatgtggcgtatgcgtggtggcgttattaggcgcgggagttgttgcggcggggacggtgttgcggacggtcgagggttaggtcgtttcggtcgggtttgtggtgggggtagttttagcggcggcggcggcggcgtgggttggcgaggtcgcgcggacggcgttcgatagtagttggaggagcggtttgtcgatttggcggcgagttatttggaggttattcgtgcgcgggacgagtgggatcggtagaacgcgcggttgcgttaggagaacgttcggttgcggttcgagaatcggcggttgaagcgcgagaatcgtagtttttttcgttaggttttgcggtttttcggcgaaggcggtaacgggacgttcgcggaggtacgtcgggtttttgaagaggttagtacgaatcggagggttagagatagcggtcgagaggacgagtcgggtagttttagggttttgagggttcgatttgagaagttggaagttatgtatcgtcgggttttgttgtagttgtatttcgagtagcggggattacgttcgagcggggataaggaggagtagtttttataggaattcgatttcggttttcgttttcgggattcggagttttttgggttttggttgtagtcgaggtcgtagtcggtgagaggcggagtttcgagcgggttttttttttttcgtttttagttattttcgatttcgcgtacgttttggttcgttttttgttcgcggatattttggattacggtgttttttcgtttttattagtggatattttcgggtggcgtttggttattcgtttggtggaggtcga

SEQ ID NO: 11474 - DNA, 536 bp, synthetic construct
  misc_feature 1..536: note = Description of Artificial Sequence: Synthetic polynucleotide
  source 1..536: mol_type = other DNA
cggacgggatgtaaagtttgggtgagacggttatcggacgtttattggaagggtgcggggatttttacgtcgatatttcgttttttcgttttagttcgcgtatttatcgcgtacgtagagtagtgatatggtcgaggatcgggtaagtttttgtcgcgttttagtcgcgtcggatcgttttttttttttttttagtaggtgtcgcgattgttttcgttatcggttttacgggtttggtagttttttatggtttcggtcgtaggtagcgtttcgtcgttgtttcggattcgttttaaattttatcgtttgagcgaatttcgggtagcggtgagtatcggtcggtaggttggggattgggcgcggtatagcgacgttatcgttgggaggtaggagttgtcgggattttttttcgttattttattcgggattcgcgcgagcgtttgggcggagttaattcgtggtgtttcgttttttagttaattaatttacgtttagtttatcgatttcgttttttttcgcgagtacgtaggaggcgg

SEQ ID NO: 11475 - DNA, 728 bp, synthetic construct
  misc_feature 1..728: note = Description of Artificial Sequence: Synthetic polynucleotide
  source 1..728: mol_type = other DNA
cggttaatacggttaggtttttcgggcgttttaaggtttcgttaattttggtaaaggcggtgttgaggtgaattacgtggatttgaaaaggatacgagggtaggagagggttacgtttttggtttcgtttcgtttcgtttttttgttttttttcggttagtttcgcgtttatttcggtagggaaacggtggttttttatagtgtgtttcgagttcggacgatttgtagttttttagtgtagatgtagttgtagagttcggtattttcgttcgggatttagagttatttttagtttaggaggtagggttagttgtattgcgtagggagaggtaagtgagtcggtttcgttcggtagggttagtttaattttcgggtaggtattgtcgcgacggtttttttttttgcgtttcgttttatttttaagtttcggcggggagatttttttattattgtggttattgttgcgtaggcgtagttttgggagcggcgggagttggaagtttaggagttttagggggcgtagggtcgggtagaaggcggcgagttgggggcggatatttatcggggattggaagcggttcgcgtaggttggggatattcggggttagggcgggtcgtttggggtgggagagtatagtgaggaagtttgacgtttaggttaggaatttagggaattcgggtagaaaaggtgagggggtgggacggtgggcggcgggtgggacgttcgg

SEQ ID NO: 11476 - DNA, 1431 bp, synthetic construct
  misc_feature 1..1431: note = Description of Artificial Sequence: Synthetic polynucleotide
  source 1..1431: mol_type = other DNA
cgagttacgttgtttttttgggagtttatcgtcgaaattaaagttatttttcgtcgggagtaggtaaaaggatgaggggaaagaaaattaacgaattatttttaggaattgacgtttttgttaatgattcggaagaaataaacgtagttttttcgtttcggttttgggttagtttacgtgatttttttgggaggttaaagagtatcgttttgttttttttgttgttaagttaagttattttacgcggcgtagtttcgattttttcggtttcgcgtagttttttttttaaattcggagaataagttttatttttttcgaaatgagaatttttttattggttcgaatgtgtagtttattaaattaaaggggcggggaatttttgtttttattggtttttttttttcgtaattttcgttttttgttgagcgagtttagtttttttttgagtttagagcgttttttattttgtcgggcggtttttgattggtggaagtgaggtaaggttgggtttcgttttttttttcgttcgttagtaggttggagtcggggttagttttggtatttttttttagttagtggttaatttttggtttagtggggattgtgttcgtttttttcgtttttttttagtttttttttcgttatcggaacgagtttcgcgtttggtaggttgaggaggagtaaagaaagtaggattaaagagaaggaagatttggttaggtttgggtggcgtttgtagtgttagaaagggaggcggtggcggcggcggttgcgattacggtcgcgcgggacgtgaggttcgagagtaatcgacgggtagcggcggtcgttttagcgtttcgtatcggggtcgttagttagtagaacgcgagtttttgtggaggagtagggtcggcgcgaggcgagattcgggagcgtgagcggggtttttggggcgtcgtcgttttttttcgtttcggcgtcgggggttgtagttttggttttcgtttttttgtcgggttagtttgtaggcggagagagtcggacggcgttcggagcgcggatttcgttttgtggaggatagcgcgtcggttgcggttttttttcgattttttttgttcggcgtttcggttcgggtcgtttaggtgtaggtgcgtgcggtttcggggtttggggacgtcgtagttcggttcggggagggggcgttaggtcgggagtcgtagcgcgggagggacgagttcgggtcggcggggggaggggagcgggaagcgtttttgttgttggcgatcgggattttttttcggtataggggaaaggcggggaagttattttttatcgggtttgtgtttttgagaggattttttgatggttgcgtgaaggggagcggtaggatagtttttgcggttcgtggagcggtcggagttagggggtgggggagggaggatcgatcga

SEQ ID NO: 11477 - DNA, 588 bp, synthetic construct
  misc_feature 1..588: note = Description of Artificial Sequence: Synthetic polynucleotide
  source 1..588: mol_type = other DNA
cgatttattttgcgagttcgggtgggagttttaggtttgtaggggtcgcgtggcgttatttttcgatcgcgatttttaatggcgagttcgtgcggtttttagtgcgtcgtttttttttgcgggtcggtggggtttgcgagaattcggggttgggggcgggtttggtagtggcgggcggggatttcgggtcgggatcgagaagcgttttcgaacggtagttatattggggttgtttagtggtttgagtttttttttgttttttttttatatttttttgttttggcgcggggggttttcgcggcgtcgaggtttcgttgcgtcgtttattcggagggaggagggtttttgggaggcgtcgcgtgggggcgcggttcgtggagttcgggcgttagggatcggtcggggtcggcgtacgggtgcgttttgggttcgttcgggtcgtgggagttagggagttagggagttagggatttcggttttcgtacggggtagataggggtagcgcgggcgattcggagcgtttgcgttttcgcggttttttttttaatagggtaaatttaggggtttgatttcgcgtttgttttgcgg

SEQ ID NO: 11478 - DNA, 1203 bp, synthetic construct
  misc_feature 1..1203: note = Description of Artificial Sequence: Synthetic polynucleotide
  source 1..1203: mol_type = other DNA
cgtttttttgaagttcgttttttagcggtttggagttcggggcgtggtcggttcgaatttgttttttaggtttagaacggagttcgtagttcgtaattcgttgtggtcgtagcgggtcgcgtttttcgttttcgttttaggagcggtcgaggatttgtttagttgcgggcgttaagttttggtcgtattttttttttcggcggagggagtcggttggcgttgcggtttttaaggcgcgcggacgtcgcggagggtagttagtcgcgcgggagcgggtagcgcgcgcgagggcgttgggcgtcgtcgcgaggcggggaagcgcggggtcgcggcggtgcgggttttagggcggcggtcgtcgtcgtcgtagtagcgtttcgagcggggagggtcgaggaggttcgacgagttggggatggagagtatcgggttttttattgttttagagcgcgtgtgcggttttgggcgcgtatagtgacggtgacggtatttttggttcggtagcgtcgaggtcgtttcgttagatagttagcggtcggcggtaggtcgggttatgagcggtaggggtcgggtcgggtttcgttgattttggtttcgcgcggtagtttttttagttttcgtttcggtttttcggtatgagagttcgttcgggttcggggttgcggttgttttagattcgtcgtacgttggcgcgtttcgggttcgcggagtcgcggtgttgatatttgcgtcgtattgcgtcgttcgttcgttcgttgtgtgtttcgggggcgcggttatggaggtggtgggtgatttcgagtatagtaagagggatttcgtgggatacggggttttcgtcgtggtttttcgggggcggtatcgttaggtgagcgtcggtcggggcgaggtcgggtttcgggcggtaggtacggggttaggtggttttgaaatttggcgtagtcgcgagtcgagattttcgattcggttagtcgttcgggtatgttattgtgcgcgtagttcgtttcgtcgtttgttttggttttgtgagggttgttgtgaggtttaagtttttggtagcgtttcgtttatcgatcggttgttgttgatttttttgtgtgttcggggtttatttcgcggttcgttcgtaggagcgtttgtatttaggttattttggatttaaaatagacggtattgtatcgtgtagattcgagggttgggcgt

SEQ ID NO: 11479 - DNA, 5370 bp, synthetic construct; identical to SEQ ID NO: 7304
  misc_feature 1..5370: note = Description of Artificial Sequence: Synthetic polynucleotide
  source 1..5370: mol_type = other DNA

SEQ ID NO: 11480 - DNA, 1691 bp, synthetic construct
  misc_feature 1..1691: note = Description of Artificial Sequence: Synthetic polynucleotide
  source 1..1691: mol_type = other DNA
cgagaataaacgttagtttttatttttgtggaacgtttaacgtagttggttgggggaatacgaggttttgtagggagcgagtttcggtttcggtttgacggaatataggcgacgtacgtgaagtttaggttttattttagcgtaggcgggtttttagcgatttatagttgttatatattcggttagcgtcgattttcgaaggcgtattttttatattttatttcgagtatcggttttatcgttagggaaggtttttttggatagtaaggtcggggtttaggatttgcgagatttattttattcgtttcgttagagtttaggagtagtaataggtttgcgtttttttcgggcggcgttttgtagattttcgacgggttaagggtgtttttagtttagtcgtgcgtttaggtcggggagatgggcggaggattggggttttcgatttttttgatagtttttgcgcgttagaaattgagtagatacggggttcgcgttatttcgttcgtcgtttgttttatttcgcgaggttgcgtttttattcgggttcgggagggtcggttcgcgtttcgggtatgaatggggtttttttttttaatagcggggaaatttcgttatcgttttttatttcggttttcggagttcgcggtggcgtaggtttgtttagtaagtttttgaatcggtagataaaggggtatcggaggaaaagtcgagcgtttttttaaatttatcggttatttttttttttttaaaataaaggagtttttcgtcgattttcgttttttttcgtaaggcgcgtcggtatttcggggagcggttatttcggggtattgtttaggtttttgggagcgcgtcgtattttagttcgagcgtcgcggggatagttggcgatttgtatttataggagttttaggggcgggtggagcgttcgggcgtttcgagtcgtcggtcggattttggagggttagcgcgggattcgttttttcgtagaagtttgcggatttcgcgttcggttcgtcgagttttgcgtatttatttcgtcgcgagtagcgtaatttgtggcggcgtcgcgcgttcggtcgcgtttcgaatttttttttagtcggtagttttcgagtttcggtcgtgcggcggtcgaagagggttcggcgtttcggagtagtcgcgcgtcgttttcgggtcgttttcgtttcgtcgtcgtcgagtttcggagagagcgcgggcgttggaaagtttcggtggcgaatggcggtttgagggcgttgcggcggcggcggggcgggggcgttggcggtttttcgtttttaagcgcggagtgggggcgttgaggcgggtgcggcggcggcggcggcggtagcgggagagggcgggatagcgggagggattggtacggatagtgatttttacggggagttgtcgcgagcgcgcggattttagttaggaggatcgttaggggttcgttttcgtcgtcggttttttttttacggtcgtgggaggggattcggcgtattattcggtttcgtttttgcgtttcgggggagtcgcgtttcgaattagttttttttttacgagggtagggatttcggttttgtttttttttcgcggtttttagtggggattcgcgttttaatttagtttttgttttacggtcgggggattagcgtttttattaagttcgtttcgtttttttacgt

SEQ ID NO: 11481 - DNA, 1223 bp, synthetic construct
  misc_feature 1..1223: note = Description of Artificial Sequence: Synthetic polynucleotide
  source 1..1223: mol_type = other DNA
cggaatgttatttgtttcgattgttttcgggtggttataggcgcgggggaaggcgtagggttaggggcgttgagggtgaaacggtttcggcgttcgggcggcggcggtggtcgtttgcggtagtttagttgaaacgtagcggaaattgtagttagttacggggttgcgggaggtaaggtaggaaggtggcgttgtcgtcgagcgtttggagttcgagcgtttattatggcggtaagggtaatggtcgttacggggagcgagtacgttttttcgcgcgtatacgtcgtcgcgtcgggttttcggggttcgttatcggcgtcgttgtcgtcgtcgttcgtttttttatttttttttacgggttgtagcggaattttttttttagatatcgtttttaagatggcggttttttttttcggtaattttttttatcgttttttgtagtaggcgtcgagtcgtcgttattttgtttttcgttttttttttttttttatcgatatttatatagcgaaaatcggttcggtcggtttgcggtttttattttacgtttgtagttttcgttttttcgttaggttttatttcggcgcggtgttttaggtcggtcgcggagtcgattcggggtttttcgatcgttttcggtataatcgggcgatttttttttaattttcgttcgtttacggagcgcgttttcgtcgtcgttcggggtagtcgggttttttttcgggtttaattgcggttttttcggggtttgttcggcgtcgcgcgttacgtcgttcggtttagcgcgggagggcgttttgcgggtcgtcgattaggtcgagattaggtcgttgtgcgcgtattaggtttcgcggtcgcggcggtattcgggatttatcggacggacgtgcgggcggtcggcgacggtggcgggtgttgtaggtcggtttttttttggagtattgggtcgggtttcggttggtggggcgggcggagggagggaggaggggtcgagttcggagttgataaaaagcggtttagtttttcggtacgggttcgtcgttagtacgttacgttatcgttcgggagagagatttaggaaaatgcggaagggtagataggttttttttttcgttcggtgggtttttttggtatttcgtgtcggcgtcgttttcgtttcgcgatcggggagtttagtggtttcgttgcggcggggttttcggcggtcggagttttcgtgatagcgt

SEQ ID NO: 11482 - DNA, 1103 bp, synthetic construct
  misc_feature 1..1103: note = Description of Artificial Sequence: Synthetic polynucleotide
  source 1..1103: mol_type = other DNA
cgaggtacgtattaggggggatttcgtattcgtagtttttcgtttcgtatttcgtagttcgggacggtttttggttttcggttttagcgaggtcgtcgaagtcgtagtatttagttttggaaggttaggtagtcgggatcgtagggattagtttcgagcggcggcggcggcggggtagaagggtagtcgttttttcgggatttaggacgtcggcgggcgggaggtatatacgcgcgtataagcggaaagaaagcgggtttattgcgtggggatgttcgttcgcgtagttgtttcggcggcggcggtcgttgtttgtatcgaggtcgaggcgcggcggtggcggcggcggttgcggattgagtttttttcgtcgggcggtggatgtagggcgcgggaggggcgcgaggggaggggtgcgcgtttgggaggcggggagggaaagaggggaggaagtaggagcgcgggggcgggcgcggttagttaggggcggggcggggcgcgcgcggggtcgggttttgtttattgtacggaggttgtgtgcggggcgcgcgcgcgggagacggtcggacgggcgtggggagaggggcggtttgttacgtatttcgcgcgtttacgtgttttcgttattggagagggtcgggtacgcggagagggtggttgcggggacgcggtggtaggttttttttcgaggatcggttcggattcgaagatcgggaggagggcgggtcgggggcgtttcgggttttttttttcgcgtagcggtttttagaggtttgcgggagttacgaattattgtaggcggttggggttggggaggtgggagtaataaagatagttaagtgagggtggcgtttcgttttatcggggttttcgttaatttgcgtattttttgaaaagcggtttcgtttcggggtttacgtcgtttcggttttcgatttcggaattcggtggtttgtagcggcgtcgaaaggtttatcgacgatttttttttttagtagtaagtcggagggagttaaataagttttatttataattttagtgttattatttagagcgttttaacgttatttagaaagtatcgatggtaaagcggcgcgtggcgt

SEQ ID NO: 11483 - DNA, 616 bp, synthetic construct
  misc_feature 1..616: note = Description of Artificial Sequence: Synthetic polynucleotide
  source 1..616: mol_type = other DNA
cgtatttaatggcgattcgatagttttatttggtatcggtgttcggttcgtggggcgggtggagggtcgggtagtcgtagggcgcgggttttttcgggtggacggtgttcggtcgggtcgggtcgggtcggggaggtaggcgcggggcgcggggcgcggtgtatagcggggagcgcgtagggaggcgaggaggcgcggattgggtttcgttcgtaggagaataaataggtttttttcggtcgttcggagtttcgtttttcgttttttttttcggtcggtttttttttttgttttttttggggtaggtagaggcgtttggtatatttcgtatattttttcgttagcgtttttcgttcgttcgttttttttcggtttcgtttcgcggggttgttggagaaattaagtttggggttttttttgtcgagtacggggcgagttttagaaggttttgtcgtgatggaaaatttttaggtaaattttttcgggttcgtggtttttaggtcgggaagttttcgttacgtgaagggttttcgtttttagttgcgcgatttggtttcggtatagggttaacgatttttatagatgttgtcgggttaatttagtcgagaattatcgt

SEQ ID NO: 11484 - DNA, 206 bp, synthetic construct
  misc_feature 1..206: note = Description of Artificial Sequence: Synthetic polynucleotide
  source 1..206: mol_type = other DNA
cgttaaaggcgacgtgtcggtcgttagttttaggtcgagtttcgagcgtttgtaggaatacgtttttttattcggcgcgggacgtagagttgcgagagaattttgtttagcgcggatttaacgttagggcgtcgtttagaggttggtttttgtttcggttttattcgtcgggagattatagagttgtttttttagtcgttcgtcgt

SEQ ID NO: 11485 - DNA, 1141 bp, synthetic construct
  misc_feature 1..1141: note = Description of Artificial Sequence: Synthetic polynucleotide
  source 1..1141: mol_type = other DNA
cgtattaattggcgtgtgtaggcgttgttgtttcgcgttgcgtacggagaagcgtttcgaatttatcgtacgatgcggagttaggggtagcgagtgagcggcggtttttagtttttttttgttttttttttgttttttttgggaatggtagggggttttttatgataaatgttcgtaaataggatagggttcggacgattttagagtcggcgttttttttttatatttttagttttagggtcggattcgttttcgcggttgttatcgtttttgtttcgggcgtttcgcggggattatttcgttaggtgagcgtttttaggagtttttttgaaatttatttgcgtgaagtataagtttattagcgtgagggtgaaaaattgtaggtatatagggaagtagtagagtagttagaagacgaaggggttgagcgaattggtcgttacgaagtttttgaagtagaaggagaagaggacggttcgtagggaggtttagaagaggtagagaaagaggaagacgttttggtagttgagtcgtttgtggcggtaacgtagtattagttagagttgtacgtagatgaatacgaagagtagcgcgtagaatacggtgtagacgacggtgaggttaagttttacgtaggggggtacggtcggggttagcgtgggcggtagcgagtcgttgcgggttgggttttacggcggggtttttatcgggtcgggggcgttgtcgcgcggtcggggacgttcgggttttatcggggtttacggtcgtcgtcgttttcgcgggggttttcgcgtatcgcgtttagtttgtagtttcgagattggaggaaagaaaataagtcgtattttttttttcggtattatatgatttattgggacggtttttgtttgcgattggtagcgtcgcgttcgtcgttttcgcgcgtcgatcggtttcgcgcgttttcgtttcggttcgcgcgttttcgtttcggttcgcgcgtttcggttcgttttttttcgggtatcgcgcgttttcgtttcgcgaatttcggttcgttttattttcgttatcgcgcgttttcgtagtgcgcgtttttagagtcgtacgttttttttcggttttttttttattttcggggtcgcgcgtttttagattgcgg

SEQ ID NO: 11486 - DNA, 1819 bp, synthetic construct
  misc_feature 1..1819: note = Description of Artificial Sequence: Synthetic polynucleotide
  source 1..1819: mol_type = other DNA
cgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgt

SEQ ID NO: 11487 - DNA, 1813 bp, synthetic construct
  misc_feature 1..1813: note = Description of Artificial Sequence: Synthetic polynucleotide
  source 1..1813: mol_type = other DNA
cgagtttattttattaacgttaaattcgttagtttcgttagtcggttgtaggatcgagggagggtgtaaaaggcggggggcggagggggggtagattagattaggcgaaatttaataagtttttagttttttagtttaaagtttttattatcgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatacgttcgtacgtatatatattcgtatatattggtatataggcgcgcggcgagttttgttaattttagtaggagttaaaaaaaattttatatatatatatatatatatatatatatatatattttcgttttttcgattaatgttttttttttttttgtttttttttttttttttttttttttttttgtttttttttaaaggatgggttggagcgttaaaaaatgttggtgggtttgggttcgtaggaggcggcgcgcggagggcgagggcgtttttgttgagttgtgtagttcggttcgttgagttcggcggttttgttcgttcgttcgttcgttcgcggtcgttagtgttgtcgtcgtcgtcgtcgtcgtcgtcgttgttgttttatggtcgcgttcgtttcgcgttttcgtcgcgtttcgtcgtcgttcgttcgcgttttcggtgagcgttggagtggggtcgggttcgtgtgtttgtttttcgcgtttttttcgaatttcggatttttagtgaaaggaagggggagggcgcgggcgcggaagggaggtggatcggagcggtagcgcggtttagtcgaacgggtatcgatcgttatttcgcgatttttttcgtagggggcgtcggcgtttaagttgttcgttcggagggtttagagtcgttttttagattagagtcgggggaggcgtagttagtagcgagttttgagcgatttttttttttattcgtttttttgttttagtgaatttttgttagttgaagggagcggggtttttgttcggggaaaaggaaaatagttcgtggtttgggatttgggattttttgtcgtttttagcgtttttttcgtttttcggcgtttttgcggtttagtggtttttgcgcgtcggagttcgtcgcgaagattgagcggtcgcggggatcgtcgcgggtttcgcgcgtatttttgggtttaatattgttattatttgatataataggagtagtgtcgggggggtattgcgcgtttagacgtgagttgtgataggttttcgaaattgggcgt

SEQ ID NO: 11488 - DNA, 1872 bp, synthetic construct
  misc_feature 1..1872: note = Description of Artificial Sequence: Synthetic polynucleotide
  source 1..1872: mol_type = other DNA
cgtggatagaaagtacgcgtaaggggtttcggggataggaagttattagtttggggagcgggaggtattggatattttttcgtttcgcggtcggtacgggtgcgcgtgcggtagcggcggtaggggtttttcgttttgttcggggttttcggtcgtgtttcgtcgttcgggtcgcgttcggggttgattcgtattattttgtaaggaagtgaacgtttcgtacgggaaggggaggcgtttgcgtcggtcgtcgcgtagtttcggggacgttcggggttgtcgtcggttcggggtcgtagacgatcgcgggacgcgcgagtttttcgtttttttttgttcgtcgtttttttcgttatttttgttcgagaggagttaaattcggtttttagagttcggggagggtggggatattcggtgtttttttcgcgttaggaggaagggggagggcggagaggatttttggttagtttgcgtcgagtagatttaaattaaaataaaaagattaaaggagtagcggtcggggcggtagcggtttttaggtcgggatattcggggtggtgcgttcgggtttgcgggggttgcgtcggcgtcggggaggcggggggagcgggagcgggcgacgcggggaaggggggagttagggggagggcgtcggtcggaggaggggcggattcgttcgttttagtcgagtagagtatagtcgagtcgagcggttcgggcgggggtcgatttcggttagcgtcggcgtagagagcgggcggaggcgtaggttatgttgcggttggtgtttatcggggttcgggttatcgtggatatgtcgtacgttcgttattttttggatttttagggtttcgttattttttaagttatgtagaagttggtggtgattcggttgagttttaattttcgcgaggtcgttattttgagtcgggattgttcggtgtcgtttttcggggacggagattttttcgttcggaatcggtgagttcggcgttttttaattttacgttttcgttttcgtttcgggttcgcgtcgcgtcgcgtcgttttcgtagtttttagttcgttcgcgtgtttatatttcggcgcgcgttcgggcgtatagtttgagtttgcgagatttcgggaagttgaattcgtcgttatttggcgaaggcgaatgtgatgtgattgttgttggtgtgaatattcgatgttatcgaacgtttttataattgagggttattttaatttgggatttttttttttttttttagtttttttttttttttttttcgtttttgaaataaaatcgacgggatttagaaggggaggtttttcgtcgggtcgttcgcgcgtatttatagtttttgcgttgatataatttttagggtggagcgggagtagtttggacgtaaattgcgacgtttaggtaaacgtgtttcggaggaaggaggttgggattcggttggttttttttgttttttttaggttggtagtcgtttcgtagtggcggagtttgtcgttggatgtgtgggtgtgtatttcgtcggtgttgtttgcgtgttgttagtgtagtgtgattgttgtttgttttttgagtgttaacgatcgtcgcgtggcgcgtgtttcgggtagttgggttagggtcggggtgggggtatggttgtttttgtcggtacgttttgtagatatttaggtgatatcgggttgttgcgagattttttggtttttttatttttcgcgttttttatcgtcgtgttttcgttttatttatttttagtaattggcgaagtaatagggaggaaacggattttattttttatcggagttatgttcgtttaggtttttgtttcgtgggtttttggttgttcgatttgattggtaaggcgt

SEQ ID NO: 11489 - DNA, 652 bp, synthetic construct
  misc_feature 1..652: note = Description of Artificial Sequence: Synthetic polynucleotide
  source 1..652: mol_type = other DNA
cgttttttcggtggagacggcgacgtggtttatacgcgagtttttcgtcgaggatgaattattagttagttcgagttgttatattttattttagtatagttatcgcgagagtttcggggtcgcgtcggcgtgttttacgtacgcgtagtttttcgcggggtcggttagtggtgtcgtcgaggcggggggagtggtcgtcgcgtcggtcgagtgaggtagggttatacgtaggcgtattcgcgcgtcgatagttcgtgtatcgtgtggtagcggttgtgcgcgtttaggaaggatatttcgttttcgtaggtcgtcgggcggtagtagggttgcgcgcgtattcgttttcgtcgtaggcgtcgtcgttggcgtagtcgtcgtagttcgaggtcgtagacgcgcgcggtagtttcgtaggcgtttgcgtagtagcggaatagtatcgtttcgtcggacgcgtagtttaggtttagttcgtttacgcgtatttttagttcgcgtagttcgtaaggtcgcgtttttaatcgcgtacgcgcgcgtcgtcgtcggggtttcgttcgacggcgcggatttgggggtcgtttagtttagggcgttagttcgcgtagttttatcgtattcggggttttttgtaggagtgtacggtttgcga

SEQ ID NO: 11490 - DNA, 722 bp, synthetic construct
  misc_feature 1..722: note = Description of Artificial Sequence: Synthetic polynucleotide
  source 1..722: mol_type = other DNA
cgtttttcgtagcggtgtagcgcggtcgtatttcgtattcgttgtttggtgtcgtggtcgttttttcgggtagtttttcgggttcggcgttggcggtagtggcgagcggcggagattttttttcggggtagtcggtgttcgaattgatcgcgtagttgttgcgcgttgagttttattttgcggcggtcggacgtttcggcgtagggggcggcgcggcgggcgcggtgttgggtatcgataacgtgtgcgagttggcggcgcggttgttttttagtatcgtggagtgggcgcgttacgcgtttttttttttcgagttgtcggtggtcgattaggtggcgttgttgcgtttgagttggagcgagtttttcgtgttgaacgcggcgtaggcggcgttgtttttgtatacggcgtcgttattggtcgtcgtcggtttttacgtcgcgtttatggtcgtcgagcgcgtcgtggtttttatggattaggtgcgcgttttttaggagtaggtggataagttgggtcgtttgtaggtcgattcggtcgagtatggttgttttaaggttatcgcgttttttacgttcggtgagttacgtttcgaagagggtcgcgggatggggggatttaagggaggttaggaggagggcggtttggatttagatttcggtttttatagcgtttcgttcgttttttaggtttggggttttgtacgcgtcgtgagtgaacgt

SEQ ID NO: 11491 - DNA, 858 bp, synthetic construct
  misc_feature 1..858: note = Description of Artificial Sequence: Synthetic polynucleotide
  source 1..858: mol_type = other DNA
cgttcgatttaggtttcgagtttttttttcgattttttttagtttaaaggttgtattcgttttaggtttttttagttcggttttttagtttttttttcggttttttttagtttggggttcgggtttttttttcggttgagtagtcgggttcgcgattttttttatttttttcggttcgggttttcggttttttttagaggtgaggtaggggttatttagaatttcgcggttttttattttttttaagattattttcgttttagttttttgttttttattttgtttttttaatttgggttttcgattattgtttcgattttattttgtcgttagggattattagtcgtttttttcgcgtttaggggacgcgtagcggtagtttttgttgatggtaagggtttgcgtattcggaaattttagggtttggggcgtggtgcggtttttgcggttagcgggtttcgtttgagttttagggttttttcgttgttggattacgttttttataggttttagggtcgcggatgaatttcgatttttgttttttttttcggtgttgtggttattgagttaagtttggcgagtcgaggtgattcgggtcgggttgcgggaggagttcgcggtgaggtggtttcgcgttgtcgggcgaggtcggtttacgtggagtcgggagtttgaggtttttgtacgcgggagttgcggacgatggtggttagtgttattgtttacgacgttattgtggtgtgtgtgtgtgagagacggagattttagtgtgtgtcgtgggtgttgtttgatcggatttaggacggtgagtaggggcggggtttatcgtgtgattttggtttacggtgacgtgatcgt

SEQ ID NO: 11492 - DNA, 598 bp, synthetic construct
  misc_feature 1..598: note = Description of Artificial Sequence: Synthetic polynucleotide
  source 1..598: mol_type = other DNA
cggagatacggttatacgagtaattttagcgacgtttttttcgcgcgtgttcgtttcggtatttcggatatttttattttgatagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagcgtttcggaggtttttgggagtgttcgttcgttcgcgtttagtgcgtaggcgttagacgtttagggtttgcgagagcgagttgagtggttttagggtttatttttggtaggagagagggtgggattcgtcggttaggtaggtgcgggggaggagttggggtcggtgcggggattcgtcggaatttcgg

SEQ ID NO: 11493 - DNA, 1281 bp, synthetic construct
  misc_feature 1..1281: note = Description of Artificial Sequence: Synthetic polynucleotide
  source 1..1281: mol_type = other DNA
cgcggtgtcggcgcgttagtagttcgcggttaaggttatttgtttttagggtttcggtatttttgcggggaggcggtaggtagaggacgcgcgcgtagtcgcgtaggagtttttaggcgagtgggggaagtatcgtaagagacgcggatttggagcgcggttattgcgttatcgtagcgatttgggttatttaagtcggcgggattgagaggtcgttgcgcgtgggtaggggtttagattgcgttcgcggtgtttgtttcggtttttatttcggaacgattgtagttttgcggggttcgtcgtttatatcgcgttgaggacgttgtttaagttaggcgttcgttttcgttcgcggttttagtcgttcgtagcgcgtcgtttttagacgcgcgtggttgttggcgagggttgagatcgcgttttcgtcggttagtttttagtagtagcgtattttttttgtttcgcgttttcgtttcggattcgcgtcgtcgtagtttcgcggtgatgagtttcgagtcggtttcgtcgtcgtcgtcgttttagtgttttggttgcgatcgcgcggagtcgatcgtttagcgtttagaggagggcgacgaggtttttcgcgcgggcgattacgagatggtagtcgagttttttcgttttatgttagtcgggttggcgtagtcggatcgcggtttgtgtttgaggttgggggacgcgttggttcgcgtcggtcgttttttcgaagttttgggcgcgtttcgcggcgtcgcgcggttcggggcgttgcggtcggaggagttggaagagttggcgggcggtttggtgcgcgtcgtgggtttgcgcgatcggtcgttgttcgcggagaattcgggcggcgagttcgaggcgttcggcgagggagggtcggtttcggagtttcgcgcgtttcgcgatttgttcggttgttcgcgttgtcggcggttgttgtataagtcggtgacgttgttttgcgggtttatagtttgtaagcgttgcgtggagttagggttcgcgcggtcgtaggtgcggcgcgtgaacgtggtgttgagcggtttgttggagaagtgtttttcggtcgagtgtcggttgcgtaggttggtaggttaggcgcggagtttgtagcgttagtagtagtcggaggtcgcgttgtttaggtgcgattaggttttggagttgggtgagtcggttgcggggcgggttcgttttttttatatttgttcggtttagtagcggggtggggagttggtcggtgggttcgaggttttgggttttcga

SEQ ID NO: 11494 - DNA, 1788 bp, synthetic construct
  misc_feature 1..1788: note = Description of Artificial Sequence: Synthetic polynucleotide
  source 1..1788: mol_type = other DNA
cgatgtagttcggagagagtatcgttcgcgtagcgacgcgtatagatttttttttggagacgcgtttttcggcgcgtgcggtcgagttcgcgtgaaatgtatagatttttcggtgaggttttgtttacgtgtgattttgagtattgcgaagttttttttttttattttcgcgtggttatttaaagttttgtttatatttcgtacgtgtagatgttaattttatagaaatatatgatgtaaggatagaaatgggaacgattggaggttgattttttcgtgattacgtttcgttaacgcggtgcgtttatgtatacggcgagtaaacgtatatagtcggtaaatagttatttttattatgtttagtttatagttacgcgtggggagaaggtagcggagagggcggcggtggtaggagaagtgggaagtcgcgcgttcgcgtgggttgttttttgatagttcggcgttgttttttttttttttcgggaacggcgtttattcgggggtcgtaggtttacgcgtcgggcgcgttcgggggggtttcgtagcgtcgagaacgggataatgaggacgcggtgataggttgggtttttgtcgcggtagtggcggcggcggtagttggagttgttcgtgtagtttttgtcgcggttatttttattttcgttttttcggtttttatttacgtttcgagggtttttttgaattcgaagatttttttgatgtttttagtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagagttttagttttttcgggagttggaaacggagtttagtttgggggcgtcggggttttttcgttttcggcgggagggggcgtttttgcgtggttcggaagcgtcgggcgggcgggggtgcgcggcggtcggatgcggggcgtcgagggcggggcgttttttcgcgttgtggtttgtggttcgggggattcgaggggtaaggcgtggggtggggggggtgggggtcggttgttatggcgacgggcggcggcggcggttgggatggaggcggaggcgggcgggagtttattcgtattgtattaaatcggttttacgttagtttcgggatagattcgcgaggagtaagtcggggagtttttgggcgggtacgcgtaggacgcgttagtagttgtttcgtggtttttttgcgagtaaaattttcgggggtgtttggtagtcgcgcgggcgttttggtgttgggttggagcggtcggcgggtttggtcgg

SEQ ID NO: 11495 - DNA, 626 bp, synthetic construct
  misc_feature 1..626: note = Description of Artificial Sequence: Synthetic polynucleotide
  source 1..626: mol_type = other DNA
cgtgaggattttttcggtatcgtttcgcgcgggtttttgtttcgtgtttaggcggaggcggggtggttattgtttttttttttcgtttcgcgttttcggcggttttttcgcggttttttgcgtcgcgttttttttaggaggcgttttgatttcgtatttcggttttttatttttcgatcgttagttttagggtcgtcgcggcgacgcgcgattttttttttttgaggggcgcgggtttcggacgcgtcgggttttgttaggtatttagtggagggtcggaggtcggcgattagttcgagtttagtcgtttcgggagttggcgcgagtgtcgttacgattttttttgttttttgcgttcgcgttgttcggtcgtcgggcggtcgttttagtttttttatatagttttttaaaaatagttcgtttcgtatcgttttgtaaggtagtagggagattcgtagcgtgttaattcgcgttcgtcgttagggttaagtttcgttttaggttttgtttcgggttttttattggtttttagtgattttatgagttttttgtttattttatatggttatacgcggtttaatggacgtttttttcgagattttacggttgcgcggagaatcgaacgg

SEQ ID NO: 11496 - DNA, 1037 bp, synthetic construct
  misc_feature 1..1037: note = Description of Artificial Sequence: Synthetic polynucleotide
  source 1..1037: mol_type = other DNA
cgggtttgattttcgcgtttcgttagtaatagttttttttgatttggtttaaggtttcggttttgtcgtttttaaaatcgttcgtaaggtttagtcgttcgtcgggttttttcgttgttttttaagttttttttaattatttgttttagatcgcgttatttgtaatttgtttcgggttggcgttatattcggcgtttcggcgttttttataagtgttttcgtttatgattagcgtttgtaggggtagttcggagttcgggtggggatagtagcgtagtttttggtcgtagcgcggggtgtagacgtcgtacgtttcgttttttagtcgggcgtatatcgagtagtagtcgtagttcggttttcggacgagtttcgcgtatggtatgcgggcgttttcggttattgcggttatcgcggcgggcggcgtaatcggcgggggttcgtaggcggttaggcgttcgggtgtgtagggcgggtagcggaatagtattttcgcgcgcgtttcgtcgtcgtcgttattcgcgtttagtagtagtagtagtagcggtagtagcggcggcggcggtagcggtagcgcggggtagtttattttcggtagtatgttggcggtcggtagcgcggcgtggcgggcgagcgagcgagcgggcgggcgggtaggtggtacggttttgcgagcgcgggagtcgtttttttcgttttttttttttttttcgtcgtcgtagtcgggttttaaagggtcggttttttttcgttttttgttttttttttttttttttttggagattatttttttttttttcgatattttttcgcgtcggtaagtgagtgcgcgtacgttcgttcgtttattttcgcgttggttgcgggttttgggggttttttgtttttttcgggtttcgttttttcgtatttttttggtttgattatgatttttgaaggagaatacggataattcgcgggtttgggtaggatcggcgtggcggtggagaagagcgcgtgtttttgtttgtttttagtttagttcgcgaggatttcgt

SEQ ID NO: 11497 - DNA, 977 bp, synthetic construct
  misc_feature 1..977: note = Description of Artificial Sequence: Synthetic polynucleotide
  source 1..977: mol_type = other DNA
cggttttggcgttaattcgtcggtttttggttttttggttttgttatttttggcggggttgtgggtcggtttaagattataagagggtttcggcgggaattttcggtggtgttcgagggatttaggtaggtcggcgatttttttttaatatattttttgaagttatcgagacgttttgtatttgtcgcgtttttagagtttgtcgtttttaggttttagttttgaggttgcggtgatatttattgggtatttcgggttttgtacgtttcgtaggtcggtcgtaggtagtcggttttgttgttatttttttttttcggtcgttggttggtttttttgttttggaggtatagagggatcgggcgttgaaaggtgtagttttgtttgtggagggatggatattcggagttgaagatagtataggagagaggggatttttatttattagtgaaggcgtcgttagggcgtttgtttttatgttttttttagatttgtgatatcgtcgtgcggtttagattttcgggggcggttgtatgttagggagggagtattttagggttttttgtttttaagggagagggatagtattttttcgggtttttagtttttttgggtgtggcgggagagttttgggcgaggttgcgtttatatttgtatttcggtcggttttttcggttgatttcgttttggttgatttcgcgtatattttttttttagcgttgtaaggatcgtttgaattcgttggttatttcggtgatgaattagtggttcggtgtgaagttgcgggtgatcgagggttgggacgaggacggttattatttagaggagtttttgtattatgagggtcgcgcggtggatattattatattagatcgcgatcgtaataagtatggattgttggcgcgtttggtagtggaggtcggttttgattgggtgtattacgagttaaaggtttacgtgtattgtttcgttaagttcgg

SEQ ID NO: 11498 - DNA, 6206 bp, synthetic construct
  misc_feature 1..6206: note = Description of Artificial Sequence: Synthetic polynucleotide
  source 1..6206: mol_type = other DNA
cgttacgttatatcgagagaagcggagacgatatttttattcggtgggggcgggggcgaggtttttttagcgcggattcgggttcggggagtgtagggcgtattttttttgtgggtttttaagcgaaggtatagttcgggggtcggggtggagggcgcgttttagtaggtcgggcgtacgggtatttgtaggaggattatttgtttgttttcggatgggtggtatttgttgatgtgtcgcgtaaggtcgggcgagttgtagaaggtggtcgggtagtatttgtaggggaatatttgggcggcgtgtagtaggcgtaggtggcgtttttgagcgtttttgttggcgaacgatttttcgtatattgggtataggtggtattcggcggacgtatttaggtttagtacgtcggttttttcgtcgtcgtcggtcgttttttggggcgttttttcgtcgggttcggggtataaggttagtaggttttcggtcgggggcgttagcggcgcgtttttggtttgtagcgtttggtggtgcgttagtaggtgtttgcgtaggtaggtttggcggcggaattttttggcgtagtgatggtattcgtagagttcgttttcggagttcgattcggatacgtcgtcggggttcggcgtgtttcggtcgttgtcgtcgtcgggtgtttttcgcgttttagttttggttgttgtttttggtttcggcgcgcgggcggcggcgggcgcgggtcgcggtttgtgttagcggcggtgcgaggttaggttggtcgggtagttgaagattttggcgtattcgggatagcggtattttatacgtacgatgcgcgagtatttgtgttgcgttagcgcgaacgggtcggcgtatttttttttgtatagttggtagatgaattcgtttagcggtcgcgtcgcgtttttcgcgcggtttcgcggcgtttttatcgggttttttttgattttgagttttagtacgggcgacgtggttatttcgttttcgaagtgtagtttgcggatggttttgggttttttggcgttcggggttttgattgttttggcgggcggtttcgcggcggtagggggcgggggtcgttttttcgggggtcgtagggcggcggtagggggtagtggggggtcggggttcgggtcgcgggtcgtttcggcgttagtcgagaacgtcgtgtttattttgagttcggcgggcgcgaagagtagcgggtcgtcgtcgtaggtgtcgttttcgttagtttcgttcgcgtcgtcgtcgtcgtttttttcgagtagcgcggcgggcgtggggaaggattcggtcgagatcggcgagtttaggttgaagttgcgttcgaagtatttgtgtttttcgtgttcgcggtttacgggtcgcgtgggattgtagagcggcgcggggtgcgtagtttcggggttgtcgaagtgcgcggttcgcgggttttgcgggggtggttgcggtttaggcgcgtaggtaagcgcggcggcgagcgttgtatgggcgcgtttcgcgggcggcggcggcggtagcggttcggggatcgggttcggcgtcgggggttcggcgcgggcgttttcgtagttgggcgagagtagtagtgcgcggtcgtcgttttcgtcgtcgcggattcggtaggaaacgggcgtggattttttgttgcgttttattaggaagtcgcggggtatgttggcgcggttcgagggtacggtattggttcggtttttttttcgcgttcggtttcggcggtttttagtgttttcggtttattgttcgggcgcggcggttgcgggattcgcgtggcgtcggcgacggttcggtttagttttgcgttttgtacgcgcgtttttgttttcgggttcggtagtcgtttttttttaacggggggagggggttattgttttcgtttttcgttttttttggagttaattagcgcgttcgtagttttttagtttggtagggtgggagggcgatggggcggttaaaagggggtcgggattcgggggtcgttcggtaggtgcggtagatgtatttgagggcgcggggttttcgcgcgcgtttttggtcgtttcgttcggcgtcgtcgtttcgttcggtttaggtatacgttcggtttcgtttttttttacggtttgttgtttttttatggggaggcgtacgtgtttgggttttgtgtttttttttcggggggcgcggagtcgttaaatgggttcgtttattagcgcgataatgtacgtttttttttcgcgcggggattattcgcgggtcgttagtaaaatagtaataaaggagaagaatggttttaaatatgttaggagggtttaattcgcgagtcggagtcgagggggaagttgtgcgcgttgattgggtgggggcgggggcgcgtcggggcggtgcgggggagatcgttgcggaggcgtagtggtttcgcgtggtgtttgggaaataaataagaattcgagagagtagtagggttcggacggttttcgttcggattttggacggatgggtcgttggatttaagaggttaagtaaaagggtttttcggggttttaagtgtggatagggggttcggttttttggtagtggtcgagggcgatgtttgtgttcgtagttttcgcgcgtttacggggttagagaaggtttttttcgagtttgagaaggaattggtacggtttttttagtttttcgaaagcgcgggattggagcgcgggcgggttgggttgggtttttagaggaacgtgaatttttgaatttttgggtttttggaggtttgggaatggtatttttggcggggttcgatttaggtcgttcggagttttcgcgtggtttaaggttcggttaattcgggtcgagttggtcgaagttcgaaacgcgcggtcggtttcgtgcgttttagtgaagttggttttttttttttcgcgcggttttatgtatttttatttcgagcgggtattttgtttgtcggttgatattagatgttaaattaagggttttaattaaggcgttgcgaaataaaggggttgtttgtttgggcgtagtttttacggagtcgtgttttttttatttttgtgaaggaaattaattttttgttattgagtttcggtcgcggttaatttggacgtaaaagagacgcgtgttggacggggggagggggggtaatttgtattttgaggtaggttgaggttttcgagaggataagtcgttttttttgtgttattaggaagagataatagcgaagatttttttcgtttttatttttatttttatttttgttgtcgtttcgtttggatttagattgggtcgtttgtttttattttttgtttagtttagtttcgaggaaatataaaaggtagaattttcgggggatagggtagagaattttacgagtgcgtagtggttttgatcgtttaatattggggaataaatagttaagttatataaaatgttatatgttgtgaggaaaatgttattttattgaaagagaaggaaatatttttttgtaaagttttgtatattagatagattttgttgagttttatttacgtttaattttattgaaggtatttaattgttttggattttttttttgaaaatattttggcgtagaaattaaatatgtaaaaatagagtttatatgagttataagttgtgatggggatagttgttaggtttaattaattaaggggttaattaggttggttaattaagggaaagatatttgataattttatgtttgtaatattttaatttatatattgaaaagggaagaatgtatatagtgaaatatattttgaaaagttttattttagttttaaaaatgttgtggtgagtgttagtttttttaaaagttagaaattttaaaatgagtttatttaaaatttataaatatatttttatttaaaagtaattgatgttatttttttgtttttttgagttttgattaatagtgttgatgaaattagaagtgggaaaaggatttcgagatagttttggttaattttattttttaattacgaattttatttggattgtagaatagtatagggcgggggttcggtttgttttattcggttttgtatatgtaatattttttttatttaatagataatagagagttagttattttgtgaattttttaaaaataataatatttataattgtaaataagtcgtggggatgggaaatcggtatttttattaataaaaaaaataaaataatttttgcgtgagtgaatttaaatagggttttgaatttagttaagggaatttattaaacgttattgagatattgagatttaatgaattcgtttttttttttttatttgtggtttttagttttgttagcgtaaatgaaatttgtttttagacgggtatagttaaaataaatggaaatttgaaaggtattagtattggaaattaattttattattcggggttggaaggagttaggttgcgtacgcgcgtacgtatatattagcgatttttaagtaggtgtagtttagttcgggtcgtggatcgtagtcgttttttgcgtgatttttttagaatttgtgtattcgtatgtatggggatatcgggtcgagatatttgttttcgtttgggaagagtaaagcgttattatagtgcgttttcgacgtcggttttggcgtacgcgattcggagaatgggtcgcgtgaagttaagttgggggaaatagcgcggatttgtttttttttaggggggtttcgcgaaagttagtgaatataaggatttaaggtagagtatttaaggggtttttttcggttttaggtgatttttttttttttttcggggttttggttagcgttttggaaaaatttcgggtttttttatttttttttgcggatttcgcggtgggtttttttttcgacgattgcggagttcgaggttttaggttttttaattttttttattttggtgtgcggggatgtcgtcggggagcgcgtcggggtttattttgatttttattacggttggaaattaaagttaaggtaatagggagtttgtagaaagcgcgaagtttggaaataagagtagaagcggggaatttttgcggaggagttggttttttggggtgtttaggagaataggaggttttggttttacgggaggagtcgggcgggttcgtatttttatttcgtagagggtatcgcgtttggagacgtcggcgttgggggtgaggtgttagcgttttttattattattttgttgtagattttttttttggttttatagaagtttttattttcggtttttagtttttcgagttataatcggtaggaatcgtgcgttatcgttgtagtgttcgtcgttcggagggattagcgtttttttgcgtcgggtgcgttcgattcgagtcggtgagaggttttgtatttgtaggaatgaggggttgttgtgttagttttaggggtacgcgagagatacgcgtagttcgtttggtcgttatttcgttcggttcggttttaggtatttttcgggtttttcgttcgcgggtcgttgtttttgttcggcgtattagtataaagttgttagggatttttcgtttagataattttatataaaaggagagtgtatgaaagagagcgaataagggacgattcgcgaggttgcgtcgtgcgttttcgcggggagggatcgcgtttaagtattttttttttttcgagttttaagtgttttttggtaatttgttgcgcgtttattattcggtcgggggtcgacggcgtggttggttattttttttattttttcgagagtatcgtcggggttattgtacgttttttgaagtgtttttagggttgtttgtttttgttttagtgggatcgtcgggttagggagggaggagagcgggtaggaaggttcgggcgggcggcgggaagggcgacgtcggcgaaagttggtagaggcgaagtttagaaggtgagaaagttataattaaagaattaggttagggagagttaggacggtacgggatttatcgggatgatattgattttggggcgtaagaggtgttttttatttgtgaggtgttggcggtcgttagttcgtgcgtttcggttttaaacggaattgataaaatttagcgaaattgattagaaaggttgcggcgatttcgattttttttttttttttttattttatttatatttgtatttcgtttcgtttgtcgtaggaggacga

SEQ ID NO: 11499 - DNA, 574 bp, synthetic construct
  misc_feature 1..574: note = Description of Artificial Sequence: Synthetic polynucleotide
  source 1..574: mol_type = other DNA
cgttagcgttaacgaatgtggggatagttcgtttggcgttcgcggtcgtatttttatcgggtagtttcgtatttttttttcgggtttttaagtcgttcgtttcggttgcgggagatttcggcgaattatattcgagaggggggcgcgtggggcggagttttttttttattgttttttcgttattagtcgtttttgtcgtcgagttcgtagtcgttagcgcgtttcgagtttttttaggttagaggttttcgtaggcgatggcggataagagggcggggattttagaagtcgcggcgcgttcgtcgttcggttttgttcgggagggggacgcgcgtacggttttcgcggttcgggttcgagaagttggggggcgcgggtttttttatttcgtagcgggtttcgggatcgttttttttttttttgggcgcggggaagcggtttttacggcgattatttcgagtttggaaaatggtcgggttcgggacgaagttttagaaatttgtggtgtagaggggttagggattcgggtaggagttagcgagaaggtcgaggacgcgaataaggaggagggcgt

SEQ ID NO: 11500 - DNA, 3438 bp, synthetic construct
  misc_feature 1..3438: note = Description of Artificial Sequence: Synthetic polynucleotide
  source 1..3438: mol_type = other DNA
cgtgtttgtttcgttttggtcgtttgaggtcggagttatatatagtttgtatagattcgagatattcggtttcgagtgatttggaaacgagtgtgtttttattgcgtttaaataagacgaggatatttataaggtgcgagtttttaatttttagttattggtaggggttgcgtagcggtatcgtttaggttttttttttaggcggtcgatttatttttgcggagagtacgtttttcgaagagggttgtagacgcgtttttttagtatttaatttgttattttataagattgagttaagttttagttaaaatatatttattttattaaaaataggcggtttaatattacgtcgtattttagttttttcgagggcgtaagagaatagagagtttttagattaattggaggtaaatattttattttttaatatttaaaaataatttaggcgcgtttgtatcggtgtggtttacgcgatttttacgcgcgaggttagtcgggttggtttagcgtagatagcggtcgggatttatttatttagtgcgcgttttttttgtttttcgttgcgcgcgtttaaagttagaaagaagaaggtgacgcgggaggcgggtcgggttttcgggtttagcgaattcgcgatttattcggtttcggcgtttgagtcgaggttttagaaagaattcgttaattttagttattttggatttgggtagggagggtgcgcggtttttaagtttagtttggatgtttagtgcggtgtgtttcggttttttcgtttgtttttcggggaggttttttattcggtggttttgggtcgttttattgtggcgtttttatttttggttatcggttttttttcgtttaggatttttcggtttagggagtagtcgacgggtattttcgaacgttggggtacggaattttaacggggcgattagagcggagttcgcggttcgaggttcgcggttgagtacgaagacgggattcgaggatttgtatatcgttcgaggggaatttgttttgggttttggtgtatatatagtatgcgttttgggttggtttgggttgggttaggtaggggagatttggttgggtacgaggcgtcgtttaagtttttcggtcgtgggtcgggcggtcgcggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgttgcgttttcgtttttcgtttttttagttttttttcgtttttttttttcgcgtttggttcggcgcgtttcggtcggtcgtaaagtttttcgggcggtagcggcggttgcgtttcgttttagcgatggtcgcggagttgagtatggggttagagttgtttattagttcgttggttatggagtatgttaacgatttcgatttgtttaagttcgacgtgaagaaggagttattggggcgcgcggagcgttcgggtaggttttgtatacgtttgtagttagtcggttcggtgttttttatatcgtttagtatttcgtgtagtttcgtgttttcgtcgtttagttttagttcgatcgaatagaagatatatttcgaggatttgtattggatggcgagtaattattagtagatgaatttcgaggcgtttaatttgacgttcgaggacgcggtggaagcgtttatcggttcgtatttagtgttatagtcgttgtaaagtttcgatagttttcgcggcgtttattattattattattattattatttttattcgtattatgcgtattcgggcgtcggcgtggtttacgacgagttgggttcgtacgtttattcgtattattattattattattaagcgtcgtcgtcgtcgtttagcgtcgttagttcggcgtaatagttgtttattagttatttcgggttcgggtcgtacgcgacggtttcggcgacggcggcgggcggtaacggtagcgtggaggatcgttttttcgacgattagttcgtgtttatgttcgtgcgcgagttgaatcgttatttgcggggttttattaaggacgaggtgattcgtttgaagtagaagcggcggattttgaagaatcggggttacgtttagttttgtaggtataaacgcgtttagtagaagtattatttggagaatgagaagacgtagtttatttagtaggtggagtagtttaagtaggaggtgtttcggttggttcgcgagagagacgtttataaggttaagtgcgagaaattcgttaatttcggttttagggaggcgggttttattagcga

SEQ ID NO: 11501 - DNA, 4088 bp, synthetic construct
  misc_feature 1..4088: note = Description of Artificial Sequence: Synthetic polynucleotide
  source 1..4088: mol_type = other DNA
cggttcggtttggttcgggatacgtttgtttcgcgtatatatagttagtcggttttgttcgaaacgtattaagtcgcgtttagcggtaatcgttttttttttttttttcgtcgtttttttttcgatttcggcgttacgatttttttgcgtttttttttttttattgtattatttttatcgtttcgatttttttcgaggggttgatgttattagtttttttatttttttcggttattttttttcgttaaagtttttttttggcgaggtttttttcgttattacggcgttttttagcgttattttttttttttttcgttttttttttttttttttttttttttttaataaattttatattttacggaggcgggtttttttttttttattcgttattcggttttttgttttcgaaattttttttttgtcgtagttttcggagttttatgggttttttttttttttttttaatacgtatttaaatttttggcgtcgtgtaggtttcgcggaaaaagagagaaagagagaaagagggggagagcgagagcgagagtaagagagagatattgagcgggtaggtcgggggagggggattcgcgttcgcgtcgttacggtttttcgtttcgtttttgagttttcgttcggtcgaattcgcgtttttgggtttttttttcggtttcgttttttatagatagagttcgcgaacgggcggggggttcgggagcgcgcgttcggggcggggggcgggttcggcgcgcgcggtttgcggggcgtttttcgagggttttcgggtcggggtcggcgtttttcgttcgtttttatttagtagtagtaggcggtgcgtggttcggtagatttgtttgtttttttgtagttgtttttcgatttttttgttggttttacgttgcgtttttttttcgttgcgttggttttcggttttattgttttcgaggtagtttatggcggcggcggcggcggcggggcgcggtcgggttgcggcggcggcgggcgcgggcggttttacgtgggtcgggagggtcggggtagcgtcgggcgggcgggtcgggcgcgggttcggtttttcggtaaggagcgcgcggggcggattgcgggtcgcgggtcgcggggcgcgcggacgggcgggaaggggagggtgtcggtcggatcgaggggcgcgcgtagtttttcgtttttcgagtcgaggtcgagggggttgatggtcgtcgtcgggtcgaggcggattagagtaggagttgcgggagttgttgtcgtcgttgtcgtcgtcgtcgtttttattgtttcggtcgggttttcgtcgtcgtttcgagttaaaagcgtcgcggcgggcggggggaggcggggggaggaggaggcggcggcggcgaggggggtggaaggaggaggaggaggaggagggtcgaggagcggtcgcggcggcggcggcggttgggagggcgggagtcggcggagggaggcggtttttcgggagttcggggagggggttttttcgttcgcgttcggtcggggacgggacgggtcggggagacgttttttatttttcgggttcgggtagtagttcggttgagtcgaggggggagagggggcgttttcgcgttagtgacgatttttcgtacgacgttaacgttttatttttcggatcgcgtcgttcggcgttttcgaggttttttttttttttcgcgggcgtcgtcgaggggttggggtgggcggaaggggagggagcgcgcgttcggatttaggaaaattttcgaaagagcgagagatatagagagttagagagtaggagtgtggaaaaagcgaggcgagtacgaattaaaggatagagtaatcgaaaaggaaaatgtgtttatatatatatacgaatacgaataaaaatttatattatatagcgatggtggtgtttggtggcggtggcggggtggggggtttgattagatgagtcgtttttcgcgttttcggcgtcgggcgttatggttcgagtcgaaggcgtttttggtttcggagcgttcgcggtttttgcgtttggcgcggtcgtttaagtaggagaagaaggcgtagtttaggaatattcggaagtagtaggtcgtttcgaatacgaagtcgtagtcgcggttttgtttcgtgcgtttttgtagtaggaagttgagtatttacgaggggttgcgtatcgagaagattaggaatattacgaggggtaggtgggcgtttagcgcgttagttttgagcggttcgggtcgttatacgatgtttttaacgcgcggcgtcgcgtagtaggcgtcgttttcgtcgttcgagttcgtgttttagttagtttaggttttattcgtgttttcggcggcggcgtttttttcggcgttttcgacggcgtttttttcggcgtttttgtcgtcgtcggcggcggtcgcggcggcggcggtttcggggtatcgggtttttttttgggtttttggtattttttttttttttttttttagtattttttttattttttttttttttttttttttttttttttttttttttcgtttttgttttagtagttttttttcgagttttttgcgttttttgtttgttaggaatttttcggggagcgtttttcgcgtcgggtttttggggtttttcgcgagtttttcggggttttcgttttttcgcggcgcgagcggttttttcggttcggttaacgtcgtagtcgtcgtcgtagtttcggtagttatttcggtagtcgtcgcggtcgtttttttttcgtttttcgtcgttcgggttttgagttttatggttatttttagtatggtggttcggttatttcggggagttcggttcgcgtttggttcgggttttttgtttgttttcggtttcgggttgttcggttttcgtgcgtttcgtgtcggggggtttggttgcggttttcgtcgcgttgtttcggggtcgcggagcgcggttgttcgggtttcgggttgttgggttggttgtttaagagttagcgttaaaaaggatgagtaaacgaaaaagggataagaataaattaaaaagtatttaataatagcgagaaattaaaaagtattaagaaatgttaatttaaaaagaaaagtgtaaaggcgcggatggtaggagtttgtttatttttaggcgttttttggtttggtttttgggtacgttaatggagaagagaaaagagagagaattggggggtgttcggaggcgtttcggggtaaggtagcggcgttcgggcgtttttgttttgtttcggattcggcggtttttgtttgcgtcgggcgattcgtattttcgcgggaggtttcggcgtttttcgatttatatgtgagtgaggtgtatttatacgtaaggtagcgtttgtcggtcgttcgtcgtcgtttcgcgtcgggataggggttcgttttagtcgtcgcgtcgtagttcggagttagagagtaggggagcgtcgcgtcggttagttatttgacgtagttcgtttcgcggtgtcgacgcgattgagtgttttcgtcggggagtagagtttttaatcggtttcgatgacgttttagtttttttagaggatcgatttatagtagcggtttttataaatcgaaggggaagcgcgaaaaatcggtttatcggggacgtatttaaatgggtcgtcgcgtattttgggggtgtaggtcggtgtcgggatcgcgcgggcgtgggtcgggggcgcgggggtcgcgatggcggggggcgcgggcgcgtttaaggcggtgggcgtttaatttcgttttttagatttgttttttaattttcggtgagtggtgtagttttgggcggcgtgtaaagtgtgcgacggcggcgtttatttttgttgtgcgtttttttatttttagttatttatttcgtttttttagcggcgcgcgttcgtcgaggtaggtgttagagagtcgaattcgaattatttgcgacgttcggacggagtttcgtattttcggacgagaaaagtgcgatgggagtgtaaagttttttttgttcgaagtagtaggcgcgtcggtgttacgggagtcgaggagcggtggtcgtggttgtggagtcggtgttcgaggcgt

SEQ ID NO: 11502 - DNA, 522 bp, synthetic construct
  misc_feature 1..522: note = Description of Artificial Sequence: Synthetic polynucleotide
  source 1..522: mol_type = other DNA
cgatatagttttcggcgcgtcgggtattgaggttttggagtatagcgtggggggtttggtatagatacgatttacgatcgggtcgattttcggttagaaagaattatgtttcggtcgttcgggtcgcgggttcgcggtgtatttttgtaggtttttattttgtttcggtagaggtttgtaagaattttgtgggtgtttttcggagcgggtagaggaggagtttagcgtcgaggtttaggcgcgtttcgttttcgttttttttcgtgtttttttttcgttgttttttttttaaaggtcgagatttggacgttgttcggtggtttcggcgggggttttgtttttggtcgttgtttttttgaattttaggtgagaagaataaaacgttttgacgttgttcggttttcggtttttggagaggacgggtcgtttttgtcgagagaattgtgcggaattaggaagcgttggtgttttttcgtttttacgggattaagcgaaattcggttttaaacgaagtaaagtcgg

SEQ ID NO: 11503 - DNA, 2260 bp, synthetic construct
  misc_feature 1..2260: note = Description of Artificial Sequence: Synthetic polynucleotide
  source 1..2260: mol_type = other DNA
cggtattcgggtcgaagcgtttggttcgcgttttcgcgcgggtttttttggaatcgtttcgggatacgcggttttttcgttgttggattttttttcgagttttagtttgttaggtagggattttttgggcgggcggcggggaagcgtcgagtcggcggtcgtttatatttttttttacgtagtataaaggatattcgtcggtaaatttttttcgtttttgattcgggtcgagtcgggaatttagcgttagttttgtttttggcggggttgaggttttttttatattttaggttatttggtaaacgttttgaggttgttattttttttgggtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggagtttaaggtttacgggttgaggtttgttttcgcgtggatcgtcgagagttcggtagattttttttaaggttttgattttaatatttttagtgttttgttaattatattttttgttttttttttttattaaggttatcgttaagatattttttttttttttttttttcgtcgttcgttattttttttgttttttttttggttttttttttagttttttgggtttttttttcgcgttgttttttagttttagttgtttttttcggtttatatttcggtagttttttttttttttcgttttcgggtattttttttttttggtcggtttttgaaatttagtaggttcggtttcggttattgtttttttttgtttgtttttatttggtttgtttttttaattatcgtttttttatatttttttttttttttttttggtaagggggacggggggaaacggggtattatattttcgtttttcgatttcgttattttttttagtttcgtgagtcgcgttttttcgttttttttaggttcgcgattttattttgaggttttttagatttcgtagggttttttacgttattaagtttgtttcgattttttttcgttgttttttatattttttgtcgcggcgcggtcggttagggatttatttcgaggtttagttggtgggggtgttggggtgcgcgcggattcggtatttacggcggcggcggcggtagtagtagtaggaggaggagaaagacgaggaggaggaggaggattagttgagcggcgttttttttttagttcgtagcgcgtattggttttttggggtattttcgggagagtattaagatcggagattaggcggcgatataggtaatcgttgttgtacggggttgggtttagtcggtttttagaggttagggtagggggaggtaggattgggaaggagggtcggagaagtggggtgtagagggcggggtagcgagcggttaggttcggaggaaggcgttttaggcgtttagggatgtcgtcgttcgggttgacgtcgtcggttttttttttcgttaggcgggcgtttgtagtcgcgggcgtacgggtttcgtttcgtttatcggttcgttgtcggcgttcgcggtgcgtttcgttttgtgtttttcgtagtcggcgtgtatttggtgtaagtaaaggcggttagttgatgggtcgcgcgcggattggttgtttcgtcgtttttttttttttcgttcgatttttttcgcggtttttcgttttcgttttcggcgcggtttcgtgttgggtattatttgtggatcgtttaataaaggcgtagcgcggcggggttcgggtggtcgggtcgcggtcgtcgttttttgtttaggggacggtaggttgcggttgggtagggaggcgaagcgtattgtcggtttttagtaaaagatagattaaaagaaaatatacgttcgtgttaggaggttagttaggtataatggggttttatttttttgcggcgtagaattcgggttcgggggttgagaattagatatagttcggtttggggttgtgggagttaagtttcggggtgaaattcgattttgcgttttaaaatatagggcgcgttttcgggttgtgtgtgcgcgttcgggggcgtttttcgtagatttggttcgggtcggtgtttttgtcgcgggaaggaggattcggacgtttaatttagcggcgaagtcgttttttattggaggaggtttttcgaaaacgt

SEQ ID NO: 11504 - DNA, 1502 bp, synthetic construct
  misc_feature 1..1502: note = Description of Artificial Sequence: Synthetic polynucleotide
  source 1..1502: mol_type = other DNA
cgacggtgagcgtggagtagttcgcggtttcgttgttttttttattttcggatttttagtttttttagagtggaggggtaagtatatagtaagtatttgatattcgttcgatttttgagttttttatttgtaggagttagggggtttgtttttcgtacgttttttgttggagggaggaacgagggaaggagaaaatttacgttgaggtcgttggtcgattattttttttatttttcggataatattgatgggttttattaaggaaagtcgaattttcgtatgttcgaggagtgtcggaggtggttgtgcgtttagttttttttggtaaagggttcgaagtattcgtttatttaaaggcggtcgagagttatattatttgtttgtatgacgggagatatcgaaacgttttttttgaacgcgatgataaatatttttttttatttagtagcgacgtgtacgtgatagtttttgggttttcgtaattacgtggaaatttggaataggtttgcggttgtatatcgttcggacgtcggggtttttgcgtttttcgttttttttgatcgcggttgggtagtcgagtcgtaggtagttgggggttttcgaacgtcgtttttgtatcgcgtcgtttttgtttcgggtttcggtagttttcgggttttcgtattgttcgtcgcgttttgtttatagggaagcgtttttttaggcggcggcggttttggtgcggatttttcggtcgtagttatgtgggattcgcgggtagttaggtgcgtagcggcgcgggaagtattggggtatttttggtttttcgggttcgttattttttttggcgggaggcggtcgcgcgcggggattggcgattttgaggtagcggtcgaacgggttcgttcggttatttttgtggggtttatagttatttaggtgtagattcgagttagttgcgcggggtcggtcgcgggggacggtttcggttttttcggttcggagggattagggtacgcgttgcgataggattgcggcggcgcgcggtttgtttagtttttatttcggtatcgaagtcgtagttttcgggtttattttcgtatttttaggggttttcgggggttgtcgataggtttttgattagcgagcgcgttttcggggtaagtatttttggcgggtagaaatttgggagcggagtatagcggtgtaagggaatcgtgttaggcgggaagggcggaatttgcggggaatttggagcgcgttggttttttttcggtagtaggaggtttttttttttgttcgttcgattgagggttgttgggttggtttaaattggattgtacggtttattagtttgggtttatcgagtttagggggaaggtagtagtagggatttaaggttgggaagcggagtttttagaagtttttgtttttgtttcggagcgttttcgaatcggagttcggagtttgttgtttgggaggcgcgttgcgtttttttttaattttttgttttcgtttcgcgg

SEQ ID NO: 11505 - DNA, 510 bp, synthetic construct
  misc_feature 1..510: note = Description of Artificial Sequence: Synthetic polynucleotide
  source 1..510: mol_type = other DNA
cgttttttgtcgggagttattcgttagtttttttttttagttcggttgcgtagcgtttttaatttaatttttggatttattttcgttttagtttttttcgtgtttagcgttttttgtaaatgattttttcggtcgggtgtttcgttttttttttcggtttttttcgcgtggtttgtttttcgttcgtttgcgttcgttcggtttttttgtttttgcgtttttatttgatcgtaaaggcggttagggtagttttcgcgcggtttgatagttacggtttttagtttgtttttggacgtgggaaattcgggtttatagcgtttttacgtatattgcggtatagattggcgttttttacggcgtttttattggaaagcgtttttgtggttttggggagagggcggttttattcgttatttttttcggagttgttttcgtttatttttatgggaggaaatcgtagggcgtgtgagttttcgatttttcgtttttattttttttaggatcggtcgt

SEQ ID NO: 11506 - DNA, 940 bp, synthetic construct
  misc_feature 1..940: note = Description of Artificial Sequence: Synthetic polynucleotide
  source 1..940: mol_type = other DNA
cgggtaattgttcgggttttgtttatttttttcgcgggtcgtatttgttaaggtcgtatcgttagcgttttttgtcgttttttttgtatagagattcgcgtttattttcgtattcgtattcgtattcgtatttgtttttatttcgcgttcgttttgcgtcgaggtcgcgtagtttgcgggtagtggcgggggtacgaggatgcgaatttaggcggggtcgggagttgggcgcgttttttagaattttcgttacggttaggtttgagttttatttatttacgtcgtattttttttttttcgtgggggtttatatggtcgtgtcgggcgcggtttcgcgggcgcggcgatcgggcgataacgcggcggggacggtcgcgggttcggttgtggcgtatcgcgagtcgaggcggggacggttaggcggcgcggggtagtgggcggcgtattttttataggtcgttcgggatgtcgtcgttattttcgttacgtttggatcgcgaggtttcgcgggtggtttagtagtttttggcggcgcgggcgaaggttcgttatttgttcgtcgtcgttgttttcgtgtcgtcgtttgtttttttatagtttcgtcgttcggttttcggcgtcgtcgcggttcggttcgttttagcgggttcgtaggacgttcgcgtatgcgttattttttgtcgcgtaggggttcgcgttgttcgggttcgcgtcgtttcgagttcgcgcgcgaatttacgcgtcgttgttgcgcgttagcggagggaaattcgcgagaagttattggattgttcggtttcggatcggtttttagaatcgttggttcggggtttttagttgtagtaaatttcggagggggcgaagtcggttaggtgggcgattttttttattcggattttttattcgttttcgtttttagtgttttttgtttgcgtttcga

SEQ ID NO: 11507 - DNA, 2718 bp, synthetic construct
  misc_feature 1..2718: note = Description of Artificial Sequence: Synthetic polynucleotide
  source 1..2718: mol_type = other DNA
cgttcgggtcgttttttttgtttagtttcgagcgcggagttgtttaggatttttagacgggtgcgagttattgtttgaagttttttttttttcgtcggaagaggatgtgtttaaaggatcgtcggaaattttggttgaagatcgtgtagatgatcgggttgagcgagttgttgtagtagtcgatttagaagaagaatttgaagagcgggtcgggtatttggtaggtttcgcggtagatgtcgtataggttgtagttgaagaagaaggggaattagtagagtacgaatacgtttatgattatagttagtataaaggtgaagcgtttttcgcgcgtttgggttattttgcggcggtatacgttgttgcgcgttcggcgtcggcgcgataggaagaattcgacggagcgcgagttggcgcgcgataggcggttatcgggtttcggggatttggaggcggttagcgttttcgatttagtcgttttcggtttcgttttttgttcgttcgtatcgttcgcgttttttttcgcgttcgttcgtcgtcgttcgttttgtcgtaacgcgtttcggcgtcgtcgtttttcggtcgttgcgttgttttcgttcggttttacgtcggcgggcgggggcgcgtagtgttcgttttcgtttgcgtttgtcgtcgcgtttagttcgttttcggtagtcggggacgtatcgtcggggtttacgggggcgcgtttttcgttgagcgtgcgcgtgcgtagtttggttattcggtagatgcgcgcgtagattaggtttatgatgaggtagggcgcgaagaaggagtcgatgtaggaggataggatgtattaggtttcgtcgttgaggtcgtattgcgggtaggcggcgtcgtcgggttggcggtagagcgagattagcggcgggaaggagatgacggtcgagatgagttatacggttacgatggtggttttgacgcggcgtggtgtgcgttttaggttgtattcgacggtttgcgttatcgattagtagcggtttaggttgatggtatatagatgtacgatcgacgaggtgtaaaatagtatatcgagcgttaggtatacgtcgtattatatttgttcgaagtattagtaggttatgagttcgttggttaacgagaagggtatgattagcgtggttattaggatgtcggtcgaggttagcgatattaggaagaggttttgtggcgcgcgtagcgttcggttggttagtacggcgattattattagtacgttgtttattacggtgaagacgatgaggaagtttattacggtagttagttttgttatcgcgttcgtcgagtattggtcgcgcggcggtttttaggaagttttcgaggtattggtaatttcgtcgttgtttttttcgttcgcgtcgttcgtattggggttcgtcgttgtcgttatcgttagcgtcgtcgttagcgtcggggacgttatggttttttcgcgagttacgtcgttttttttggagtcggggcgtagtcgcggtagttcgggcgttttttagtcggggtcggcgttcgtatcgtcgtttgttgttcgggcgcgttcgtcggggatcgcggcgtttagtagtcggttttcggtcgtggtggtttcgcgggcggcgcgtcggagagcgtggttgtcgggtttttcgtagttgtcgagcgtgtaagtgtagagtaggaggcgttcggagcgagcggcgacgcggttgcggggggaggggggtaggtttcggggttttcgcgcggtttcgttttcggttcggtttacggggagcgtttcggcgtcgagtttacggcgacgcggcgttcgagcgggcgtgtttgagcggtttcgcggtttcggagtttagtcggggcgtaggcgataggcggcggcggttcgggcgtttcgttttttattcggtcggttagggttcggcgcgtcggggcgtcggtcgtcgttttttcgggttttcgcgttcgcgcgtttttttcgtttttaattttattttttcgggcggggcgtcggcgtcgtcgcgagtttttcggttgttttcgggcgcgggcgtttttcgcggtttacgtttggtcgtgcggtcgtcgtttcgttcgtcggagttgcgtcgtcgtcgtcgtcgtcgttttgcgttgggcgcgagtgcggtcgtttgcgatcggtttttaatttgggtcgagttgcgtagcggggcgggcgcgcggggcggggcgggtcgcgggttttggggagttggtcgggaatcggagttcgcggtcgtttggtcgaatttgttcgcgcggcgtcggggaggagttcggggcggcggcgcggggcgcgcgttcggcgagggcgttttttttagggtcgtttgtagtttgcgggacggggtcgagcggcggtcggtttgggtggtgagttttagaagttgttttttttaagattggagtttttttcgtttttttcggcgtaggtatgggcgtaggcgggggcgcgtatacgcgcgcgcgtagtacgggcggttcggggtttatggtttgatggtagagtaatttttcgtagtttgggggaggacgcgacgttatttgcgtgcgtataggttttgtcgagtttagggttcggattagattttggatcggcgtttttcgttagagttattttcgtatttatttcggttttagttttttcggtttattttttagcgttgttggagtatgaattataattaacggcgg

SEQ ID NO: 11508 - DNA, 2661 bp, synthetic construct
  misc_feature 1..2661: note = Description of Artificial Sequence: Synthetic polynucleotide
  source 1..2661: mol_type = other DNA
cgcgggtaaagcgtgtttttcggtgggttataagtagcgttcggtttttttttttttcgttaagttgtttgatttttttttttaggcgcgcgcgtatatattatatttatatattttaaaattaagattcgttttataggatttgggaaaagaaaaagaaaaaaaagtttttaattattatttttttttcgtcgatttttttttatttttcgttttttttttagcgggtagttaaggagagttagaggcgggggaggggagagggaggagaagcgacgtaagtgggtagttttttagcgtcggcgaggcgcgggaggaggagaagtagtggggaggcgtagtcgtttatttgcggggtagggcgcggaggagggattcgggttgcgcgttttcgggtcgaggaattaggacgcgttcggagtttcgtacgcggttaagttcggggcgtttttttttttcggtcgggcgaatttaaggggcgtagttttttgttttgatagagttggtcggcggaggcgtgtagagcggcgagtcggcgagttaggttgagaaattcgagtcgggaataaagaggggtcggattgagtgtgtgtgtcggttcgagtttcgggtagaggtatttgggttcgaggttttcgttgtgatttttcgagatttcgtagtgttttttattgcggagttttcgcgtttgtcggtaaaaattttatttttggtaaatttttttttttttttttttttttttcggtttttattttttgttttttttttttttttagtagattaaatgagtttcgagaagaaaaatcgaagcgaaagggaagaaaataagaagatttaaaacggatatttttagcgtgggtggttttttttttttttttttttttttttattttttaggaagtggacgtttcgttattttttgatttttgtatttttttttggggtaaacggggtttttttgtttagatttttttttttttttcggaaaataaattattaagtcggtattcggggtaattatagtggagagggttttcgcggagacgcgtcgtcggatttttttttgtattttggggaggcgtgttttttttagaatcggcgtttttcgcgcgtaaatttcggcgacgcggggtcgcggggtggtcgtcggggtagtttcgtttagcgcgcgtcgcgtagacgttttcggagtcgttagttatcgtagttttcgtcgtttagtgtttttcggtttcgggggcgggcgtttgcgtcggttttcgcgaagcgggaaagcgcggcggtcgtcgggattcgggcgtcgcggtagttgtttcggttgtcggtcggcggtttcgcgttcgttcgtttcgttttcgttcgttgttttgttgtacgaatttttttaatttttttttttttttttatttttgagttatttttttgttttttttgttgttgcgcgggtgtttttatagcggagcggagattatagagtcgtcgggatgttttaatttttcggaggaggtggcggcggcgggggggattcggaattttgcgttacggacgagatgattttttttaaggacgagggcgatttttagaaggaaaagattttcgtcgagattagttatttcgaagaggaaggcgatttagttgatattaagttttttttggtgaacgagtttgaaattatttcggttagtaacggatacgaggtgagcgggtcgttgttttagtttcgagaggcgtggcgggtttttgggaaatttagagagggaggaagggaacgaaggcgttcggtcgttcggttgagggtttcgagtagatttttcgtttgttttggggtgtgtgcgtagttgggttttcggttcgtagtgtgtgtgtgtgtgtgtgtgtgtgtgtgtgtgtgtgtgtgtgtaggatgggaggtagaggggtagggtaatttattttaaatggattagtttagggggttcggtggttgaacggttggttcgcgggtaggaatttataatgtttcgttttcggtttttttgttgggttgaggggtgtcgtgttttaaagcgagtagggttgaataacgttattgataaattttttcgtgggacggaaaataaagtgtatacgttattttttggtagatgtttttgtaaaagtgcgttaaattattaaaggtttaggtggagacgagtagagttataggcgggaggaaggggaggcgggcgtgggttggggtaggcggggtcgtttttattatcggtgagtcgggtcgcggggagtaggtcggtcgatggggcgcgtattcgggttgcgggggcggtgcggggtttagtttttgcggttttagcgtttgggttagtagttgggagttgtgggtgcgtcgagtcgatttatcgtaagggtatattttggttgtatcgtttttaattttagttttttttaatcgttattatttggaaataaatttataatttttatttggggtttgggatcggattaggttttaaatttacgtagaagaaaggcggagaagtagcggaagtcgggtattagttttgtagggtggaaggcgttttatcgggttttttggttcgttgcgggcgatagagttggtaatttgagtagagtaaatagagatacgtgggtgttggttagagaaagcgcggagtagggtcgcgt

SEQ ID NO: 11509 - DNA, 801 bp, synthetic construct
  misc_feature 1..801: note = Description of Artificial Sequence: Synthetic polynucleotide
  source 1..801: mol_type = other DNA
cggttattaagcggttttttcgtgagtttcgtttaatgtttgtgcgtttaaattagtagcgttcgaggaacgcgttaattgggagaagtgaattgagggggttcggcggtcgttgaggaggggagcgcgcgggaggaggggcgaggagttcggaggcgggcgcggttggtagtttagagggttcgggcggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcgattttggttttttcgtaagtttttcggattcgggcgttttcggtttttttttatttatttttttgtcgggtaggttcgcgatttttcgtttttcgggtcgtttttcgtcgtattcggttttggtatatttttattatttagttcgggttcgttttcgttttgggtttattttagttttttagcgtcgtttgttgacggagcgcgggagttttaaggggtcggggttattcggtcggcgtgggtggtgttaggttcgggttatatttcggtatcggattcgagttttttagtttttcgagtaggattcggaggaatagaacgttaatttttttcgt

SEQ ID NO: 11510 - DNA, 311 bp, synthetic construct
  misc_feature 1..311: note = Description of Artificial Sequence: Synthetic polynucleotide
  source 1..311: mol_type = other DNA
cggttaacggtattacggaagtattagttggtatagaggttcggtgtaattatcgttttgtatcgtaaaacgggtttaggaagtttttaggagatattagcggtgttagaatcgagaaagtgacgatatagataatttatggatttcgcgtacgggaaacgtttcgttgggcgttaagaacggtgtagtaattgaaaaatcgtttagtgggcgttattggtaaaagcgttgttgtaaaatcgttagtttcgtattagaagtagagtcgttagatagaattcgggatttgaaattatcgaagcggagatcga

SEQ ID NO: 11511 - DNA, 1048 bp, synthetic construct
  misc_feature 1..1048: note = Description of Artificial Sequence: Synthetic polynucleotide
  source 1..1048: mol_type = other DNA
cgttttcgtaaatttttcgggttttacgttttgcggttattacgtttgatagagaaataattagtattagcggttgattcggttgttcgggttttcgtgtaggcgggcgggagcggataggttttggtacgtatgcgttcggggcgggattgcgttttaggtttgcgcgttgtcgttagattagcgggggggcggggcggcggcggatacgcgttttaggcggtagtcgcgcgagagggattttgtgtttcgttgatttttttcggggcgttttttttcgtgtcgttttttttttttttcgtcgcgtttttgcgaggcgttttttattcggtgggatcgattcggggggatggagggggtacgtttttataatttttttgggatttcgaagagacgttcgcgtgcgatttgagacgtcgttttcgtcgagggtttatgggcgcgtttttataggcgggtagtggacgtgagggcggcgagcggcggggtcgcggcgtttaggagggtcgcgttcgggttcggtttcgcgtaggtcgcgcgcgcgcgttttcgtcgtcgttcgggtcgcgttcgtttcgtttttaggcgtcggtttcggagttcggttcgcgagtagcggcggttgtcggagggacgatgagttgcgcggggcgggcgggttttgttcggttcgtcgcgttcgttttgttgatttgtagtttgtggtcggtacgggtagataacgcgagttaggagtattatacggcgtttattaacgtgacggtgtaggagttcggtcgcggcgtttcgtttacgtttcgtatcgatcgcgggcgttacgggtttgatttttttaaggtcgaggttcgcggttaggtgttggcgtcgttgtttttttacggaggtgagtgtcggttcgggggcggcgggcggtggtcgttgtatttcgcgtaggcggcgggattagggttttcggtttcggttttggttttggttttttcgcgttgttcggtcgatagttttagttagggtcgaggttttcgtcgtggatagttcggtttgttttcgt

SEQ ID NO: 11512 - DNA, 301 bp, synthetic construct
  misc_feature 1..301: note = Description of Artificial Sequence: Synthetic polynucleotide
  source 1..301: mol_type = other DNA
cgggaagtagtaggcgtacggtcgtttggatttttttggaggtgatggtcgagcgtttgttgtaatgcgttaggcgggaagtttcgtcggcgatgcgttcgaagatgtcgttgataaaggaatttatgatttttatggttttagaggagatgtcggtgtcggggtggatttgttttagtattttgtatacgtatacggagtagttttttttgcggttgcgtttgcgttttttgtcgttttttttttgcgttttggttacggtttttttggagttttttttcggggcgggagcggatttcgt

SEQ ID NO: 11513 - DNA, 1395 bp, synthetic construct
  misc_feature 1..1395: note = Description of Artificial Sequence: Synthetic polynucleotide
  source 1..1395: mol_type = other DNA
cggttttgtgaggtttacgcgggagcgcggaggtttttgggttttagggcgtcggtagatggtttgtagcgtatcgttcggttttcgcgttggttacgttcgttagcgttatttttttttttcgttttttatttttaaaaattcggcggtcgagtagtttcgtatttcggagggttttcggtgtaaaattgagtgggaaagagaaaggggcggagagcgacgagagagggaaggtggggaagaagagttcggtcgttttcggtttttttcggcgagttttgagtttttagggtttattcgtttttttaagtcgaattatagaaattttttattgttatgttaatgacgagaggggttgtggggagagggtttcgaagatttttttggaagaagggaagtttttttttttgttttcgttttttttacgtttattcgagttttttttagttagttttttgcgtttttttttttttatttcgagtttgaagagtcggtggtttagtttcgttttttattacggttttatgcgttttttatagttttacggttttttagtttagttttagaatagaggaggtggtttgggaattcggggcgcggtgttagtcggatttttcgtttttcggttgggcgcgttgcgggttgggtcggcgtatttgcggttattcggcgagttttggtttattgattttcgtttcgagagagtcgggagtttttttttttttttatttttcgttagtttattttttattgaacggtggggagggggcgggagcgggggacgttttttagtttttatttttcggaggtttggcggggcgggtagcggagtcgggcgcgcgtagaacgtagtttttgttttttttcgttttagtattttaaatcggtttttgtagtcgtcgtagtagttgtcgtcgtttaggttgtttgggggggcgattgcgcgttatttagacggcggagcgtcggggatttaaatgttattaaaacggtgatttattattgcggaagtcggtaaatttttgtaggaggtttagttattggttgatatcgttacgtgttttttttttagcgtttttcgttttttcgtttttttttttgcgtattgtatatttatattatttttttttttcggttttatggaggaagtgagaaagttggtatagttacgtcgggtttcgtaggattaggttatttagtgatagatggataatgtaagaatgaatttttttttggaatattttatatttagtagtggcgattcggggatttgtttagttcgagtttatttttcggattataggattataattttttagtcgtgcgcggttagcgttaatagttgcggcggcgacgatcgttttttagtgggtaggggggtgtagatcggttcgt

SEQ ID NO: 11514 - DNA, 766 bp, synthetic construct
  misc_feature 1..766: note = Description of Artificial Sequence: Synthetic polynucleotide
  source 1..766: mol_type = other DNA
cgatttcgttttatgtcggtcgtatcgtgttttttttaggttttattagtatttgggttgttatggtgagattaagatgggtttcgtttataattaacgatgttatttcgtagcgagttaaagttattttttattttgggttcgttacgcgatttttgtcggttttcgttttacgcggttttagtacggcgttaaggtttcgtttataaatcggtttcgttttttcgtgttcgggttcgtcgtttattagacgtcgtttcggcgtagcgagttgagggtacgtttatttttttttcgggtttttagtttttaaggttttagtataatgttttaggaggaagattttaggttttttttttattcgacgttgtttttgggcgagtcgaggtttcgtttattcgtcggttcggttttcgtttttatttgacgttgtttttgtgtagcgagtttaggttcgcgttcgtagtcgtgttattttcggagttcgtttttttgtttaggttttggaagcgttcgcgggtcgttaagttacgttgcgagttttgtttaggaacgtttagtcgttcgtcgaagtttagtattttcgcggcggcgttataggtgaatagtatcgggaagtagtcgtggttttgcgcggagggcgggggttattggagcgtcgcggaggggaaatcgaggtcggagggaaggttaggcgggcgtttggtcgttcgggaggtagatgttagtttaaggatatagacgggttatagcgagggaggttcga

SEQ ID NO: 11515 - DNA, 691 bp, synthetic construct
  misc_feature 1..691: note = Description of Artificial Sequence: Synthetic polynucleotide
  source 1..691: mol_type = other DNA
cggcgattagttttcgtagaggcggggttcgagtttttagttagagttttaataagtagtcgaagaacgcgggtagaggtttcgatatggttaggagagtacgtcgtcgttcgtaggtgttcgggtttcgtcgagatcgggaagaggtggcgtcgttagttttttttagatttaggggtggttcgataggtttaatttcgtttttcgttttgttttttcgttttttttttcggcgacgttcggttcgcggttggtcggttcgtcgcgcgtttcgggacgagggcgggaggcgagcgcgttggtcgtcgcgtatttattattgttaacgtcgtcgtcgcgttttttttattttatttttttttttttaggagaatttttagtttcggtttttttcgtttcggcgtttcgttacgtgatttcgggtcgttttttatacgtgatcgtttttttttttttttttattttcgtattcgttttttttttagttttttgtttcgttttgttggtcgttaggtatttcggggagaggtcgtttggaggcggggttttaggttttatttttcggagggtggagaggggcgggtaaattacgtcgagtgggcggggtttgaatagaggcgggttcgcgggttttttttcgtcgttttttcggttatcggacgagcggtttcgtgttcggtttttttatcgt

SEQ ID NO: 11516 - DNA, 1024 bp, synthetic construct
  misc_feature 1..1024: note = Description of Artificial Sequence: Synthetic polynucleotide
  source 1..1024: mol_type = other DNA
cgcgtatttattttgggttgtggagtttagttggtcgtcgttcgtttcggttacgcgttgcggttttacgggttcgggagcgagggtttcgttcgcgtcggatatgggtcgtttcgtcgagttcgcgtcgcgtcgttgtcgtttagttcgtcgttcggtagggcgtacggaggaagggttgtgaggtgttgggtgtagggaattgattgtttttggcggaaaaatatataaaattaaaaaaaaaaatgtttttagagaagagtatattatttttgcgggacgttttttttttttttattttttttttttaaattttatttcggggaagttttgatttgaaatttgcgaagaaaattgttatagcgtaagttgatagcggcggggttttaggggttcgaggtggatttagcggggaggggttggaaagagagatcgggtttgggagaatttcggggatggggattaaattttttttttttttcgttcggagattattatttattttcgtattttttcgtagtcgttttaagtttttttttttttttttttttttttttttgtttcggaaagttagcgagttttcggtagcggtcgtattttcgtttcggtggtttgacgacggcggcggtcgtttttgcgcgttttttcgttttttttcggtttagtttagacgtcgtagtggcggtaattgcggtagcggtggcggttttgatttcgcgtatttcgttttttttttttagttagtttattttagtcggtttttttgcgagggggttttttttttttttgtttttttttttttttttttatttttataattttgaaatatttttttttttgttgtttttttttattatattcggatcgggaaggtttcgaatttttggttagcggtttcgatgttgggagcggcgcgattcgggttcggtcgcgcgatttttcgcgttttgcgttgtttgggttaggaggttagagtcggtttgggttggttcgggttttttattcgggcgttgcgttttttcgg

SEQ ID NO: 11517 - DNA, 1339 bp, synthetic construct
  misc_feature 1..1339: note = Description of Artificial Sequence: Synthetic polynucleotide
  source 1..1339: mol_type = other DNA
cgtcgcgggttttggcgagtaggtgattacggatttttggtgtttgttgggcgagacggtgaagtaatttttttttcgttttttttttcgtttagaaaggtgtaagattcgttaaatcgtgcgttgtatagcggcggtcggagtagacgcgggatggtcgcgcgttttttgtatagtatagaggggtagtcggagagtttgggaaaggtacgagcggggaattagagtatagggtgcggattagaaagagtagacggttagtcgggcggggaaggaagttgtcgagttgtaggtgtggaaggggttgttttaggtttatttttggtagacgagggggcggggagtcgcgtcggggacgaggagattgcggatcgggcgcgttttttgcgtagtcgttcgttcgcgtgtttaagtttttcgggaatggttttcgtttaggggtttagttcgtcgtcgttagtttcgtagagtttgtagttgttggggttcggtagtcgttagggggcgggagttgcgtcgcgaataatggtcgcgtttggtcgcgggttggcgggaggcggagtggaggtagagtcggtgtcgggcgcgcgcgtcggtcgggcgtgttggggcgcgggagcggttgcgtaggcgggggcgcgcggcgcgagcgcgggagggcgcggcgggagcgtcggggaggcgggcggaggcgggcggaggcggggggcggggagttcgaggggtggaagtcggcggcggtcgagcggggttagttttttgtagtgtttgttaatgttggagtcgtttgtaaagtgttttcggtaagaaggtaaatatttttatcgggggcgttcgggagatttcgattttcgcgtcgtcggcgaagaaggtagagggcgttggggagttttgtagtttcgtagtacggggaattcggagaaaagtagtttttttcgcggttttttttttttcgcgtttttttttttatatcgggttttcggggtagtagcggggaggggagatcggcgggggagggaggatagggaggcgaaggaattggggtggggggtgcgtgtgtggtggagggggtgggacgatataggtgttttgaggggaggagtcgggaggaaggcgaggaggtcgggttaagtgggggtgcggaggtcggggagataggaacgcggttgcgggcgcgggaggttggggttttagggggtcggggtggtagcggtcggaagagaggacggcgagtgtagttacggtgtggttgcgagggagagggagcgtttagagtagggtaggggagggcggttcggggagggtttgcgggaaatgggtttgggggcgttggaggcgg

SEQ ID NO: 11518 - DNA, 2273 bp, synthetic construct
  misc_feature 1..2273: note = Description of Artificial Sequence: Synthetic polynucleotide
  source 1..2273: mol_type = other DNA
cggtttttagggatcgaggggttcgtagagtgatttattttattttcgggaagttgtcgggagtttcgcggattcgtcgcggtttttagtttttatgtgtaggggtttcggggttggggtttggttagtgcgacgtttcgttcgcggttatttatagttgttgaggaatagtagtatcgcgaagtcgagcgtggcggtggttagtaggattaggtaggcgttgtagggtattatgaagtttcgtattagtagggaggcgttaggcggttgtcgggtgtttcgcgttagcggtagcggaggtatggttcggggtttcggttttgcgttttatttttagagcgtgggggttttttacggggtgtttttgggtttttttagggttgttcgttttattttgggatttttggggcggcggatagtagttgtgtttttagagtttatttagttatagttttgggggtgttaggtttcggttttagttttttaggtttatcgtgggaggagggtagaattttttcggagtagaaattttaaatgtgggtttcgaggtaggcggaggagggattgggagttcgtagttatttttgttgtttatagttttttcgggttggtcgttagcgttcggttttttcggagttttcggagtcgcgtaggtcggagaggcggtgcgcgcggtaggtgcgcgggggtcgggcgtcgagggtttgttgttttcgttttcggtagaggcggaagcggcgataggagcgggtaggtaggaggggcggtcgcgtcgggagcgagaagaaagcgtcgtttgcggaggtcgcgtcgggtttcgggttttttttagtttttttcgttttcgcggggttggggaggtgagtgaggggcgaagacgtcgcggagggagggcgggagtagagataaaggaagtcgtttttagggatttcggcgttcgcggggagttttagaggatcgggcggatgcggacgggagagcgtcgtataaaagggaacgtcgggtaggcggggtcgggggtgtttggttggggttggggttggggttgggttcggggtcgggagcgttggggttggggttgggtcgggattggggttggggtggttgaggttggggtcgagggtgggtttgaaggtgttgggattgggggtgggattggggttgggtttgggggcgttgaggttgaagttggggtcgggggtgggattgggggcgttggggttgggtcgggggtgggattgaggttgcgggcgtttaattgggattgagtcgagggtagcggtggggttgggtcgggggagtaggggtcgcgtcgggtagcgtcgcgtgttggagcggaggcgggtgcggtcggggtaggtcgcgggaggaggaagcgtttggggagtaggagttgggtcgggcgggttcgcgtttcgtattcgcgggggtgaatcggagtcgtcgtagggggttcggggggtcgcgtgcgatcgcgtgtgcgcgtcgtcgtgcgtgtgttcgcgagtgtttgcgttcgcggtttcgttttggcggggcgtaggtgggggagggttttaggtgcggcgcgagttggagggtggagtgaggtgagcggtttagaaatcgtttcgtttatttttttttggggattgatagtggtttttttagtcgtcggcgttttcgattttcgcgcggggcggggttatgtaaatgagttttatgtaaattgcggcggggattttttgcgggttcgtggggttggaacgtttttaagaggtcgtttcgggaacgttcgggttttgacgttattgcggttcggggcggggaatgggggtttgggtttatttgggatttttgacgcgtagttcggcgtttttatattcgttttcgtaggtcgtttttttttttggtcgttgtttagtcgggggattcgggggtaagggaggggttcgttcggttcggtgtgtgtattattttttagagtttatgttaggttcgattattttggaggttagaatttttcggcgatcgtattttagcgttttcgtatatttttggttattcgtagtttttggaagggatttttgcgtatttattattttgtttttttttttgtttttgtaatgatcgattttattttttaagttttagttttaggaaagtaaggattcggcgttagggcgtttttgtttcgttagttttttttagtatcgcggattaagttatttgttatattcggttttatttattttgtagacgatagttgtcggtagttattagtgttatcgcgt

SEQ ID NO: 11519 - DNA, 5586 bp, synthetic construct
  misc_feature 1..5586: note = Description of Artificial Sequence: Synthetic polynucleotide
  source 1..5586: mol_type = other DNA
cgggtttagtttcgtatacggattcgttaggagtaggtggttagtacgcgttgttggcggcgtattacgtaggtgtaggtgtttttattgacggcgttggcgatgatgtttaggtgcgtttcgtttagggttaggtagtcggggtaggagaattttaggggtttttggtttttgtattagttgtaggggggcggggcgttttttgtaggtatagtttttttcgttgtttgtttcgtatttttgttttaaggtcgttcgcgggttgtttatttcgaggatcgttcggggcgtttatttattatatttttttttttttgtggaggattttttggtcgtagcggaaggttacgtttttgttttcgggtattagtttggttttggttttggggggcggtggggtggtggttatcgtggggaaggggaattttgtttcgggtgggggaaagagtttcgttagtgtttttttagtttcgattatggttaaggtttagtttttacgtagttttgtttcggtttcgtgggtattatcgtagtagaagtcgtagttgttggggtagagtttttttatgagtcgtcggcgagcgtcgtagaagttttttcgcgtttaggacgcgtatacgaatagtttgtcgaggtattttgtcgggagcgtggggagtacggtttggtttaggatcgttcggttttcgttttttcgttcgataaagggatttatcgtagagtcggtgtagtttttatagttcgttttgggataacgttttttagtcgcgtagcgtggcgtttaggtgtatgagcgttcggtcgtgttgtgagtgtattaggtttagcgcgtggtcgatttcgtgggtcgttacgtgtattaggttcgtgagttatacgtttgcgggtttcgggggttagcgtttgggagtttcgggtttagtttcgtcgttcgtgggttagtttttcgaggttcggtgtatttgttggagcgtagtcgcggagtcgttttcggtcgtagttacggaaagataagaatgttttgggtttaggcggtgagttcggtttttaggaatgtagttttagttttcgttttagaggcgtagggggatgggaaagggagtttagggttgtcgggatgggggtttttacgggtttttttttttgtttgttagattttagtggtagttattatttcggaaggttttttttgtcgtttgttttaaagttcgatcgcggtagtttattgtgttgtagaggagaggtttttaggaggttagtttggacggttattttttttttagttgtagcgcgtggggtttaggatttagtattcgttgtcgtcgaagtggatgtcgtcgtgcggggggaagaaggcgtgggttagttttttcgtggggtcgtcgaagtagtggtgtagcgcggagattaggtagttcgtgtggttgatcgggtagaagtttggggggagtacggggttgagaggtcgggcgcgtagggtcgggtcggggcgggggcgggcgtttatttattcggaggtcgttgggttgttcgggggttatttcgcggaagttgaagggggatacgtcgttttatatgcggaaggcggtagttagggttcgtcgcgtttttcgcgggtttagtaggtttcgcgggaaggagaggattttgtagggagagtgagtttagcgggcgtcggtcgcgttttttttttcggggtttagttagggcgtatttgtaggtgaggttgaagtggttttagcgtagtttggttggagttagcgtgtagcggcgtttgcggggggttagtgggttcgggattcgggtgggggggatcgtcgagaggtttagcgtagcgacgtttttttttagggaagaaagcgtgcgtgggaggtatcggtgacggtttttaggattaaaaattgtcgcggaaaatggattggaaggaaacgggggtgggggtgtttagggttgggagcgggcgtggcgggttttgtttgtttgtggtttcgggttttttaatttgagcgttttgttgtacgtttttgggaacgcggtttagtggaggggaaggggttgaatagtagggcgaggttttttattttttttaataattggatataggggcgtttaatttttcgatttcgggacgtatattcggatttttaaatatttcgtatatttcgtatacgttttgcgggtttttcgatagattagatttatagacgtgaggatttttttaattcggtatttggtttttttttcgtcgtttatttgcgttgcgttttaggtcggtatcgtcggggtttttagtcgggttagtagtattagcgcggggaggaggtatagggcgattagcgcggttttaagttagcggcgttcgacgtttgttttcggggttttcgaggggatacgggtttcgcggtttatggtagatttgttgtggggtttagggttgtatggggtagtaaggcgcgggggttcgggtcgtagagttttcggggaggattcggaggggaggtagtggttcggcggttcgggttatagttcggtgtggtgggggggagggagacggggcgggagagggggtaaggttgtttttgaagggaattagttggttcgttcgttggtcgagttgtttgttgtttttagtcgggggtatggggattcgcgtttcgtgggttaggggtagaggtttgggtatggtttgttgggcggggttttcggaggggggagcgaagagggttttaggtagttcgggaagggtagcgttagggttttcgtttaggaaagggtagtagtgggggtttttaagtttttattgttgggtagtgagtgatttggtggttttttttttaaatggaatttttaaaaaatttttgagttttatatgagcggagtttttattttggtttaggtagttgagttgggtcgtaggagacgcgtcgttcgtttgatagtgttttcgagagttgggaggggatggtcggatggggacgtggtagtgagtatggggcggtggagggggaggcggggagggggtgcgtgggtaggtaagggtcgcggagggtgttaggttgcggggcggagggagggaatttgttagggtttttcggggagtcgggaaggggcgggttttggttgcgggaagtttcgtggagggtagcgcgtgaggtggagggtgtgtggtttttaaattttcggttaggttttagtaaaggggagagggagacgggagggacgggaaacggagttaagcgtcgggtttggaggtttggatcggttttgattgggggcgggggcggggagttcggagatttaaaggttcgacggggcggtcggcgtttaggcgcgagcggttttgggttgggatcgagatcgggtatcggcgtttcgcggggcgggggtgggggattgggtagaggagtaggagatttcgagttagatcggtttgtgtttgtttcgttttttttcgtttttcgcgtcggcgtcgggtttagggtgacggtagttcggttaacggggttagcgttaagtagttggcggcggtcgcgggcggtttttggaaagcgcgagaggttgggtttggtcgtcgtatttgtttcgatatcgtttttcgtttttttagttcgttatttcgtttgcgtgcgttcggtttttagattttgtttgggacgttttttaattaattttttgttgggacgggattttatagttttggggagtgtcgggttttttggattagagcgcgagttttcgcggtcgtttttaggacggaagagcgaggggggttcgggggtagatataggagttttcgtttcgtcggattcgggtttggggggcgggaggcggtcgtgttcgcgtttgaagggtgttttggttcgaaggtcgtagttcgggcgggagtttggattcgagagtttggggcgggcggggcggatttagggaagggtttttttttttcgtttttaggttcgttcgcgtgtttcgaggggaggattttagaggcgttcggttttttaggtagatagtagaggtaacgttcgagaatttttttttttataaaatatagggcgggggtacgcgaaggtagttcgggcgcggcggacggcgcggtttatacgaagatttggatgcggtcgcggatgggttggcggtagatggggtaggcgttgagcgcggagtcgtagggggcgtatgcgtcgtggtcgtattggaatacgaggcggatgtggttgtcgatgtagatggggtaggtgatgcgtttttttatttgtcggtagcggttttgtagtttttttattagttggcgcggcgggtcgggggcgggggcggcgttcgttattttagagtcgtttgcggggtgggggacgggtgtgagttgggaggtcgggtgggggaatgcggggagtagggagttgcgggggggcgaggttgggggcggggtgttatttgggacgggttgtgatttgtaaggggggttggcggggtgggtgatttggaggtagaggtggggttcgggtgcgggtaggaggtgagtcgtggaaattaggtataaggtggtgtgcgggttggagttagggttgtaggtgggttgtgagttgggtcggggtgtgatgggggggcggtgttttgggtgggttgtgatttggggtggggttatggagggagtgtgatttgggaggggtcgtgaaatttagcggggttggggtgtgatgggggaggagggtgttattttgaggcggggttgtgggtcgggtgtgatttggagtaggtggggttgggggttgggggttggggggtcgggtgtgagttttgggagggcggggtgtaatttggggaagggttatgggcggaagtgtgggagggaaggggtgggggacggggattcgcgggttattagttgagtaggaggcgtgttgggggcgtagagttttatttatttgggcgtagttttttgttgacgattatttggtatttgatgtatttttttattttgcgcgcgtattttgcgaagaggagagcgcggttggttgcggttttattagtcgggtttttttatttcggggttttttatttatttttatatacggtgcggtgttggtacggcgagaatagtattagtagcgttagttcggagtatattaggtatttagcggtttcgggtttcggcgcggcgtttacgtgtaggttcgttacggtgttgggggtttcgagcgtttgtttggggttcggggtcgcgttttcgttcgtttgtcgttttttgtagggggaggaggcggtttgagaggggttcggaggtcgtcggattttattttcgtcgtttacggatttatcggaagcgttgggcgtagttttgaagggttttgagtacgcgattttcggcggttaggtttagcgggtttcgatcgcggtggttggtgtagtttacgtcggcgttttttagcgttaggaagtaggcgatcgtcgcgtttatcgttagtttcgcgttgtcggggaggttcgaggtttgtagttgggcggtaggatagacgtcggtgagggcgggcgtcggggtaggttcgagggaggcgttttttggtatttggtagttttagtagtcggcgt

SEQ ID NO: 11520 - DNA, 1264 bp, synthetic construct
  misc_feature 1..1264: note = Description of Artificial Sequence: Synthetic polynucleotide
  source 1..1264: mol_type = other DNA
cgcgggtgaatcgagcgttttttcgtttttttggtttgtagttagagatagtttttcgtcgttcgatttcgtattcgttgaggagcgtagggttgtgttcgtatttcgtttcgtatttgtttgtttagggaaatcgggagtttcgcgggtttcgtcgcgggaaggaggcggtattgggttttaaaaattcgtgttgaggagaagtcgagcgttttaatatattcgtcgtcggtcgggtcgggttttcgcgcgtttcgacgtcgttttagtttcgttcgcgcgcgttcgatacgttcgttttcgttttcgttttgatatagatatacgcgcgcgttttcgtattattttagaagtttattcggttcgcgcgcgtatttagatacgcgtggtttatattcgtcgtatacgtttttcgtataaatacgcgcgttttttacgttttcggttattttagatatacggtttcgggttttacgtaggttcgggcgtcgatatattttcgcggtatggatacgcgtgttttttatttatttttcggttaaacgtatttttttttgtagttttttatttttgttttttatatttattttttattttcgttttagaaatacgttttttatatcgggttcgtcggatttttatattttttattcgcgttagaaacgcgcgtattttcgtggtttttttttgtcgcgcgtaaatacgttcggttcgcgtacgttttttcggtttggtttcgtatattcgcgttagaaatacgcgtggtcgcgtattacgttttcggttcgcgagtacgcgtgtttttacgtttcggtttcgttttcgtttcgcgcgcgttttcgttggtcgtcgttttcgatcgtacgcgtttttcgtttagtttcgcgtcgtcgcgtatttattcggatttgttgagttcggtttttgttcgttaggtttgcgtcgagtcgtcgtttattggttttcgcgtttcgttcggtttcgttcggttcggtttagttcggtttcgcgttcgtttagttttattcgtcgtagttggaacgattcgcggggtttcgggtatcgcggttttttcgttattgttcgagtgcgtcgttcggattaatggcggggcgcggcggtgagtttatcggattagatttcgttttttaggtcgcgtggtttaatcggaggatgcgacgttattcggagtcgggtagaggttggtgcggggcgcggagtcgttcggcgcggggattgcgtcggaattgcgttcgagtcgcgt

SEQ ID NO: 11521 - DNA, 716 bp, synthetic construct
  misc_feature 1..716: note = Description of Artificial Sequence: Synthetic polynucleotide
  source 1..716: mol_type = other DNA
cgacgggcgcgtgaggtttagagaggagtagtttcgggattcgtttttttttttgtttgattttggttaggaaaaggggtttggagcgttttcgggtttcggaaacgcgggatttttcgtaggtagtcgagtagggcggtcgtcggggttatcgttgggcgtcgtcggagttttaattcgatttatgtgcgggatttcggttttttgtgcgggagttttcgttttgcgcgtcgggttttcggttttcgttttcgggttgggattcggtttttcgtcggttttattgagttttcgtttcggatttgtcgatttttcgatttcggggagagagattaagagattgggacgtaaagggcgtgaggatcgtattttttattcgtaggtttttttaggggcgtcgcgtcgggggtttcggttggcgatcgagtaggtttcggtcgagtattgtcggcgttgttatttgtgtgtatcggggatagggacggagggacgcgatttttatttattcggttcgtttatttgggtcgttcgcgtttcggcggtttcgattcgacgttcgagttagcggagttcggagtcgttgggtttttcgtttttttcgttcgttcgtttttttcgttttttcggtttttttcgtttcgtcgttttgcgtcgttttattataaaaggtgaggttcggggggagggggcgcgggattttcgtttcgcggaagcgg

SEQ ID NO: 11522 - DNA, 619 bp, synthetic construct
  misc_feature 1..619: note = Description of Artificial Sequence: Synthetic polynucleotide
  source 1..619: mol_type = other DNA
cggtggatcgtttgggcgggtaaacgtttttttacgttggcgggtaggatttgaattcgggtttttagggttttgtaggtcgttattgttttcgttttttttttgttttcggtttttttcgtttggtttgtcgcggttcgtcgttttttttttttttttttttttcgttcgttttttgttttttgtttttttttttcgtttttttttattttttgtttttcgcgatttttttttttttttcgatttttcggcgtcgttttttttttttttttgttttcgtagtttaaatacgcgatatttggagtaatagtagtcgttcggcggtttgggttttattataggtcggtttttatcgcggcgtgtattatattattttattttaaagaattcgtagagaaattcgtttcggtcgataatagaaagtaaaaatatagttgatttttattagggtttttttataggtttcgcgtgaggtaatgaaatatggaagcggtgagatatgtaatgttttattaagcggttttagttataacggcgtgtatgttaattacgtttgtaggttatcgttcgttttcggttgtcggattatttagcgcgttttttttcgagtttcggacgg

SEQ ID NO: 11523 - DNA, 293 bp, synthetic construct
  misc_feature 1..293: note = Description of Artificial Sequence: Synthetic polynucleotide
  source 1..293: mol_type = other DNA
cgttttacggggtaaatttcgaggtttagtttcgcgtgggagtcgtagcggggcgggttcgttttgggttgggcgggtttttttagcgtagcgttgggggttgcgggttttttagtagtcggagtagtattttgagtttcggttgttggagcgttgggatttttggttgtcgttttcgtagtagtagtaattattatttcgttgtcggcggcgtttttttgggaagtagtagtaattggtggagttggagtcgtagtagtttgagtcgtcgtagtagtttttgtcggagtcgt

SEQ ID NO: 11524 - DNA, 2748 bp, synthetic construct
  misc_feature 1..2748: note = Description of Artificial Sequence: Synthetic polynucleotide
  source 1..2748: mol_type = other DNA
cgaatcggtttttttcggtttcgtattttttagggtcgttcggcgagtttttgtatgttttttattcgttaagttcgttattcggtttcgtttttttatacgcgtattggtacgtttttttttagtttttagcgggcgggtagtttgtcgggtatttaggaagttcgggtttttcggcgtcggaggatttataatttagttatcgtaataagttcgcgtagttaaagtagttcgtttgggtattaggttttatcgtttttgtttcgtggttttaagagggttcgtgttagttttcgaggtatggtcgtttggcgttcggtatattttagatttatttttttttgagggtaggggtttttcggggagagaaagagtagtttcggggttcgtttcgggtttttttgtatagattttttaggtacggagaataatggaatagttttgcgcgttttttttattcgagtaagttttgttttttttttttcgtttgttcggtttttattagttatagggtaaaggtttttcggttaaataggagtttcggcgttaacgtttagagttttcgatacgttttaaaagatttgcgggtgtaggggttggggttagagtcggggttgaggtatcggatatgcgtttagatgcgtatagttggtagttcgttcgttttcggttttagacgttttttttagttagaatttttatatcgcggggaaattcgatttgcgtttttattcgggatttatagaggaagtggagttttagttgtgtttcggggttaattagtttttatatttgtttttttatatttgttttttagattcgggttttcgttggacgttttttttgtaatgcgggatgtttttgttaagcgtaggttatattataacggaggtttttattagttttaggttttgttatattgggattttggttttatttttgagagtttgtaatttttttattttttattttattgtttagttttatttcgggtaggttagagtcgagttcgggttttcgtttgtaatgtttttaagaaggtatatttgagttatgcgtatttggaggtgggttagtttagtatatttgggcgtaatgtttattatagtttgatcgtgaataggagggtttttcgggaaggcgtaaggggagggggtttcgttttttttatattttttttagtagttggttaggagaaagttaggggcggggcggggcggggcggtaggatttatttagtatttggttgaagagtagttgttttaggttttttagtacggttattattagttcggggtttattttgaggaaggcgcgttttttttggtttttggtagaggggataggtttagagtttttttgcgttttggttttgttggagagtagttcgtcgttcgatttgttattttcgtttacggtcgttttaggcgttttgttgagcggtttgattttcgtatagggttttcgagggattcggttcggtttttttaggttgggcgcgagcggagttaggggggttttggcgtcgttcgtcgggttgtttttggtttggaagagcgagtgtttcgatttggatagcgttttggatattagcggagttttacggtttttggattttattttgtttaagtttttgggcgttttggttatatcgtcgttttattcgggtttataaagttgtagttttttttcggagttcgtgagaaaagagaggttggtgagtgatttttgtttgcgtaggttggaggcgggcggttcgtcggggatacggttgtttacgttgtcggatttgaagatttttagtttagtcgcgttggttttggttatgtcgtcgtcgtcgtcgggcgttttggcgcgtttgggtagtatgtttttgtcgttcgtcgttgtcgtttttttgtcggcgtttcgcggttcgttcgcgttttcgtcgtcgtcgtcgttgtttagttttatttcgggttgtacgtttttgacgttgttgtttagtattttgttcgcgaggagcgtatggacgattcgcgcgtttgtaggtacggggggagggggtagggggcgggagcgtaggaggaggaggcgggggaggaggagggggagagagaggacggaagaaatcgaggaagaaggggagagaagggggagagagcgagggaggagggagagaggtaagtcgagggcgtaggggaaagaaacgcgaggaaggaagtcgggaaaaaggaaagagtagggaagtcggggagcgatagggcggggtcggaggaaaaggggcggggcggcggggaaaatataaattaaaatttaaaaattagttaaaggaaggatggaagtttcgcggttttttcggcgtttagcggtgtttttgttttggtgttcggattttagttcgcggtttgtttgtttgttagtttcgtggatatcgtattgtcgggtagcgtttcggtcgtatttagttagttagttagttcgagtcgaggttgtaggttgtagtttcgagtagaggaaggagggaaggggaaggcggggagtaaataggaggaggggagcgagtgtgcgtacggggagggaggtgggggagagatagtgtgtttatttttggttcgggagggggaggtatttgcgagcggagttttaggggcggatgagtggggggtagggggaaataaaggaaaagtagttttttttttagtttttcgcgtagaagcggggcgggtttttggattttcggagggtacggggattttttgtcgt

SEQ ID NO: 11525 - DNA, 433 bp, synthetic construct
  misc_feature 1..433: note = Description of Artificial Sequence: Synthetic polynucleotide
  source 1..433: mol_type = other DNA
cgggattgggcgttagttagtagttcgtaggattaggcggggataggcgggtagtatttataggtaagtcgttagggggtttaggtttttcggaacggcggatagttcgagtttagagtagtcggtagatagtatgatgtcgtttttttggtagtggtagggggtcgggtaggcggtgggtttcgggtcgggttggggggcgtcgtcggtttttcgggaagcgtatagcgcggcgtaaagttatagcgttcggagtttcggcgggttgggtatttcggcggtcgggttattggggtatttggcggtcgggcgcggacgtacggcgcgatggtcgtagttgttttttttcggtttcggcgggttgtatcgtcggtggggatcgttttaggggttttattgggcggcggcggcggcggtgggagcgtcgggacgg

SEQ ID NO: 11526 - DNA, 1376 bp, synthetic construct
  misc_feature 1..1376: note = Description of Artificial Sequence: Synthetic polynucleotide
  source 1..1376: mol_type = other DNA
cgcgggatttttatttttgcgaggtttttagagtttttttgggaggaggttttcgttggaacgtgtttgggtgaggagagggagatcggtttttaggtagggacggttagggtgcgcgtattttagtttttgggttatttcggcgggagtttgcgttttttttaggcgcgatttttaggaaggtttcgggtggtgatcgtagattggagagtgagttgggttggggaaagagtgaggcggatcgtttttaattttcggtaaagtgtgcgttttcgttttattatttaggggcggcggtttttgatgagtttatgggggcggggcgttaggagtttcgttcgcgagtttttttttcgttttcgcgaagtagtagttcggaattcgcggttagggattcgcgtaggtttttttttagttgaggggcggtcgggtattcgggtttcgattcgcgattatcgtatttattattattatagcgggaattgttcggcggtttttagaagtttcggttcggtcgtagaggtgggttttcgagtatagaggtttcgaaattcggttcgtagtttttagttttaatgtcggggggcgcggtggtttcgggcgattttttatttcgtttttggagtttataggtggttttataatttcgcggttcgcgttgcgttcgcggggtttagtacgttgtcgcgggatttgtttaacgtggagtgtgtgtttgttttttttcgtttcggttttcggcgtagtttttatttagaagacgaaattgaagacgaagagtaggtatttgatgtatttggtgtagttttttatttttatggcggcgcgggcggcgggcggtttgcggggcgcgggtcggttttgggcggcgggcgggtcggcgcggggtttggcgggtggtcggtaagggggtttggcgggtcgaggggcgggggcgcgaagaaaggggcgcgggggcgcgggggcgcgggggcgcgtggggcgttgggcgtcggaggtttggtaggatgcgcggtggggtcgtcgtcgtcgtcgtcgttgcgcgttcgttttttggtcgggcgcgcgtttcgtttcgtagtatttatagggcgtcgcggtttcgtttttttataggtttcgtttcggttagtttacgtttcgttttcggtttcgttttttgtcgttagggcgcgtagtcgaggggtatggggtcgttgtatttatttttaatttggcgcgtttcggttaggattttagggtttaggtgtatcgtgttgggcgcgggaggcgtttttaagttgttgtcgcgtttcgagtttttaagggggtggtagtagggtcgcgtttgaggataggtatgtagcgtttgtttaggagtgtagtttcggtgtcgg

SEQ ID NO: 11527 - DNA, 3393 bp, synthetic construct
  misc_feature 1..3393: note = Description of Artificial Sequence: Synthetic polynucleotide
  source 1..3393: mol_type = other DNA
cgtagcggaggcgggaggagagtttttggcgggtatttgtttttcgcgtttttcgcgcgtttaaggttgggtttcggggtattttattcgggtcgtttcgggtttagttttagtttagaatgattttatattttttatatttttaagttttagaaattatcgttttgagaattttaaggaggatattttttttcgggttttttgtagcgtcgagtttcggtaggttttttcggcgttcgtttgttgcgagatttttttgtcgtttcgaggagtacgagattttagtcgtttgtagattatttatatttgcggagggtggtagtaggggtttggttggtttgaaacgcgtcggggaggcgcgcgttgtattaaatttcgtttttgtttttaagggtagattcggggtaaggggattaagattttcgacgtatttagcgttatggggatagttatggttaatattttgtttttgcggttaattttaaggttattaaaattttttattcgtagagagcgcgtatagtagtgcggatattcggggattgttttaaggaaggttgagttttgggagcgcgtggatttcgttttatcgttcggcgattggttcgcggggttgggggcggagatcgagttcgcgttgtataaatatttatgagtcggtagcgcggcgcgagcggggttggagtcgggaagttgggttaagggcgttgttttcgtcgaggaggaggcggcggttgggcgcgggtcgcgttatttaggtgttcgtttcgtttttcggtttggatttgtttttgggtgtttagtaggaaggagattgtgtgtatttcgttcgattgcggtcggagcgcggcgttgatttttttaggcggcgggggttcgtttgtttcggcggcggacggacgaaggacggacgtcggagaaagagggcggcggtttgggtcgaggcgggtttttaatttcggcggcggcggcggcggtttggttttgggggcgggtatgagttttcgggggtcgagtggtggtcgttagggttgattcggcgcggtaagcggttcggtttagttattttgattgcgtatcgcggttttagaggaaatttgcggcgttttcgttttttttgttcggcggagttatcgtcgttcggcgcggcggggagaagtggtcgggcgcgcggagaggaggcgagcgagcgcgggacgatgagtcgaggttcggtcgttttgcgtcgcgagggttgagcgcgattcggggttagtagagcggatttacggattgtggcgcgcgtttgtagtcgtttttaaattttcggagcggcggaaaggagtgcggaagggttttgtttaggttgcgggtcgcgtcgttgcggacgcgtttttagaaggggttagattatcggtagatttttttttcgggcgaagtataagggagattttagattattcgttgtattcgtttgcggttttttcgtgggtttttttttcggtatttttttgcgcgtcgtttggagggcgagggtatcgggtcgaggcgtatagtatggagtggggttatttgttggaagtgatttcgttgttggtcgttttggcgttgttgtagcgttttagcggcgttgcggtcgtttcggttaaggagttggtatgttaagagattatcgtgtcgttgtgtaagggtatcggttataattatatttatatgtttaattagtttaattacgatacgtaagacgaggcgggtttggaggtgtattagttttggtcgttggtggagatttagtgttcgttcgattttaagttttttttgtgtagtatgtatacgtttatttgtttagaggattataagaagtcgttgtcgttttgtcgttcggtgtgcgagcgcgttaaggtcggttgcgcgtcgtttatgcgttagtacggtttcgtttggttcgatcgtatgcgttgcgatcggttgttcgagtaaggtaattttgatacgttgtgtatggattataatcgtatcgatttaattatcgtcgcgtttagttcgtcgcgtcgtttgtcgtcgtcgtcgttcggcgagtagtcgttttcgggtagcggttacggtcgttcgtcgggggttaggttttcgtattgcggcggcggtaggggcggtggcggcggggacgcggcggcgtttttagttcgcggcggcggcggtggcgggaaggcgcggttttttggcggcggcgcggttttttgcgagttcgggtgttagtgtcgcgcgtttatggtgagcgtgtttagcgagcgttattcgttttataatcgcgttaagataggttagatcgttaattgcgcgttgttttgttataattttttttttagttaggacgagcgcgtttttatcgttttttggatcggtttgtggtcggtgttttgtttcgtgtttattttcgttatcgtttttattttttttatcgatatggagcgttttaagtattcggagcggtttattatttttttttcggtttgttattttttcgtgtcggtgggttatttagtgcgtttggtggcgggttacgagaaggtggcgtgtagcggtggcgcgtcgggcgcggggggcgttgggggcgcgggcggcgcggcggcgggcgcgggcgcggcgggcgcgggcgcgggcggttcgggcgggcgcggcgagtacgaggagttgggcgcggtggagtagtacgtgcgttacgagattatcggtttcgcgttgtgtatcgtggtttttttgttggtttattttttcggtatggttagttttatttggtgggtgattttgtcgtttatatggtttttggcggtcggtatgaagtggggtaacgaagttatcgtcggttattcgtagtatttttatttggtcgcgtggtttgtgtttagcgttaagtttatcgcggtgttggcgtttagttcggtggacggcgattcggtggcgggtatttgttacgtgggtaattagagtttggataatttgcgcggtttcgtgttggcgtcgttggttatttatttttttatcggtattatgtttttgttggtcggtttcgtgtttttttttcgtattcgttcggttattaagtaataggacggttttattaagacgtataagttggagaagttgatgattcgtttgggtttgtttatcgtgttttatatcgtgttcgtcgcggtggtggtcgtttgttttttttacgagtagtataatcgttcgcgttgggaggttacgtataattgttcgtgtttgcgggatttgtagttcgattaggtacgtaggttcgattacgtcgtttttatgtttaagtattttatgtgtttagtggtgggtattatttcgggcgtgtgggtttggttcggtaagacgttggagttttggcgttttttgtgtattcgt

SEQ ID NO: 11528 - DNA, 1381 bp, synthetic construct
  misc_feature 1..1381: note = Description of Artificial Sequence: Synthetic polynucleotide
  source 1..1381: mol_type = other DNA
cgttttaacgtgttgttttggtattaggacgcgtatggggaggtggagataaacggtgcgtggggttcgcgtgggcgcgaggaggggtcgttacggtttttttgagagtgcgttgttgagttcggttttggaggcgtgcggcggggaggggttagttttcgggtgttttgtgcggttcggttggggttaaagttcggggcgggtttgtttttgtgtacgtgggagatggttaggggtgttggggatttcgagggttggtgtgaggtttcgggagttatcggggtgattggtcgtcgttcgtagacgggaagttttacgacgtttacgttttttatagcgattgtttcgaggatcgtaagttcgtgaattttattttaaagtcgtagttggagcggcgtcggggttataagttttttttggacgatcgcgattttttgtcgcgcgttggtatttcgggttttatttcgtgtttcgtttattcggagggttcgtttcgtttcgttttatgtttcgttttattcggggttttatttttattatcgagtttcgtttttattttcgtttattcgaggtttcgttttaaaaattcgtttatttcgtaggtttcgttttttttttagagttttgcgttcggtatcgtttttgagttttcggtttcgttttttttcgttttcgtttttgcgtcgtcgacgttcgttttttcgtagagtttttcgtcgattttttggtgaatttgagtcgttgtcgacgttttatcgtggtgttttcggacgtttttttgagtcgggtttggtgtagttatagttttcggtgggtttcgcgcggggttgggtgggttttagcgtagtatttatttttttgacggtttcgtttcgtagggagggtttgtgtcggttgttggagtttattcgtagatttatttttattattttcgagggttagaggcgcgatttcgcgtattcggcgtttcgtttgttgcgttagtatcgttatttggtgattttgttgttttggaggttcggtttcgtggtgcggagtaggcgcgggagggttcggggttagcggcgggttagagatgggcggtgttcgggttttaggttgggattttttcgtggggagttttgcggtattacgttttgtgaatgggttttggggggaggtttcgttgtttggggtttcgatgcggggagtcgtttttgaggttttcggagttacggaatagttgtcgtagggcgtggaattcgtgggtagtcgtaggtgtgtttttgggggttaggacgttaggggttttcgaggtgtttatatttgtaaatcgtttcgatttggtttttagattttttttttcgatttttggaaagaagtgtagttggcgttgtcgcgg

SEQ ID NO: 11529 - DNA, 493 bp, synthetic construct
  misc_feature 1..493: note = Description of Artificial Sequence: Synthetic polynucleotide
  source 1..493: mol_type = other DNA
cgagttgtttttgggcgcgtttggggttgtatttgggttacgtgggcgtcgttgtgtagtcggtatttttcggttaatttcgcggtttggagaaggggttttgtattcgtcgtcgttgtttgttttcgcgcggttttcgtttattgttttgcggttgttttgcgggttgaaaagtttttttcggtgtagaatttcgggtttagcgatagtttgcgtcgagtgtgcgtatttgtcggagattcgttagttcgtcggtcgcggtgagtggtttttggagttattggtttagggcgggttcgcgggatggggcgggcggttcggggcgtagtcggttaggtcgttgttatggtaacgcggtggaaaaacgggtttttgggtatttcgttgtcggtcggttggtaattttttagcggagggatcgggtcgagttcgcggattttttcgagtgttttttggggtttagtcgttggtattttatttttttcgggttcgg

SEQ ID NO: 11530 - DNA, 922 bp, synthetic construct
  misc_feature 1..922: note = Description of Artificial Sequence: Synthetic polynucleotide
  source 1..922: mol_type = other DNA
cgtgttttttttcgttatttggtacggttcgtgttttcgtcgttgatttggtaggttgcgcgcgtatatttcggtcgggtgcgggtcggcggggtatagcggtttttacggttcgttttcgttagttatttttcggttttttttttcgttgttcgcgtgtttcgggtcggtttagtatttttcgagttacgtgttcgcgtttttcggcggggaggagcgtagtcgcgggggcgcgtttcggtgatttcgttttttagttttttttttttgagttcgggagttcggttcgcgcggttaggtgcgaggagattcgggattttacgttcgttcgttttgtttagcgttttagtttcggcgtgcgaggcgtcgtttttttttttgttttgcgcggtgtatggaggggttcgttcggatcgtagtcgtcgttatcgtagtcgtcgtcgcgcgcgcgcggggggatgatttgggggtggtttttcgagtcggttgtagcgtaggaggtttggaggtttagttagtttcgcggagaggtgcgggggtgggggtttcgtcgtagggtcggagggaggggtggcgcgcgggtattgggtttggggggttttggtttaggggacgggaggtttcggggacgggcgggtcggcgttttttggagggcgtgggggtgtagggttgcgtgcggggtttggatgttgatgtttgttcggcggggagtttcggcgtttcgcgttttcgggggttcggaggtatttcgcgggaggaggcggggtgaggtgttagtgatacgacgaaatttttttttgacgatggttttcgggggtaggtgagatgtcgtagagcggggagttagggcgttcgcgcgtttttttaagggagtcgggtttttggttttttttaatttttatttttgtagagcgttcgcga

SEQ ID NO: 11531 - DNA, 719 bp, synthetic construct
  misc_feature 1..719: note = Description of Artificial Sequence: Synthetic polynucleotide
  source 1..719: mol_type = other DNA
cgttcgaggatgttggaggtgggggtcgtcgttttagttcgggcgtagggttgggggattgggggcggaaatttttcgtagaattgtttcgtttgtttattttaagggaacggagaggattcggtttttcgcgaaaatttggtttagggaaagggatttcggaaagtagtttcgtagggttgtggtagttttatttcgattcgcgttgcgtttacgtgtagggttcgatttttttcgggaggcgcggcgtcggttggggttaggcggtcgaggatttcgcggtttttcgtttcgtttcgtttcgtgggttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggattcgggttcgggttgggggcggggaaggggttggatacgtttgcgtatacggcggttcgatttttaggagttttcgggaggggtagaaagggcggggtggaggagggggaagggcgggggtgatgtcgcgcggtcgtaggtttgggatggtgttcgcgttttcgagattcggatagaggtaagtaggggcgtcgtgggtgttagagaggcgg

SEQ ID NO: 11532 - DNA, 958 bp, synthetic construct
  misc_feature 1..958: note = Description of Artificial Sequence: Synthetic polynucleotide
  source 1..958: mol_type = other DNA
cggtgtacggggttatatagtcggaaatttttgtcggtttcgggttattttttttttgaaacggtttttttcggagttattttttggaggattttatttcgttcggtgttcgggtttcgtatttattttttttttttcggttcgtttttcgtacggcgtttattttgtttttcgttttttcgttttatcgtcgttttgtttatattgtttttcgtgggcgttttcggtcgtttttttttttcgggtttcggtttgggggtgtttagttcgttcggcgtcggtttaaggtcgcgcgatttcgtacgttttcgagattcgtttcgtcgttcgtcgttcgggtcgtatttatcgcgttcgtaggatttgggggttttcgttttgttcgcgtttcggtatcgtcgtcgtcgtcgtcgttagcggaaatagggggcggggtttgttcgggaatggcgagtttgcggggcggggcggttcgggggcggagcggggaggggcggggcggagcggggaggggcggggcggagaaggatcgtagggttgagcggggcgttagcgttagtgttcggtattgtttcgggttgggttttttgcgttagaggaaggggagttcggggacggggtacggggttcgcgaggtacgggtgttttttcggggtttcggaagttttttttttcgtttcgtcgttcgtatgttcggatcggtcgttttttcgaggtgttatgatttcgttttttttttgcggcgaacgggttttttttcggggtaggggcggggaggttcgggtttggtagtgcgtttttttgggttttgcgtttatacggtatttaagggtttttttggtttaggtttcggttttttttttcgcgttaggttgtttggtttcgttattttatttttatatttacgaattttttttttggtgtttcgggcggattgtgcgagatgttgatagcgcgg

SEQ ID NO: 11533 - DNA, 3843 bp, synthetic construct
  misc_feature 1..3843: note = Description of Artificial Sequence: Synthetic polynucleotide
  source 1..3843: mol_type = other DNA
cgcgcgtggttttcggagaggcgtttattatttgcgtggcgttttttcgcgtcggagtgcggttttgtttttagcgttagtgcgtcgcgcggttcgtcggtttcgtaggattggttatcgttttttatttatgtaatttgcgtgtgcgtgtgcgtgtgtgtgtgtgtttttttttcgttcgttttttttttttgtgtgtaagagagcgagggtgggggacggaggtaggtaggcgagtaggtagggaggggaagaagagaagggaagttattaaatatatatatatatatatatatttatatacgcgcgcgtatatattcgttttaattttttagaagtttcgggattgtagttgttttatgtggggtagtagtgttggtagggacgtcggtcgggagcggtcgggagcgggagtcggtcgtgcgcgcgcggttggaggttcgttggggtttcgtttttcgcgggagttattgttggtttcgttggagttgagcgtagagttcggatttgtttttttttgggcgtttcgttacggttcgcggagtagaggagtcgcgtcgtcgagagagagaggagttatcggcgcggcgttttgtttttttgtcgtcgttttcgtcgttttttcggcggtagtagtttgtagttacggtaaggcggcgtgattcgttttacggaaaagcgttttggggatcgcggcgacgtttcgttagttttatcgttttttgtattgttggttcgggtagggttcgggtagtttacgcggttgtcgagggtttcgggagatgtttgtttgtttttttggtttaggaggagggaggttagggcgcgggtggtcgaagaggtaagttgttttggagtttggagtcgtcgtagttttcggagttcgtcgcggattggagtttgggagtaagggttgggggagggtagggaggtgggaagcgggtgggagggaggcggcgcgttttaggttcgtttgtttttttcggatttcgtttttcgtttcggttcggtcgtttgtagtttttttgtagattagttcgttttaggttttcgtcgggcgttggaggagttcgcgaggcggcgtcgggttttagcggttgtagtttgttttgcggggtaagtgtcggttgtagtagtttcgtacgggcggtggttggagtttagattttggagatgcgattttagtttttcgttttttgtaattcgcggggcgttcgtttttttttatcgggcgttcggtcgcggtattgatgttcgtttaggagttaattgaggttgtagtcgttagatggacgtttggagggttttcgggtgtgagtgtgattgtatgattatttttatttttagtttcgggaaatgtgttttgggttgaaatgtgattatcgagttttttagttattttaattgttatttttaaatgcggtcgttatattggaggagtagattggaaggtagtggggcggtgtgtgtgtgtgtgtgtgtgtgtgtgtgtggatatatatacgtaatcgaggaatatataattaattatttgggtgaagggcggggggtttatttagtgagttttttttggcgggggggtcgggcgagttagttgttcgttgttcgttttttttttgtttgttttcgtttaggcgaggttggaaagtattggaaatttagttgcgtggtttttaattttggaaattggtttcgtttttagggtaaaatgttaaggcgatttatgtattcgcgtttatgtggatgagtgtattattgtttagttgggtgtagagtttttaatagtatcgcgttaagtttttattcgatttttaatttttttttattttttaatcgtggagagagggtttatagaaatgtagttatttgtaaattatcgacgtagtgaaaggggcgtagggaggtagttagagttttgtttgaatttgtatattggtttggtgtttgtagtatacgagattatttcgttgttttgtagaaggcggtggtggggtaagttcgggattttaatcgtcggggtggggggtggggggaagagggtgtttatgtattgagttttgaggtcgagtaaggagagagatttgttgagcggtatcgcgggtaattatataagttgtttcggtgattattcggaattgtgatgcgagttttcggttttcgaaagataagtttgaaagtttgtttgtttggggagtgtaagtatcggggcgtttttatttcggtttgggtagttaggatacgtttcgtattacggcgtttatttgtgcgatgggcgtcgggtgttgatgttgttgtttttaaagaatcggttatcgaggtagggattaagtgggggtattcggaattgatcgtagaggaggagttagttagaattgaggttttattgggtttttagagttttaagttttttttcggaggtgttggaaggttttttagggaacgtcgtttttagaaattgatttggtgttttggggagttttaaagtttttttttttcgttttttttgggcgtttttttttgttttttaagttttgtgttttttacgtgtttagaaatttgttcgcggtgtttggttttttttggagatgtttaggtagtttagttatttaggtttacgttggcgaggggttagagggagtagaacgttggttttgtcgggttgttatttttatttatatttatttttggttttttgcgttagttcggcgttgatggggacgggatggggttggggtcgggtatggttttcgttttttcgtttttcgtttttgtagatagtagtttgtttttgttgcgtttatttttttcgtttcgtcgtttttttttagcgtcgtagtttgtgtattacgttgatgggttttgatagagaaattatagtaagagtatgtttttaaattttgattttcgtttgtagggggataagttattttagttttgatatagtcgtggggaacgttgaagtttgggatatattggttttgaatttttttttttttagttcgtagttaggagatggtgatgtgtatgggtggggagtgttttgtttttgttatattttagcgttttgaaatttttcgtttttttttattgaaattttcgatttgtttgaatttgttttttgttgtaaaataaattttttttttcgtagatttgtggggtttttcggattttttgtcgttgttatgatttttaataatgcgattgaaaagttagtgttcggttggaaaaaaatttttaggtgttagtcggtcgcgttttgattttgttgaaggagtttttaattcggttgttagaggggttttggtttagtcgtgggaatttaggaagaaggagggcgtttcggaggcggttgggttagtttttcgggtagggcgggaattaggtcgcggcggggatcgtagagggggaggggacgggatttcgcggtaatttgtttttcggcgagtcgggttcgcgtattttagttttttcgttttagtttttcgtggttcgtttttttcgtcggtttttagttgttttcgtggtataggagtcggtcgcgattttttcgcgtttttcgtcggagttcgcgggacgtcgttaattttgggtttttcggtggtcggagtagcggtgcgaattagcggggcggtcgggtgggcggggtttgggcgggaaattggagtcgagaagatcgcgttttaggttaagttttagtcgtaagcgtcgcgcggtatagtgtagggtttcggtcgcgtttttttttcgttttcggttcggtcgcgtttttgcggatttatagcgcgtttcgggcgttttgtagttgggtttttagcgggggagtttttttcgttaaagttacga

SEQ ID NO: 11534 - DNA, 384 bp, synthetic construct
  misc_feature 1..384: note = Description of Artificial Sequence: Synthetic polynucleotide
  source 1..384: mol_type = other DNA
cggttggtcgggggacgtgttcgcgttgtttttttttcggtcgttagggggcgtaggaagaagttttggaggtttgtttcgggatcgcgtattcgtttttttttttcgttagttttttttttattttcgttgagtttcgtttcgtcgtttgttttttgcggtattcgttcgtatacgaatttagttcgggaatcgagttgcgggagtgcggtttgtgtcgtttcggttaggagtttgtcgattgtagacgttttgcgaatcggtaagatgtgttttttggggttgtttttttttttatcgtttcggggttaagttattttatatgagtataataacgagttggtgacgggtagtagttatgagagttcgtttttcgattttcgg

SEQ ID NO: 11535 - DNA, 1432 bp, synthetic construct
  misc_feature 1..1432: note = Description of Artificial Sequence: Synthetic polynucleotide
  source 1..1432: mol_type = other DNA
cggacgttagggggtgtttttagttttagcgtagaatttcgtttcgtataatttatcggattagttaggtcgtcgaagggtattaggttttagttattacgacgtttcgttcgacgggtcgtagttatgtaggagtggtagaggttgtttgacgaagttttttttgggggtcgatgttttttttcgggtgggaaggggcgttgtcggtgagggttattttggcgtcggtttgcgtcgttcgaagtcgggggggaggggaggttttcgtttagtaggggttacgttcgtttcggacgggggtcgcgcgggcgtttaggcgacgtattttcgtcggggttcgtgatcgttacgttcggcgggcggcgttgcgttttttttcggggtttcgtttaaggttgtagttcggttcgcgtcgtttttagggcgtttttttcgttcgcgttgggagttcggcggtcgcggtttttttcgttagttttagttgtagtttgtttttgttgttttttttcgttcgttcgttcgttcgcggtttgtagttttcgggttcgtttcgaggtggagggattgtttttttcgggggttgtacgtattcgtagcggtttcggtttttcgtcggatatatatcggtttttgtaggttgtaaagaatagcggcgagaatgtatcggttttttttttttttgttttgagtttcgggtgtggggggaggggaagtcggcgaatagcggcggcggtagcggcggcggcggcggtagcgggcgacgtaagttcggatgtagtttcgggggtttcggcgttgagaaatagtcgattttagtggcgtaggacggatacgaggacggttcgggggattgtgtatcgggtgtgcgagttcgtaagtcgtagtaggggtcgcgcgcgttgggtttttacgcgtttatggtttcgggcggcgcgcgggggttttcggggtcgtagtttcgcgtcgtttggcgcgcgtcggcgtttcgtttggttttaggttcgggtgtcgcgcgtcgcgttttataggcgtcgggttcggttgttcgtttttttcggtcggcgcgcgtagttttttcgcggagtagtcggttaggtagttttgttcgttgtttcgttttggttcgattgataggcgcgagcgtcggtagtagttttcgcgtttcgtttttcgttcgtttttcgcggtttagtttaattagcggcggttgagaggcggttattagggtgacgcggtatcgcgttttgcgaggggcggagtcgggggtcgttacgcgcgtttttcgcggtaaaatttaaaggtcggtagggcggttttttaatttttttttttaagtagggacgaggcggaatttgtttcgcgaggattgtaattttcggtatgttgcgcgtcggcgtcgggtggaggggtttcgattgggggcgtagggcgt

SEQ ID NO: 11536 - DNA, 325 bp, synthetic construct
  misc_feature 1..325: note = Description of Artificial Sequence: Synthetic polynucleotide
  source 1..325: mol_type = other DNA
cgttgtcgtcgttgttttttcggtttttttgttattattttttacgttttgtagttttgttttttgtttacgggttgttaagtcgcggtttggtcggtggtggtagtggcggagttagataaagttttcgtttttttcgttttagagttttttaggcgttttaagtggcgggaaggtcgttagttttttaggtttcgcgttttttgtttggcgtgggggtggggagtcgcgtttggttttaggagttttttggtttttgttaatttttcgtttttgtatattgcgtttattgtttgagatgcgtcgagacggttttcgttgacgt

SEQ ID NO: 11537 - DNA, 1242 bp, synthetic construct
  misc_feature 1..1242: note = Description of Artificial Sequence: Synthetic polynucleotide
  source 1..1242: mol_type = other DNA
cgtttatagataacgttttttcgtcgttggcgttggttcgggatgcggtttcgagatttttgtagtcgcgcgttggtttaggggattttcgtaggacgcgggcgggcgtcggggtcgggtcgggtttgggtagagtgataggtttttagtcgtgagttttataagtagatttatttataatatttcggataggagtttaggtcgcgtcgttcgcgtcgttcgcggggattcggcgtgaatttatacgttttttttttatcgtttcgtcgtttgttacggtttcgagattcggttagttttttcgggggtttttttcgtcgcgtagtatttcgttcgtgagtagttttcgtttgcgtttttttttttttagggcggtcgtttttattttcggtttttatttagcggggatttattagggcgagggttgaagatttcgcgggacgtcgcgcgtcggggatagcgacgtatttatttttttagttatttgggaggttgtaggttcgggtcggagttcgaggtttaggggcgcgcggagtagttttggttaaggcgtagggcgcggggttgtatgggggtttagtttagcgtgtatatcgtgtattttttagcgtagggtttcgcgttttttcgtagttcggtaacggtcgttattttagagtttcgtttattaggagtttcgtttagggtatcgtttattcgggtttcgtttttatcgcggttttcgtcgtggtttcgttttcgtttagagtttcgtttttagcgtatattgcgttagtcggatttgttttgtagttgggttttttggaggtttttatttcgcggttattgaagcggatgagtgtgaggttgattgggggtttggggatgggggatcggagattattaagaatatggttgtgttgggaaatttttttttagagtagagagggagggttttttttcgtcggggtgttttttattttttagtttttttcgcgtgggttcgtattttagttagaggggatacggcggttaggtttgcgttgttgcgtttgagtttaggtcggtagaggtcgtagatttcggttttttagtcggtagggattcgtaggtgcgcgtttttacggacgtttttcggggaagttcgagttcgttttttgtaggtcgggaagtattcgtttcgagacggtcgtattttcgtagcggaagggcgtttgtattatagttgtagtattagcgcgtgcgaggcggggttagggtcgg

SEQ ID NO: 11538 - DNA, 1460 bp, synthetic construct
  misc_feature 1..1460: note = Description of Artificial Sequence: Synthetic polynucleotide
  source 1..1460: mol_type = other DNA
cgcgtttttgttttttttcgatttagtcgtaaatttcgagttttagcggtcgttttttttttttttcgttttttttgatttaaggttttaaaagataaacgtgttatttttcgtttcgtttttggattttggtttcgatcgaatgtagtggggatcgagaagcgtaaggtttaggatttgttagaggggcgcgttaagggcgtttttgtttcgttaggatattatcgtttgggtattttattttattttttcgtagttttttttggggtcgggcggggcggggcggggtaggggggtcgggcgcggtttacgcgttttttcgagtgcgcggtgcgggacgggcgcggttgacgcgttttcgtcggtgtttgtgttttttcgtaggttaggagggtattttgcgttgttattcggatttggcgggtagcgagttgtagcggggtacgtttacggtcgagtcgtagcgggaatagagcggcgtaggtttgaggagtttgggcgcggacgagcggttgcggttggtcgagtttaacgcgtagtatcgcgcgcgtttcggtttttttttcgtgttcgtcgcgcgttttagcgatcggacggcggtgtcgcgcgagttggcgcgtcggttgttttgttcgttcgcgtaggagttgcgtattgttttgggcgaggtgaagaagatcggtagtttgcgtttggtcgatttttttcgcgtagatttcgttaagttgtagttgtcgcgcgggttagggattcgggacgtataatcggacgcgcgggggttacggttcggagttgtgcgttttgggcgggaggcggattcgggtttggaatagcgtttatatacgtgtataaaggaagtggagaattgaggtaattatacgagtaatgagtttttttgttcgtttatttatacgcgtacgcgttgttaaaatatttatattgtttagtgttttgtttcggatttatttagtttattgttttaattttttattttttttgcggttttcgatattatcggtttttgtggattttaaagcgtttatttagttttttttaatttttttttgttaagttcgaattgtaaagtaaaacggacggaaaaggaattttttatgttatagcggtttgtttgtttttttttttttttattttatttgttgcgttcgatttttatatgtgagcggaagcggtgttttcgtttttgggtattaggggagtagattgggagttaggaaagttaaacgttggtttcggttcggtttggggagtcggggaagtcgtaggaaggaggcggtgggtcgggaagagttttgcgaagggaagagttaatcgaagggttgggaaggcgtttcgtggggacggacggaatagttgtagttatcgtttttaaaaggcgggaggcgtttagttaaagatttttttcggaggtcggttttgggggggtggttcgattgtttcgg

SEQ ID NO: 11539 - DNA, 1064 bp, synthetic construct
  misc_feature 1..1064: note = Description of Artificial Sequence: Synthetic polynucleotide
  source 1..1064: mol_type = other DNA
cgattggcggttgtgtggcgatagcgtacgtttagtttttggaaagttttgtagtttattaggagagttttcggggcgtttttttttttggtttttttagggatttgcgggtagtggaggagttttttatagcgaggtagcgcgtttaagtcggataggatgtttacgcggtatttttttgtttcgggttggaaggcgaattttaggtttcgcgcgtttagggtattgttggtttttagtagtttttttacgattagaggtaagtttcgagttataatttttagttgggtgaagattatttttatttttagtattagtggtagtattattgttttttcgggcgcgttatagcgtagttgtagtcggacgcggtttcgagacgggttgcgcgcgtttaggtgagagtagcgtatttcgttagggttaaagtcgtacgggaagcgtttgggatttaggcggttcggtcgttgggttagtgcgtcgttgtttagtatcgaaatcgcgtagcggttttcgggttgtatttgtaatattaggttatgtaggggatttagttagattttacggtcgaaaggtattcggagttcgcggttcgttagtattatggtttttttagtagggatttttgtagttttcgcgagattaggggatagtaacgttttgtcgaaggtagcgggttgtgtcgggacgcggtttattagtgataggagaagtagtagtagtagtagtagtcggggcggcggtggcggttttggttgaaagttggtggagttgtttgttcggcgcgaggataattcgggagtttcggttgagtgtatggtttcggtgttcgggtttggataggttagtttgagagtatgcgaagtcggttttcgggtagataataagagatatcgtcgggaagtgttaggaatttcgcgcgttgttcgcggggtttttttgtagtcggggttgggttagaaggatggtaaagttgcgcggcgtcgttcgggttggagtcgtagtcgaggagtcgaagtttttttaggtcgtttagtttcgtcgttagcgttttaatcgcgcgg

SEQ ID NO: 11540 - DNA, 622 bp, synthetic construct
  misc_feature 1..622: note = Description of Artificial Sequence: Synthetic polynucleotide
  source 1..622: mol_type = other DNA
cggtttgttacgcgttttcgtcggggtttattcgtatttgggtcggggttggtgtttacgcgcgacggttcgggagtacggatttttgtttttcgtagtatcgtttttcgggtggagtcggcggtttcgtttcgtagagttggggttgtatttggggtaacggggtcgggtttggacgttaggtcggaggagtagtatttgttaggagtacgtttcgtcggtaggtcgtaggagttttgggagtcgtcgttatgggtacgttcggcgggtggggggtcggtcgggttaaagattcggagttacgcggggcgggggtcggtatcgagggtcgggaggcgcgaagggtacgcggcggcgggaagcggggcgattcgaaggtttacgggggtcgggaggttgcggggcgttcgggattttttttcgggtggttatcgtgcggtcggggcgcggaagttagaggtgtttagaggcgtcgatttcgtcgaggttgcgattttggttcgttcgttcgtggggtattgtaattttcgtatttttattttgcgggtcgggagtgcgtttggagcgggacgggatttagcgggtgacggtaggggcggtagaaatatcgtttaattggcgg

SEQ ID NO: 11541 - DNA, 1622 bp, synthetic construct
  misc_feature 1..1622: note = Description of Artificial Sequence: Synthetic polynucleotide
  source 1..1622: mol_type = other DNA
cggttttatcgggttgtaagggtcgggaagttgtgtcgggggcgttttagaggttagagttagggagggggttcgcgatataggcgggttttttaggcgggtttagggttaggatagcgcggtattattcggttagttttttgtagttaggatgaaggtcggggatagacgtttagttttagattttttagatagggttgggtagtgtcggtgggtgtttgggagaggcggaggcgggcgtatttttagtattaggttcgggaaggatacggtgtttagtcgttggagtttttggtttgcgtgttttattttgattttttggtatttggtgaacggttttttcgtagggtgggggtagttaggggatttgtcgaggaaagttggggatagcgggtttggtggcgcggttcggcgcggcgcgtgtttggggcgcgtggtcggttatagaattcggggagggtggaggttttcgggtacgcgtcggggtggtgggtagttcgggacggtagcggcgattcgttatttgaggaggggcggggattttatcgcggttaggtcgaggcgtcgagggttttttgcggttttcgttttttttcgttggtttcgacgtcgcgttcgggtcgggattcgagtttcggtttcgcggggtaggtttaggtttgcgcgttgcgtttgtagtcgaggtagaaattcgtttcgaggcgcgggcgtcgggttcgggttttaaggatgcgcgtcgggttttttttcgcggggatagtcgagtttcgtcggcgttttaggtgttttcgtagtgcgttcgggcgcggacgtttttttgttttcggaggggaagcgggagggtttttggggtaacgtttcgatttcgggttttttaatttgggtcgatagtcggttggtatagggaggtttgcgcgggagaggggcggagagagcgtagcgcggggtatagcgggcggttttcgtgtcgcgcgcgcgattggaaacggcgtgtagattttaaaacgagggttttatagagggttacgaggggtaggagagagttttcggagaattttagtttttcgatacggttattttttggtaaacgagcgagaattggggcgtagagttttgggagggtcgttttttcggcgggagcggttcgagtatagttttatagtagatgcgagcgcggcgggcgttttggtgacgaagtagcgggatttgtaggaggtagaggtttggtggggtcgtggacgttacgtcgagttgtttagatttttttagaagatagtggggattatttaacggtttttagtagaaattaagttaggtgttcgttttacggagattgttcggttgtagggtggaggttggatgagaataggcgtttttttaggtaggcgttcgtggtggtaacgttgtttaggaggagggtacgggtttcgggaagatttgcgaggttaaatcggtagtttcggagaattgagcgtaagaggtcggtgatatagagaggagttcgggaggtcgtatgttttaggttgaagttatttggcggggacgtttattgagatgcgaaatataggaagggatagaggttgcgtagagggaaaaggcgatggattcggttttggaaacgt

SEQ ID NO: 11542 - DNA, 324 bp, synthetic construct
  misc_feature 1..324: note = Description of Artificial Sequence: Synthetic polynucleotide
  source 1..324: mol_type = other DNA
cgatttttcgagggaggagatagcgtcgtttttttatttgtataggtgttttcgtcgtaggtttcgtatatttatttatggtatttatataggggttcgaagaatatgttcggtttagttacgtggtagatgtagacgtcgtagtcgtagcggtttcggtcgtggtatagcgcggttttcgggggttgtttaggtgcgcggtagcgtcgtttcgattcggttcgggatagtttgtaggcggcgttcggttagtttttgcgcgggcgataagtaatcggtaggtcgggttagacgcggacgtcgttttttgtttcgaatttacgt

SEQ ID NO: 11543 - DNA, 1881 bp, synthetic construct
  misc_feature 1..1881: note = Description of Artificial Sequence: Synthetic polynucleotide
  source 1..1881: mol_type = other DNA
cgtattcggtttcgaagaaggcgtttttcggataaaatcgaggaatttgttttgttttgtaaggaattagggtttgttgatttttagattttaacgagaatttttgtttttcgtaggcgttttataaatttttattggataattttatcgcgcgttattgggttttcgggagattcgtgatttttattcgttttgggcgcgggttcgtagagttttaattcgcgttttcggtagtcgggatttttcgttcggatcggtttttaggttggaaatattatggttcgtattcggggcgtagtcgagatttatcgcgtcggaggtttcgggattcgtttagatcgttgtttggttattttacgtttttgagttttttatatagttagtttcgtgattttcgagtttcgtgattttcgagtttcgtgatttttaagtttcggaagtcgttgtaggtagcggtttagttaggtttcgttttttttatcggagttttacgcgttaattttagttaggtttcgttttcggtcgttttaggcgtggatttaagttaggtttcgttttttgtttggttattttaggcgtttatcgttttaggcgttttttagtttaagtttaatgttcggttgttttagacgtcgatagttttatgtttcgttttttaatcggttgttgttggcgttttttggtttaggtttcgttttttattcggttgttttaggtattttttaggttagatttcgttatttatcggtcgttttaggcgttcgtagttttaagtttcgtttttcgttcggttgttttaggcggttttcggtttaagtttcgttttttgttcggcggttttagaggttcgcggttttaggtttcgatttttgttcggttgtataaggcgttttttgggttaggtttcgtttttagttcggtcgttttaggtttcgtttcgttttttttgtgcgcgtttcgttcggtagtttgtgggacgcgatcgcggcgttagtttcgtttttttgtgttgcggcggcggtttttcgagtttttttcgacgcgttttttaggttagcgagtttcgcgtttttcggtgacggattatgtcggcggcgggagcgggcgcgggcgtagaggcgggtttttttagcgaggagttgttttcgtttcgtttttcgttgtatcgcgtttgtcgcgacggggatttggttacgttttgttcgttgttgtagtagatattttacgtttatttggtttttgaggattttttttatggttggacgttcgtgtattgggtcgcgtatttcggtaaggtgggtgcgaacgttttaaggcgttatttttttcggttgtttagtgggagtcggggaaagcgggtttgaggtgcgggggacgtggggcgtgtcgggatcgcggggcggaagcgggatcgacggcgtttgtgtttcgaggggtttagggcgtttgtgcggtagcgttcgcggttcggagtcgcggcggggtagtcggggggcgcggggcggaagcgaggtcggtggcgtttgcgttcggaggggtttagggcgtatgtgcggcggcgcgcgtagtaagtttttaataaggcgggttttaagggtttcggcgtttgttggtcggattttgtgcgagcgcgcgcgcgcgcggatggtgcggggttttttaggtcgggtcggaggcgcgagcgatttcgtagagtcgggtattaggtcgcgaagtcgtttaggcggttttcggggagtcgagttggggttagaggcgcgcggggaatgttcgggcgcggtcgattttttggtttcgtatagtttcgttagtagtcgagggtcgcgttgcggacgagtttagtcgaggagtaagcgtttcggcgggattggaaggtttcgg

SEQ ID NO: 11544 - DNA, 944 bp, synthetic construct
  misc_feature 1..944: note = Description of Artificial Sequence: Synthetic polynucleotide
  source 1..944: mol_type = other DNA
cgtttatagggcgtcgcggcggcgttgtagagtttatagtagttcgtgtcgtcgtttcgttcgttagcgttttagcgaggaagtagcgcgtagttcgcggtttagcgtattcgtagtagcgttcgtagttcgttcgcgttatgttttaggcggtcgagcgtttttaggagtgggttatggagggttttcgcgacgggttgaagaaggagcggttattggacgatcgttacgatagcggtttggattttatgaaagacgaggagtacgagtagatggttaaggagttgtaggagattcgtttcgagtcgtaggaggtgtcgcgcggttcggagttttggaagtagtagtttatcgaggacggggattcgtaagtggcggaggttcggggttgggggtcgtcgggagggcgggacgcgcgcggtttgggggtgggaggcgtcgggtttggagttcgagtcgggggattagcgatgtagtcgggcgggcgtcgcggtatttcggggtttttgtatcgtttcgaacgttgtagggttgtagggtcgcgcggggtatcggtttaattcggaggggcggcggttgggttttggtggatggtagcgtcgttatacgttttttttttttagattcgttttttaggtcgggggcggggcggtagcggggacgcgaagttttcggttgtataaggcggggcgggagtttttggtcgttggcgggcgtcgagtagtcgggaggggaagtatagggcgtttcgagttggcgggagggcggggcggtttggtcggcgttcgtcggggtcgcggggggaggggggcggaaagtttttgggcgtttgttaggaatatttagtttataataatttcgcggaaaatatcgcggtttcggtttttagaaatttcggttttgcgtaatttttcgtagttcgcgtttttttgggttttacgcgg

SEQ ID NO: 11545 - DNA, 1514 bp, synthetic construct
  misc_feature 1..1514: note = Description of Artificial Sequence: Synthetic polynucleotide
  source 1..1514: mol_type = other DNA
cggagtcgaattcggtgtttttgttcgtttggggtttcgttagcgcgtcgtaagtttttttagaaatttaaattttgtaggtcgtatttttaattcgtattttatttaggttttcgtttggcgtcgatttgttttagtttaattttcggtttcgtagattaggtatttttcgggacgcggggtagattttgcgttcgggttttttttcgtagtcgggttgttcggtttttgcgcgcgtataataggcggtacggcgtagttttcgggagcgcgggattcgggtgttagtttcggcgtttagttatagcgatatagatttgggtgtcggggttcgttagggagttttgtgattcggggattttcgcgatgtagagaattagggatcgcgtacggagtttaggcgcgtagtttgtagttaggattagtttttcgttttcgtcgttgaagtcgtttcgagttttacgtttttttcgttgtcgggttcggttgttttagggtttcgttcgttcgttttagagtgagcgattttcgatttacggagaagcgattttattatcggtgttcgatatttagagttaagggagcgagaagaaggcgaagaaagaggcggagagcggtgtattgttttcgttgggattcgcgatttttagaaattttttcgaaatttagtttcgtcgtcgtttcgtcggtagggggtatagcgggcgttcggggcgcggcggttgagcgatggggcgagcggaaagggtttagacgtttggtttttgtttatatttcggagaaagttttgagtattaggcgttgggttttttggttatttttttgattttttttatcggcgtcgagtttgttttattttttttagttttttggtttcgttagttagaggggcgtttcgcgttcgtttcgttttttatttacgtttttcgattcgattcgttttttcgaattttcgttttttgagatttcgttttcgattcgttttaattggtcgcggcggtagtcgagtcgcgggagttgcgcgttgagttcgcggtagtacggggagcgttcgttcgtttcgttttggatttaattaagcgtttcgcggaggggtgcggttatttgggggtaggagaaagcggagtacgttatttttttagggatttaggaagcgaggcgagttttaggtggacgcggtggtgtggattacggcgattagggtttttttttttgttgtggagacggaggtgcgaggggacgtcggcggttttttattttttggtcgagtggtttttttcgttttcggttggattttttcggggcgttttttttagagtcgagtcgggttggtcgggggcggttgtttggtttgagtgtcgttttattaaagcggaacgtcggaggggaggttatttcgagagaaggcggttttcggcggaggtggtttcgtgaattttgtagttttttgttcgttcgttattcgagacgtcgcgtttcgtgggttttacgttggatggagggggcgtcgtcga

SEQ ID NO: 11546 - DNA, 2144 bp, synthetic construct
  misc_feature 1..2144: note = Description of Artificial Sequence: Synthetic polynucleotide
  source 1..2144: mol_type = other DNA
cgcgtttggatgcgtttttcggattcggttttatataagttttagtttttcggattttgtatttttttcgcggatttttttatttttttatttttaggtttagatttttttttgtcggaatcgttacgtttttttatttttttattttcgttttattcggtttttttttttttggtttttattcggttaggttgtttcgttttggtagttttcgagggtcgttcgaggttttcgtttattaatcgttttcgtttggaagaatgcgttcgttcgagcgtattttcggcgggtgttaaagtttttcgttttaataggtgtttttgtttggttacgtatagttttgttatttggggttcggacggagacggcgataggatcgttttttgtagggcggttgcggtttcgtacgttttcgttcgggtttttagagcgttaagggttttcgtagtttcgtcgtcgttttcgttgtgttatattgtttttgtttttttgttcgtttagatgtcgcgaggttgattttatgtaagggtatcgttaagttcgggcgttgatattgtttatttattcgtggtggcggattttaaggttgggagtgagagacgcgtatagtgcgagatttttttttaatttagagaatttcggggaagttgggtgttcgcgtcgaagaagcgggtttaagttgattcggtttagaagggggttcgaagttaggcgtagcgtttagagagtttttttttatttacgtttttattcgatgttttttgtttttagaaggttggagaggggttgcgtattgttatttacgcgttcggttgcgagtggtttttatcgttcgttcgtcgcgcgttgggttcggtagtttttcggggtatacgaggttttcgtagtttttagattttcggtttcggtagcgtagagtcgggagagtcgttacgtttttagtcgcgcgcgtacgtcgggtttattaaatttgtagtatttttttttagtttttattttttgttatttttttttagtcggtgcgttttagtttcgtcgttcggtagaggttgttataataacgggtaggaatgttttaatatatataaagtcggttcggcgtagcgggtatttagttttggtcgggtttcgcgttttcggtcgtcgcgtagggtttggacgcgcgtcgcggttttttagtcggtcggtcgacgttcggggcgtatttataatgagcgggatggtgcggttttcgcggagttgtttcgattttttgtttgttttttgcgcgtttcggtcgtcggaggatgttgcgtgggttcggttgttttgttataagtagtagaaagtgtttaggatttaggttacggttaggatggcgatggtattggcgcggattttttttatggtgggtagacgggcgttttaggtgggggattgggtcggcgtgttttcggggtcggggcgggggcgttcgtagttttagttgtttgttttcgttcgcgtttagttgtttagttttgtagagtagaaaaaggagagaggtgggggggcgggggggtgatagggagagataggatcgcggagcgatttttacggttttaatgttttttagtttcgagcgcgcgcgtttttcgggcgtttatttattcgtgcgtagggtcggtttcgcgttttagtcgtcgtcggttgatttattaggttattgcgtattgggagagaagcgcgtcgagtgggaagcggcgcgggtttttttttcgcgttcgggaattcggcgagatagacgttcgcggcggaatggcgattggttaaagttagtttcggtttttatcgttaggtgatcgaacgttcggtagttgttttcgcgcggttttggtcggttttgtcgatttatatttattttcggatcgagcggttttgagttatcgattggagacgcgcgattttcgatttgggttcgcgtcgcgagttgtagtttcgggttgcgttttggcgcgggatttaaggtgtgttcggcgagtttttgtgtaggggcggttgggcgggggagagttttgagtttgtattggaatttgtagttgagattagttagatcgggttcgtttagaggagggattggaagttggtgtatttgatattcgaagagcgcgaaggggaaacgacgt

SEQ ID NO: 11547 - DNA, 379 bp, synthetic construct
  misc_feature 1..379: note = Description of Artificial Sequence: Synthetic polynucleotide
  source 1..379: mol_type = other DNA
cggtgcgggttcgtttttttttagtttagtttttttgatatcgttttttttttggggacgttgtttgcgggttcgcgcgttttcgttttcgatttttttgtaggttttttcgggggtcggggtaggatcgtatttatcgaggattcgggcgttggagttagtagtagcggtacgagtaggagtagtcgtattttagtttgcgggagacgtattgggttagagcggttcggggttttcgtagttgttttgggcgcgggcgagagtgtgtgggcgcgtttttttttatggtttataggtgattaggagattcgtaataggatagtcgggtgcgtttcggtgtatcgtagagaatatagcgtgagggcgtttcgtcgggcgg

SEQ ID NO: 11548 - DNA, 637 bp, synthetic construct
  misc_feature 1..637: note = Description of Artificial Sequence: Synthetic polynucleotide
  source 1..637: mol_type = other DNA
cgtcgttttatttttaataagtcgaagtttttgaaggaggttcggtgttatttcggtgtgatcgcgtttcggcgacgttgggtagggtgtagggagttagttcggtcgcggtttagcgggaggggagggggtcggtttcgaattcgggcgttcgggtcgcgggtgatttattgggaacgttaggttcgcgcgtttagatcggcgggcgacgtttagcgcgttttacgtttttcgttcgggtcgttcgcgtagaagtagttttcgcgtatttttgtttttcgagacggattcgtcgggaaggagtttggagtcgggcggtcggcgggtagtaatttttttttttttagttattatggtcggtgcgattttttattcgcgttcgtagacggattttttggaaagtatcgggttgggtttatttgattggcgttcgtaggggtcgtcgatttttttatagatttacggaaattgtcggtcgtaagtcgaggttcggtttttagtattcgtcggttcgttcgcgtcggttttttaaagagttgttagatttattcgttagtagtttttttattcgatcgttttgtaggtgcggtgggtttttttttcgttttcgacgcgcgtgcgtattttcgtgtcgcgg

SEQ ID NO: 11549 - DNA, 959 bp, synthetic construct
  misc_feature 1..959: note = Description of Artificial Sequence: Synthetic polynucleotide
  source 1..959: mol_type = other DNA
cgggagtggggcgggtaggaacgagggtttgagtttaggatcgtaattttcgtgaggggttcgaggattttagtttaacgtttcgtcgggtttcgtttttatttttttttttatggcgagttcgtcgaggtttcgtcgtttcgttattcgtttttagcgtcgcgcgggttttgttatcgcgtttacgttcggttaggcggcgatttttcgcgttttgtttcgtcggttgtcgggggtttaagaaatttcgggggggcggggtcgggggcggggtgaggttttcgggggtcggggcggggtcggggagggggcggtggggtcgggggttcggtttagggcgggaaatgggtggggaggggcggggtttgggttggagattggacggaggagtcgggcggagatgtaattggaggaagagggcgggacggggcggagaaggtttttcgtatcggcggagggagagggattaggagggggttgcggcgggggaggagagggggttttcggtttagagattgaggcgagggtggcgggagcggcgcgtaggtagggttggggtggggcgtatatagtgagcgttgggggcgttggcggtggagtttttgaggtttttcgaattagtgggttggggttgcgagatcgagtcgagttgttttgggcggttagagatgtgggtatatagaggttttttttttttttttttcgacgtcgggtagtgggcggtggtttggttttttttttggaatttttgggcggggtcgggtttggagtttgggtttttgttcggagggtggtgttataggaagagttggagttgagagtcgggatttcggggtttttttagggggcggttcgtttttggtttttaggggtttttaagcgtagtgtttttttgttttttttgggtatcgtttaatttttttcgtatttgagggtcgattattttttcgatttcgcgg

SEQ ID NO: 11550 - DNA, 826 bp, synthetic construct
  misc_feature 1..826: note = Description of Artificial Sequence: Synthetic polynucleotide
  source 1..826: mol_type = other DNA
cgtttatttttgcggcgtcgtgaaagaaggcgtaggaggagggagttttgatattttttttcgggttggggttttatagcggcgaaaagacggagggagtgatcgggggtcgcggggattttttcgggacgggttttcgtcggaggagtttcggaaagtcgttttttattttcgaggtttcgtttgcgcgggcgttttattagcggtcggggtggtggcggcggcggcggcggcggcggcggcgcggggcggggcgtcgcgatttttgttttttttttgggtcgagcggtaggcgcgttcgtatcgttttcgttttttcgtcgtagtcgttgtcgatcggttggttgggttttgcggcgtgaggatttcggcggcgtcgtagtttcgcgagttatggtttagttcggcggggaggttcggttcgggtttaagacggcggtgtagattcgcgtcgttatttaggaggtcgaggacgtggacgagttggaggacgaggaggagggggcggagattcggggcgtcggggattcggttcggtattttagtttcggttggggtagcgcgagcgaggaggagtcgagtcgcgggtataggtaggcgcggcggttggttcgggaggtgggtttcgagggggcgtcgggtcgcgcgcgagttcggggcgttgattgcgcgcgataatttttcgggtagagggggttgagttagtttcgtcgtcggggaagtagtttcgggtcgagtttttgagttagaatcggttcgtggaggtagtcggtgttttagttcgtagtttcgtcgtttaatcgaggtttttagggttggcggtcgg

SEQ ID NO: 11551 - DNA, 2156 bp, synthetic construct
  misc_feature 1..2156: note = Description of Artificial Sequence: Synthetic polynucleotide
  source 1..2156: mol_type = other DNA
cgttcgaggaatcggtttaatcgtttttcgttgtagtcggtttgtttttttttcggaattatcgagggagaggcgcgtgcggaggtcggcgttcggatttcgtattcgttattgttgtcggcgtattttttcgaagttttatttcgaagggttgggttttattcgcgcgttttgtgcgtgtttttttgtttttttacgttttttttgtttggttgttgcgaggttttgtaggggaaagattggcgcggggttcgtattttgtttatgttataggaaaatcgtgggagttttttcgacgcggcgtattttcggaagttttttttttaggagggttgcgggaaggtcgggattttgtatttagacgaattcggtcgttttttaagaggaaagtcggagatttagttgaggggtaaaaatgttagggaaaggcgagtttagagtttggtgatggagaaattgggaagttattttttattttttaattttaggatggggaattcgtaattgaagtcggagttttagatttggggcgtatttttagtttagtttaggaaagagatttaagggcgtagtagtgtggatattttttatttcggtttcgaaggtttagcgagggtttaatttgggttttttgttaggttcgtttttcgtttttttttagttttcggttcgtgcgtcgttgtttttttaagaagtttaggtaggtaggttcggttgttggagtcgtttttatggtaattcgcgagttgcggcggttttatgaatatttcggggcgcgggagttcgagcgttgtcggagggcgtttcgggggaggcggtcgttgatgtaagttcggcgggtcgttgggtttcgttcggttgcggcgggagtttcgggacgggtcggacgggtcggggtagaggaggcgaggcgagttcgcgggtggttagttataaagttcgggcggcgagatagacggatagttagttttttcgcgggacgtacgttcgggattcgcgcgggtcgtgcgttttgtatttcggagcggttttttgagcgtcgcggtcgtagagttttttcggtcggcgtttattgtttttcgcgggggcggggcgtttggagtcgggcggcgcgtcgcgtttttgaacgttagagggagggagggaggtaagaagggagcgcggggttttcgcgtttagtcgggttcgggaggaggtgtagcgcggcgagttcggggattcggagcgggattaggatttttttcgcggcgcgtagtttgtttaagtatgggcgtttgaggttgtttttacgtcggcggtaaaggacgcgtttttacgggcggattgatcggcgggcggatttggagttcgttcgcggcgtcgcgtttttgttttcggttcggttcgatttcggtttttggcgttatggataagttgtcgtcgtttatgcgtaagcggttttatagtttttcgtagtaggtgggggttaaggcgtggattatggacgaggaagaggacgtcgaggaggagggggtcgggggtcgttaagattttagtcgtaggagtattcggttgcggttattgttttcgttttttttttcggcggtcgcgggtggtacggagtttcggagttcggttttcggggtagcggatagcgaagggtcggttcgcggcgcgggtaagtttagtacgaacggcgattgtaggcgttttcgcgggagtttggtttcgttgggtagtcggggcggcggtagcggcggtacggggagcggtagtagttacggatatttgtatgatttcgcggaggagcggcggtttatcgtcgagggcgacgcgtttttcggcgaggataggacgtttttaggtttggcggtcgagttcgagcgtttcggcgtttcggcgtagttcgtagtttcgtcgtcgtcgttttagtagttatcgtagtcggttttcgttttttgcgagtagttttcggtggatatcgttattaaagtggagggaggcgcggttgtcggcgattagattttttcggaggtcgaggtgcgtttgggttaggtcggttttatgtagcgttagttcggggttatgttttaattcggggttaataaattttttttaaggatgttcggtagttagaaagtcgtggagcgcgaataggagagggttaagtcggtcgg

SEQ ID NO: 11552 - DNA, 1441 bp, synthetic construct
  misc_feature 1..1441: note = Description of Artificial Sequence: Synthetic polynucleotide
  source 1..1441: mol_type = other DNA
cgtaaggaggaaaacgtggaatcgaatatagtagttgcgggatcgtattacgtgatttttttttcgcggtcgttttatagaatttgtgggaaggggggggagggggagtgtcgtcgtaatttcgaggataggttagtagttcgcgggttcgattttagtcggcgttttcggggttattatattttttcgtcggcggggaaattatattttttatacgttcgaagtcgtcgttttttcgatacggttcgttcggtcgtacgtatacgttacgggtcggcgtttttcggtatacgcgcgaaggtcgggtttcgtttcgttttttatcgatttcgcggagcggcgattatcggttttaattagtttcggatttcgggcgcgttcgggtcggtttttttttcggtttagttttcgttaatcgggggatttatttcgttgaattcgtttattcgggagggcgcgttttcgttttattgttttatattcgagggtaatagcggtcgtatcgtttatttgggtcggggggtttttttttcgttttcggtcgattgagtcgggttggggttttcgaggaagcgcgggtcgtcgggcggttggaagtgggggaaggagaggagggggagggggtcgggatatcgggagtcgttttttttttttttcgtcgattgcggttttcgtaggttggtcgggcgttttcgtatattcgtttagttttttatagtttcgcgtttcgttagttttttttttattttatttttatatatttttatttttatatatttatattcggtcgtttttcgtttttttattcgtttgtcgcgcgcgcgcgcgatttcgtttatatatagcgcgcgcgacgtcggcggagatcgtttcgtttttttagatcgaacgtcgttcgttcgtttgttgaggagcggcgcgcgtttcggtttcgtttttttggcgtcgcggcgcggcgggcggggggcggcggtcggaggagttgggggtcgggttagcgcgtcgagtattgtcgagcggatttgatatttgcgtcgagagtcgtttttttagtttttcgttcgtattcgagttatcgttggtttcgggggaagagaggcgatggatcgcgcgcggggagcgaaaagggagcgcgagggcgtttcgaggacgcgtttttttattcgtttttaaatcgtttttattgagaaagggaaacggatggggggggtggggggcgaggtttgtttttaattcgaaatcgcgagattagtttttttcgttgtacgtttttttcgtttttatattttttgtttaggttttattaatttgcgtttggaatttcgatacgagttttttattttttcgggcgtagggttttgtcggtatttcgacgtttttcgtttagttttttcgtcggtcgtcgttcggagttttcgtttacggtggttttttttttcgg

SEQ ID NO: 11553 - DNA, 734 bp, synthetic construct
  misc_feature 1..734: note = Description of Artificial Sequence: Synthetic polynucleotide
  source 1..734: mol_type = other DNA
cgggtttcgttcgttttgtttgcgggtcgatttcgcgacgtcgatcggttcgcgttttcgttttcgagcgtttcggcgggcggagttgcgggtgaggggggggttggtttggggggcgggggtttcgatgacggtatcggagcgcgtcgtattggggatggaaatttgattgtttggttcgggacggcgtttgtagttaggtaggtgagtgtgggtcggagagcgggttaggggcgaggatcgggtgggtggagggaggcgcgcgtttttttttcgcgtaggtttgggtttagtggttttgggagtcggtatttttgggagatttgattcggtatgaggagttcggtatttttgttttttagttttttggaagtttttttttggattggtcggcgtcgttttttcgatatttgggggttgaggtcggtatttcgggtttgcgtggaggggcgagcgttaaggttgcgagagtcgggtttcgatttgtaattattttttttaatttttatggagtttcgtttcgcgttcgtcgtttttagttttagttgttttgtttcggtttcgaatagcgtttgcggggttgttagagtattttcggagcgggagcgttgtgcggagagtaggggcgcgcggaagtcgggattgtatcgggttcggaacgtttacgcggaggggtgcgcgaaggtttatacggtattgcgaggtagagtttatcgttgtgtgtttagggtcgg

SEQ ID NO: 11554 - DNA, 935 bp, synthetic construct
  misc_feature 1..935: note = Description of Artificial Sequence: Synthetic polynucleotide
  source 1..935: mol_type = other DNA
cggcggtgtttagggggagagggttttagcgtcgtcgttttttaagtcgattcgttcgtatttggttttttttttatagggttggagtttggatgaagttttttatttttgttagattttagtcggggggtcggcgtcgcgaggtttttatgcgcgtttttaaagttgtcgcgggggaggggttatttttcgttcggggttgagattagtcgagtttttcgtttttgttcggttcgtttatttcgggcgtatagcgttagtcggagtagttttagtagttgcgtttttagttcgtacgcgtttaggtttagtatggcggcgcgcggttcgggcgtcgcggagtcgtcgaggagtcgtcgttcgtttcgtcgtcgtttcgttcggcgtttagtttcggcgcgattgcggtgagtttatttcggtcgggagcgtttttcgcgtttagtcgcgttcggtagagagtttttagtcgtttcggatttcgcgtagtttcgtagagacgcgcgtgtcgttcgtacgggtcggtattcgggtcgttttcgtcggcgtgttaggatttcgtatagaagcgttcggacgcggacgtacgtagtcgcggttacgattttcgtcgttcgttcggttcgtgttcggttttggttagtagggttgttttatttttacggcgcggcgggagttcgagggggttttttgggaaattttttgcggggcgtcgtggcgtaggtgcgtttttatttttagggttttattattcgcggttatatttggggtcggatcgcgcgttttttttttttttttcgtttttgagggagtttttgtttgggtcgagggggatttcgggggtttgtttagttttggggtgaggggttggtttaatattttataggtttacggttattagtagggcgggattatagtgggcgcgggtcgtacgt

SEQ ID NO: 11555 - DNA, 1054 bp, synthetic construct
  misc_feature 1..1054: note = Description of Artificial Sequence: Synthetic polynucleotide
  source 1..1054: mol_type = other DNA
cggggtgggggatattcgggttgagttagttaagtcgggagtgtgaggagtagcgggggtcggtaggaacgtggacgcgagattggggagtagtggggttgtttgtgcggggatgtagtttttattaagtatacgggtcgagggttgattataggtagagtagcgttttttggtagcgttgcgggtgtggatgagggaagttaggtttcggatttatatttagacggtcgttttttagtttgtttttttttttttgtgggtttttaaagtgcggtttggtttttttatttcgattttgaggtttggaggtggggacgggattgtgggcgtcggtaaacgtgagttttcgagcggggcgggaaaggagtttcgcgaatgttttttttagtttcggcgttttacgtgtaggtttatgattgggagcgtttttaatttaaatcggtattgcgtcgggattattttttttttggcgtcgttttcgtcgtttttttcggatttttttcggttttttttttatttttcgttttcggggtttttttttgttgagcgggggttgtcgggatttgggattgcggggttgtttcgatttcgtagtcgttcgcggtggaagttagttcgggtttggttttgagcgcgcggttggggcggtcgttgtttatggtgttggcgcgggtggcgcgtcggtcggcggggtttgcggaggtttaggcgtttttggcggggaaggcggcgttttcgggtttggggagcgagggttttcgttttaggggtacggaggatatttagattggggcgttcgtgggtttggtgttgtcgtttcgggcgtcggtattttgcgatatttttttttttcggttttgggagggaatcgaggtagtttcgcgttaggttttttcggatatttggggtaaattcgttttttagagtttcgtgttttttttttaaatttgaggtagcgatttttttatttttaagggcggtcgtgaggtcgaattatgtgtcgattttagtcggtttttgtaaacgttgtgatgtcggttttcggaggtcgcgt

SEQ ID NO: 11556 - DNA, 1474 bp, synthetic construct
  misc_feature 1..1474: note = Description of Artificial Sequence: Synthetic polynucleotide
  source 1..1474: mol_type = other DNA
cgttagcgtcgatgttgttgttttttcgttttttttatttttatatatttttattcgggttttcgcgggtttttcgaattaagtttttagtttagtttttttaaatagtttatatagcgatacgggtattgggtaattgtaattagttttaatcggaagtatttgtttgtgggtgagatttatttgattttcggggtcggtcgttataagggcgagggttgaggatttttcgtgggggatatgggttttttattagtcggaaagttttagcgatcggttgggcgtttttgggtcggattcgcgtcgtcgttcgcgtattggggttttcgaggtgtgatgttatttgttcgtagaatcggtttttttcgcgtcgtttttttcgcgtttttattttagtttttttttcgtcgttttcggggttaatatggtagcggcgtcgtcgttttattttcgtaatcgtacgattcggttggtagggtcgtcggttcggattttcgagatttatatttcggttaggttcgtacgttttgcgtttcggattttcggcggtttttcgtagttttcggggcgtcgattttcgttcgttgttatacgaggttcgggcgttttcgatagttcgggattacgttagagtgacgttatatatcggatttcggcgagttgcgggtatgagtaacgcgcgcgttttcgttttcgagtttttttcgtcgtcgcgtttatcgttgaagattatggcggtcgaggcgtttatgacggcgaaaaacgaagtatattcggggtcgtttttggattcggatatgtttgcgggtggggagggggtaagttttgtgggtcgaggcggtggcggaggcgggggcgaggacgggtcgggtacgaaggtttgcgggcgggcggcggcgaaggcgattcggttcgttagtcgttgcgttttaaatattagtatcgtagaataaaatggcggtcgcggtcgcgttatatgatttgggtttcgtttttgcgagtcgtattatttcgtatcgtgggggagacgcgttttcgggacgttcggtcggttcgttgatttttttcgggttgtgtcgttcgtttagcgattcggtttcggcgttcggtttcgttttgtttcggttttcgcgggtgttttcgggcgtcgtcggtttttggattttcgtagcgttggatcggtttcgcgtcggggcggggcggtgtggtgtgtgttttattagtatacggggcggggtttcggacgtttcgttttttttgcggttgcgcgtcgtttgtaggtgttgggttttcggcgacgtttttttttgtatttttggcgtgaagttgtaggtcgtggtttcgcggttttgtttttaagacggggttttattttttcgggcgttggttttttaggatttttttattaattttgggcgagttaagggttttagtagatgtgcggcgcgcgggttttttttgttatagcgttcgg

SEQ ID NO: 11557 - DNA, 357 bp, synthetic construct
  misc_feature 1..357: note = Description of Artificial Sequence: Synthetic polynucleotide
  source 1..357: mol_type = other DNA
cgggagatttcgagattttcggtcggtgatagtaggcgattttttgtttttgttaatttgtgggtttttacggacgtggggaagggaggagggaggttttagttttttgcgggggaggggcgtgaagacgcgcgggggtggggggagatgagtcggcgtcgttatgataacgaggtcggtggttcggttttggggattcgggagggagggaggcgtcgtggtcgcgcgcgcgggcgggggcggggggttaggttttttaggagtagttggggaatattcggcgattttggcggttgttttttggtggcgtagggagttcgcgtgtttgcgagtgcgtgtgtgtgcgaagtttttcgg

SEQ ID NO: 11558 - DNA, 814 bp, synthetic construct
  misc_feature 1..814: note = Description of Artificial Sequence: Synthetic polynucleotide
  source 1..814: mol_type = other DNA
cgtcgtttaagagtttggggtcgtggggggcggggttgtttgttatcggtttcgtttcgtcgataggattcgtttttttttttaggttcggcggggtcgatttcgtttttcgtttttagtttgtcgtacgatagcggcggcgcggcgggcggagtcgggaggcggggaagtagtggtcgtgtgagcgtgaggagttgtcgttatcgtttgtttttcgtttttttcgtttttcggggttttagcgtcgtgggtcgcgtacggttttggaagagacgtcgtttcgtttttattcgttttttttatcgcgtcgttttttcgttttgttttgcgggtttaggcggaattcggaacggtcgtttttttttttcgtttttcgtcgtcgttttttttttttttttttcggttttttttttagtttcgggtcggagcggggtgtcggcggcggtcggttcgggcggcggcgtttggttatgtcgtgtcggggaaggtaatgagtcgtagagtttcggggtttcggttgagtagcggcggtattaattattcgcggagttggaatgattggtaatttaggtgggtgatcggttcgggatttcgtttcgatttttcgggtttcgtttcgggcgggtcgaggtttagggtcgcggggttgggaggcgcggtttaggttttttatttatcggagtcgggcgcggttttttgggttttttttttttcggttaggggaggaaggtcgcggggaggcgaggtttaagtgttttttttttttttgtttgtttagttcggggttgaagtcgagtttcggggttttcggcgg

SEQ ID NO: 11559 - DNA, 847 bp, synthetic construct
  misc_feature 1..847: note = Description of Artificial Sequence: Synthetic polynucleotide
  source 1..847: mol_type = other DNA
cgtggtgagatatcgatttcgtagagtagagggggcggcggtagaggggaagggttttcgtatttattttttttgtaggaggtgtatttgtatttttcgtatttgtaggagttcgcgtaggtgtaggagttatttagagagggcgacgttataggaagggttaatgtggacgaattcgggtttttacgtttgttacgaggagatggggtgttaagtttttttgtttttcgcgatataggtatgttcgttttttacgaggtgaagaatagggaattaggggttttttttttaagtgtttttgagcgaaggcgtagggcgtgggtttttttgtaggtataagggcgcgtagtgcgtaggatgcgagcgggggcgggggtttattagaagggtaggggtaggttttagggtttatgtcgaggagagtagtagttggaggcggtgaacgggtttttttaagtaattggacgcgcggtttggttagtggtagtaggtggcgatgtttttatagtttcgggcgggggcgcgtatgttaagttcgttgggcgttcgtttttgcgtatcgcgttcgtttttttcgtttgtgcgtttgggtttcggcgtacgtattgtatttgtcgttcgtttttgtcgtgtgtgtgtattgtcggggttcgttcgtttacgttcgcgcgtgcgtttttatttttatttcgtattcgcgtgtacgatttattcgtcgtcgttgtgcgcgtattgttagtttatttttcgcgtgggtttcgtaggggacgtgttcgtcgtagtagtcgttattgcgtggaagcgcgtacgtattattttcgaaagtggagaaaaaggcgttttgcgt

SEQ ID NO: 11560 - DNA, 589 bp, synthetic construct
  misc_feature 1..589: note = Description of Artificial Sequence: Synthetic polynucleotide
  source 1..589: mol_type = other DNA
cgtgggtgtttcggaggaaacggtcgtagttttaaattttttagtttttttagtagggagttttttcgcggagtttcgtttggcggtcggaagttattttaagtcgtttattcggaagtcgtcgttttggtaattgggtatcgttttattttttttttttagtaacgtttatcgttttagacgtttgaggttagtcgagtttcgattggtttttttgttttttattttgggagacgtttgagatttagcgtttttagatttcgtatttgaatttgtggcgtttggtgttcgcgagttgtcgaatgaagttgagcgttttagtggaattagggattttaggggtgagcgatcgcgaggggagagcgacgaaaagggcggtcggagttggaggggcgcggagttaaataaaaaagggcggtcggagttgtaggggcgtcgagttaaatacgttatttttagatggggggttttaggcgagttgtttagtttttttgaggtaggtttttcgtttgttcgttttttcgtagtttttgagttttttttttacgtcgtttttcggtagttttagagacgttacgtttgttttcgt

SEQ ID NO: 11561 - DNA, 20 bp, Homo sapiens
  source 1..20: mol_type = unassigned DNA
cgtggtgcgcgcggcgggcg

SEQ ID NO: 11562 - DNA, 116 bp, Homo sapiens; identical to SEQ ID NO: 8448
  source 1..116: mol_type = unassigned DNA

SEQ ID NO: 11563 - DNA, 44 bp, Homo sapiens; identical to SEQ ID NO: 8459
  source 1..44: mol_type = unassigned DNA

SEQ ID NO: 11564 - DNA, 34 bp, Homo sapiens; identical to SEQ ID NO: 8470
  source 1..34: mol_type = unassigned DNA

SEQ ID NO: 11565 - DNA, 211 bp, Homo sapiens; identical to SEQ ID NO: 8481
  source 1..211: mol_type = unassigned DNA

SEQ ID NO: 11566 - DNA, 95 bp, Homo sapiens; identical to SEQ ID NO: 8492
  source 1..95: mol_type = unassigned DNA

SEQ ID NO: 11567 - DNA, 264 bp, Homo sapiens; identical to SEQ ID NO: 8503
  source 1..264: mol_type = unassigned DNA

SEQ ID NO: 11568 - DNA, 59 bp, Homo sapiens; identical to SEQ ID NO: 8514
  source 1..59: mol_type = unassigned DNA

SEQ ID NO: 11569 - skipped

SEQ ID NO: 11570 - DNA, 324 bp, Homo sapiens; identical to SEQ ID NO: 8536
  source 1..324: mol_type = unassigned DNA

SEQ ID NO: 11571 - DNA, 102 bp, Homo sapiens; identical to SEQ ID NO: 8544
  source 1..102: mol_type = unassigned DNA

SEQ ID NO: 11572 - DNA, 24 bp, Homo sapiens
  source 1..24: mol_type = unassigned DNA
cgcaacgactcgctgccgcccacg

SEQ ID NO: 11573 - DNA, 521 bp, Homo sapiens; identical to SEQ ID NO: 8546
  source 1..521: mol_type = unassigned DNA

SEQ ID NO: 11574 - DNA, 1484 bp, Homo sapiens; identical to SEQ ID NO: 8547
  source 1..1484: mol_type = unassigned DNA

SEQ ID NO: 11575 - DNA, 34 bp, Homo sapiens; identical to SEQ ID NO: 8548
  source 1..34: mol_type = unassigned DNA

SEQ ID NO: 11576 - DNA, 14 bp, Homo sapiens
  source 1..14: mol_type = unassigned DNA
cggcgaggggctcg

SEQ ID NO: 11577 - DNA, 37 bp, Homo sapiens; identical to SEQ ID NO: 8550
  source 1..37: mol_type = unassigned DNA

SEQ ID NO: 11578 - DNA, 34 bp, Homo sapiens; identical to SEQ ID NO: 8551
  source 1..34: mol_type = unassigned DNA

SEQ ID NO: 11579 - DNA, 538 bp, Homo sapiens; identical to SEQ ID NO: 8552
  source 1..538: mol_type = unassigned DNA

SEQ ID NO: 11580 - DNA, 109 bp, Homo sapiens; identical to SEQ ID NO: 8553
  source 1..109: mol_type = unassigned DNA

SEQ ID NO: 11581 - DNA, 901 bp, Homo sapiens; identical to SEQ ID NO: 8554
  source 1..901: mol_type = unassigned DNA

SEQ ID NO: 11582 - DNA, 15 bp, Homo sapiens
  source 1..15: mol_type = unassigned DNA
cgggcggcgcgggcg

SEQ ID NO: 11583 - DNA, 383 bp, Homo sapiens; identical to SEQ ID NO: 8556
  source 1..383: mol_type = unassigned DNA

SEQ ID NO: 11584 - skipped

SEQ ID NO: 11585 - DNA, 624 bp, Homo sapiens; identical to SEQ ID NO: 8558
  source 1..624: mol_type = unassigned DNA

SEQ ID NO: 11586 - DNA, 94 bp, Homo sapiens; identical to SEQ ID NO: 8559
  source 1..94: mol_type = unassigned DNA

SEQ ID NO: 11587 - DNA, 63 bp, Homo sapiens; identical to SEQ ID NO: 8560
  source 1..63: mol_type = unassigned DNA

SEQ ID NO: 11588 - DNA, 41 bp, Homo sapiens; identical to SEQ ID NO: 8561
  source 1..41: mol_type = unassigned DNA

SEQ ID NO: 11589 - DNA, 1041 bp, Homo sapiens; identical to SEQ ID NO: 8562
  source 1..1041: mol_type = unassigned DNA

SEQ ID NO: 11590 - DNA, 23 bp, Homo sapiens
  source 1..23: mol_type = unassigned DNA
cgccttcggctcgggccatggcg

SEQ ID NO: 11591 - DNA, 515 bp, Homo sapiens; identical to SEQ ID NO: 8564
  source 1..515: mol_type = unassigned DNA

SEQ ID NO: 11592 - DNA, 1017 bp, Homo sapiens; identical to SEQ ID NO: 8565
  source 1..1017: mol_type = unassigned DNA

SEQ ID NO: 11593 - skipped

SEQ ID NO: 11594 - DNA, 54 bp, Homo sapiens; identical to SEQ ID NO: 8567
  source 1..54: mol_type = unassigned DNA

SEQ ID NO: 11595 - DNA, 10 bp, Homo sapiens
  source 1..10: mol_type = unassigned DNA
cgcgttgtcg

SEQ ID NO: 11596 - DNA, 26 bp, Homo sapiens
  source 1..26: mol_type = unassigned DNA
cgggcaggttcgaccaggcggccgcg

SEQ ID NO: 11597 - DNA, 934 bp, Homo sapiens; identical to SEQ ID NO: 8570
  source 1..934: mol_type = unassigned DNA

SEQ ID NO: 11598 - DNA, 279 bp, Homo sapiens; identical to SEQ ID NO: 8571
  source 1..279: mol_type = unassigned DNA

SEQ ID NO: 11599-11600 - skipped (2 entries)

SEQ ID NO: 11601 - DNA, 11 bp, Homo sapiens
  source 1..11: mol_type = unassigned DNA
cgagcgcatcg

SEQ ID NO: 11602 - DNA, 30 bp, Homo sapiens; identical to SEQ ID NO: 8575
  source 1..30: mol_type = unassigned DNA

SEQ ID NO: 11603 - DNA, 10 bp, Homo sapiens
  source 1..10: mol_type = unassigned DNA
cgctcccgcg

SEQ ID NO: 11604 - DNA, 56 bp, Homo sapiens; identical to SEQ ID NO: 8577
  source 1..56: mol_type = unassigned DNA

SEQ ID NO: 11605 - DNA, 98 bp, Homo sapiens; identical to SEQ ID NO: 8578
  source 1..98: mol_type = unassigned DNA

SEQ ID NO: 11606 - DNA, 33 bp, Homo sapiens; identical to SEQ ID NO: 8579
  source 1..33: mol_type = unassigned DNA

SEQ ID NO: 11607 - DNA, 48 bp, Homo sapiens; identical to SEQ ID NO: 8580
  source 1..48: mol_type = unassigned DNA

SEQ ID NO: 11608 - DNA, 42 bp, Homo sapiens; identical to SEQ ID NO: 8589
  source 1..42: mol_type = unassigned DNA

SEQ ID NO: 11609 - DNA, 40 bp, Homo sapiens; identical to SEQ ID NO: 8600
  source 1..40: mol_type = unassigned DNA

SEQ ID NO: 11610 - skipped

SEQ ID NO: 11611 - DNA, 42 bp, Homo sapiens; identical to SEQ ID NO: 8622
  source 1..42: mol_type = unassigned DNA

SEQ ID NO: 11612 - DNA, 20 bp, Homo sapiens
  source 1..20: mol_type = unassigned DNA
cgcccgccgcgcgcaccacg

SEQ ID NO: 11613 - DNA, 116 bp, Homo sapiens; identical to SEQ ID NO: 8634
  source 1..116: mol_type = unassigned DNA

SEQ ID NO: 11614 - DNA, 44 bp, Homo sapiens; identical to SEQ ID NO: 8645
  source 1..44: mol_type = unassigned DNA

SEQ ID NO: 11615 - DNA, 34 bp, Homo sapiens; identical to SEQ ID NO: 8656
  source 1..34: mol_type = unassigned DNA

SEQ ID NO: 11616 - DNA, 211 bp, Homo sapiens; identical to SEQ ID NO: 8667
  source 1..211: mol_type = unassigned DNA

SEQ ID NO: 11617 - DNA, 95 bp, Homo sapiens; identical to SEQ ID NO: 8678
  source 1..95: mol_type = unassigned DNA

SEQ ID NO: 11618 - DNA, 264 bp, Homo sapiens; identical to SEQ ID NO: 8689
  source 1..264: mol_type = unassigned DNA

SEQ ID NO: 11619 - DNA, 59 bp, Homo sapiens; identical to SEQ ID NO: 8700
  source 1..59: mol_type = unassigned DNA

SEQ ID NO: 11620 - skipped

SEQ ID NO: 11621 - DNA, 324 bp, Homo sapiens; identical to SEQ ID NO: 8722
  source 1..324: mol_type = unassigned DNA

SEQ ID NO: 11622 - DNA, 102 bp, Homo sapiens; identical to SEQ ID NO: 8730
  source 1..102: mol_type = unassigned DNA

SEQ ID NO: 11623 - DNA, 24 bp, Homo sapiens
  source 1..24: mol_type = unassigned DNA
cgtgggcggcagcgagtcgttgcg

SEQ ID NO: 11624 - DNA, 521 bp, Homo sapiens; identical to SEQ ID NO: 8732
  source 1..521: mol_type = unassigned DNA

SEQ ID NO: 11625 - DNA, 1484 bp, Homo sapiens; identical to SEQ ID NO: 8733
  source 1..1484: mol_type = unassigned DNA

SEQ ID NO: 11626 - DNA, 34 bp, Homo sapiens; identical to SEQ ID NO: 8734
  source 1..34: mol_type = unassigned DNA

SEQ ID NO: 11627 - DNA, 14 bp, Homo sapiens
  source 1..14: mol_type = unassigned DNA
cgagcccctcgccg

SEQ ID NO: 11628 - DNA, 37 bp, Homo sapiens; identical to SEQ ID NO: 8736
  source 1..37: mol_type = unassigned DNA

SEQ ID NO: 11629 - DNA, 34 bp, Homo sapiens; identical to SEQ ID NO: 8737
  source 1..34: mol_type = unassigned DNA

SEQ ID NO: 11630 - DNA, 538 bp, Homo sapiens; identical to SEQ ID NO: 8738
  source 1..538: mol_type = unassigned DNA

SEQ ID NO: 11631 - DNA, 109 bp, Homo sapiens; identical to SEQ ID NO: 8739
  source 1..109: mol_type = unassigned DNA

SEQ ID NO: 11632 - DNA, 901 bp, Homo sapiens; identical to SEQ ID NO: 8740
  source 1..901: mol_type = unassigned DNA

SEQ ID NO: 11633 - DNA, 15 bp, Homo sapiens
  source 1..15: mol_type = unassigned DNA
cgcccgcgccgcccg

SEQ ID NO: 11634 - DNA, 383 bp, Homo sapiens; identical to SEQ ID NO: 8742
  source 1..383: mol_type = unassigned DNA

SEQ ID NO: 11635 - skipped

SEQ ID NO: 11636 - DNA, 624 bp, Homo sapiens; identical to SEQ ID NO: 8744
  source 1..624: mol_type = unassigned DNA

SEQ ID NO: 11637 - DNA, 94 bp, Homo sapiens; identical to SEQ ID NO: 8745
  source 1..94: mol_type = unassigned DNA

SEQ ID NO: 11638 - DNA, 63 bp, Homo sapiens; identical to SEQ ID NO: 8746
  source 1..63: mol_type = unassigned DNA

SEQ ID NO: 11639 - DNA, 41 bp, Homo sapiens; identical to SEQ ID NO: 8747
  source 1..41: mol_type = unassigned DNA

SEQ ID NO: 11640 - DNA, 1041 bp, Homo sapiens; identical to SEQ ID NO: 8748
  source 1..1041: mol_type = unassigned DNA

SEQ ID NO: 11641 - DNA, 23 bp, Homo sapiens
  source 1..23: mol_type = unassigned DNA
cgccatggcccgagccgaaggcg

SEQ ID NO: 11642 - DNA, 515 bp, Homo sapiens; identical to SEQ ID NO: 8750
  source 1..515: mol_type = unassigned DNA

SEQ ID NO: 11643 - DNA, 1017 bp, Homo sapiens; identical to SEQ ID NO: 8751
  source 1..1017: mol_type = unassigned DNA

SEQ ID NO: 11644 - skipped

SEQ ID NO: 11645 - DNA, 54 bp, Homo sapiens; identical to SEQ ID NO: 8753
  source 1..54: mol_type = unassigned DNA

SEQ ID NO: 11646 - DNA, 10 bp, Homo sapiens
  source 1..10: mol_type = unassigned DNA
cgacaacgcg

SEQ ID NO: 11647 - DNA, 26 bp, Homo sapiens
  source 1..26: mol_type = unassigned DNA
cgcggccgcctggtcgaacctgcccg

SEQ ID NO: 11648 - DNA, 934 bp, Homo sapiens; identical to SEQ ID NO: 8756
  source 1..934: mol_type = unassigned DNA

SEQ ID NO: 11649 - DNA, 279 bp, Homo sapiens; identical to SEQ ID NO: 8757
  source 1..279: mol_type = unassigned DNA

SEQ ID NO: 11650-11651 - skipped (2 entries)

SEQ ID NO: 11652 - DNA, 11 bp, Homo sapiens
  source 1..11: mol_type = unassigned DNA
cgatgcgctcg

SEQ ID NO: 11653 - DNA, 30 bp, Homo sapiens; identical to SEQ ID NO: 8761
  source 1..30: mol_type = unassigned DNA

SEQ ID NO: 11654 - DNA, 10 bp, Homo sapiens
  source 1..10: mol_type = unassigned DNA
cgcgggagcg

SEQ ID NO: 11655 - DNA, 56 bp, Homo sapiens; identical to SEQ ID NO: 8763
  source 1..56: mol_type = unassigned DNA

SEQ ID NO: 11656 - DNA, 98 bp, Homo sapiens; identical to SEQ ID NO: 8764
  source 1..98: mol_type = unassigned DNA

SEQ ID NO: 11657 - DNA, 33 bp, Homo sapiens; identical to SEQ ID NO: 8765
  source 1..33: mol_type = unassigned DNA

SEQ ID NO: 11658 - DNA, 48 bp, Homo sapiens; identical to SEQ ID NO: 8766
  source 1..48: mol_type = unassigned DNA

SEQ ID NO: 11659 - DNA, 42 bp, Homo sapiens; identical to SEQ ID NO: 8775
  source 1..42: mol_type = unassigned DNA

SEQ ID NO: 11660 - DNA, 40 bp, Homo sapiens; identical to SEQ ID NO: 8786
  source 1..40: mol_type = unassigned DNA

SEQ ID NO: 11661 - skipped

SEQ ID NO: 11662 - DNA, 42 bp, Homo sapiens; identical to SEQ ID NO: 8808
  source 1..42: mol_type = unassigned DNA

SEQ ID NO: 11663 - DNA, 20 bp, synthetic construct
  misc_feature 1..20: note = Description of Artificial Sequence: Synthetic oligonucleotide
  source 1..20: mol_type = other DNA
ygtggtgygygyggygggyg

SEQ ID NO: 11664 - DNA, 116 bp, synthetic construct; identical to SEQ ID NO: 8820
  misc_feature 1..116: note = Description of Artificial Sequence: Synthetic polynucleotide
  source 1..116: mol_type = other DNA

SEQ ID NO: 11665 - DNA, 44 bp, synthetic construct; identical to SEQ ID NO: 8831
  misc_feature 1..44: note = Description of Artificial Sequence: Synthetic oligonucleotide
  source 1..44: mol_type = other DNA

SEQ ID NO: 11666 - DNA, 34 bp, synthetic construct; identical to SEQ ID NO: 8842
  misc_feature 1..34: note = Description of Artificial Sequence: Synthetic oligonucleotide
  source 1..34: mol_type = other DNA

SEQ ID NO: 11667 - DNA, 211 bp, synthetic construct; identical to SEQ ID NO: 8853
  misc_feature 1..211: note = Description of Artificial Sequence: Synthetic polynucleotide
  source 1..211: mol_type = other DNA

SEQ ID NO: 11668 - DNA, 95 bp, synthetic construct; identical to SEQ ID NO: 8864
  misc_feature 1..95: note = Description of Artificial Sequence: Synthetic oligonucleotide
  source 1..95: mol_type = other DNA

SEQ ID NO: 11669 - DNA, 264 bp, synthetic construct; identical to SEQ ID NO: 8875
  misc_feature 1..264: note = Description of Artificial Sequence: Synthetic polynucleotide
  source 1..264: mol_type = other DNA

SEQ ID NO: 11670 - DNA, 59 bp, synthetic construct; identical to SEQ ID NO: 8886
  misc_feature 1..59: note = Description of Artificial Sequence: Synthetic oligonucleotide
  source 1..59: mol_type = other DNA

SEQ ID NO: 11671 - skipped

SEQ ID NO: 11672 - DNA, 324 bp, synthetic construct; identical to SEQ ID NO: 8908
  misc_feature 1..324: note = Description of Artificial Sequence: Synthetic polynucleotide
  source 1..324: mol_type = other DNA

SEQ ID NO: 11673 - DNA, 102 bp, synthetic construct; identical to SEQ ID NO: 8916
  misc_feature 1..102: note = Description of Artificial Sequence: Synthetic polynucleotide
  source 1..102: mol_type = other DNA

SEQ ID NO: 11674 - DNA, 24 bp, synthetic construct
  misc_feature 1..24: note = Description of Artificial Sequence: Synthetic oligonucleotide
  source 1..24: mol_type = other DNA
ygtaaygattygttgtygtttayg

SEQ ID NO: 11675 - DNA, 521 bp, synthetic construct; identical to SEQ ID NO: 8918
  misc_feature 1..521: note = Description of Artificial Sequence: Synthetic polynucleotide
  source 1..521: mol_type = other DNA

SEQ ID NO: 11676 - DNA, 1484 bp, synthetic construct; identical to SEQ ID NO: 8919
  misc_feature 1..1484: note = Description of Artificial Sequence: Synthetic polynucleotide
  source 1..1484: mol_type = other DNA

SEQ ID NO: 11677 - DNA, 34 bp, synthetic construct; identical to SEQ ID NO: 8920
  misc_feature 1..34: note = Description of Artificial Sequence: Synthetic oligonucleotide
  source 1..34: mol_type = other DNA

SEQ ID NO: 11678 - DNA, 14 bp, synthetic construct
  misc_feature 1..14: note = Description of Artificial Sequence: Synthetic oligonucleotide
  source 1..14: mol_type = other DNA
yggygaggggttyg

SEQ ID NO: 11679 - DNA, 37 bp, synthetic construct; identical to SEQ ID NO: 8922
  misc_feature 1..37: note = Description of Artificial Sequence: Synthetic oligonucleotide
  source 1..37: mol_type = other DNA

SEQ ID NO: 11680 - DNA, 34 bp, synthetic construct; identical to SEQ ID NO: 8923
  misc_feature 1..34: note = Description of Artificial Sequence: Synthetic oligonucleotide
  source 1..34: mol_type = other DNA

SEQ ID NO: 11681 - DNA, 538 bp, synthetic construct; identical to SEQ ID NO: 8924
  misc_feature 1..538: note = Description of Artificial Sequence: Synthetic polynucleotide
  source 1..538: mol_type = other DNA

SEQ ID NO: 11682 - DNA, 109 bp, synthetic construct; identical to SEQ ID NO: 8925
  misc_feature 1..109: note = Description of Artificial Sequence: Synthetic polynucleotide
  source 1..109: mol_type = other DNA

SEQ ID NO: 11683 - DNA, 901 bp, synthetic construct; identical to SEQ ID NO: 8926
  misc_feature 1..901: note = Description of Artificial Sequence: Synthetic polynucleotide
  source 1..901: mol_type = other DNA

SEQ ID NO: 11684 - DNA, 15 bp, synthetic construct
  misc_feature 1..15: note = Description of Artificial Sequence: Synthetic oligonucleotide
  source 1..15: mol_type = other DNA
ygggyggygygggyg

SEQ ID NO: 11685 - DNA, 383 bp, synthetic construct; identical to SEQ ID NO: 8928
  misc_feature 1..383: note = Description of Artificial Sequence: Synthetic polynucleotide
  source 1..383: mol_type = other DNA

SEQ ID NO: 11686 - skipped

SEQ ID NO: 11687 - DNA, 624 bp, synthetic construct; identical to SEQ ID NO: 8930
  misc_feature 1..624: note = Description of Artificial Sequence: Synthetic polynucleotide
  source 1..624: mol_type = other DNA

SEQ ID NO: 11688 - DNA, 94 bp, synthetic construct; identical to SEQ ID NO: 8931
  misc_feature 1..94: note = Description of Artificial Sequence: Synthetic oligonucleotide
  source 1..94: mol_type = other DNA

SEQ ID NO: 11689 - DNA, 63 bp, synthetic construct; identical to SEQ ID NO: 8932
  misc_feature 1..63: note = Description of Artificial Sequence: Synthetic oligonucleotide
  source 1..63: mol_type = other DNA

SEQ ID NO: 11690 - DNA, 41 bp, synthetic construct; identical to SEQ ID NO: 8933
  misc_feature 1..41: note = Description of Artificial Sequence: Synthetic oligonucleotide
  source 1..41: mol_type = other DNA

SEQ ID NO: 11691 - DNA, 1041 bp, synthetic construct; identical to SEQ ID NO: 8934
  misc_feature 1..1041: note = Description of Artificial Sequence: Synthetic polynucleotide
  source 1..1041: mol_type = other DNA

SEQ ID NO: 11692 - DNA, 23 bp, synthetic construct
  misc_feature 1..23: note = Description of Artificial Sequence: Synthetic oligonucleotide
  source 1..23: mol_type = other DNA
ygttttyggttygggttatggyg

SEQ ID NO: 11693 - DNA, 515 bp, synthetic construct; identical to SEQ ID NO: 8936
  misc_feature 1..515: note = Description of Artificial Sequence: Synthetic polynucleotide
  source 1..515: mol_type = other DNA

SEQ ID NO: 11694 - DNA, 1017 bp, synthetic construct; identical to SEQ ID NO: 8937
  misc_feature 1..1017: note = Description of Artificial Sequence: Synthetic polynucleotide
  source 1..1017: mol_type = other DNA

SEQ ID NO: 11695 - skipped

SEQ ID NO: 11696 - DNA, 54 bp, synthetic construct; identical to SEQ ID NO: 8939
  misc_feature 1..54: note = Description of Artificial Sequence: Synthetic oligonucleotide
  source 1..54: mol_type = other DNA

SEQ ID NO: 11697 - DNA, 10 bp, synthetic construct
  misc_feature 1..10: note = Description of Artificial Sequence: Synthetic oligonucleotide
  source 1..10: mol_type = other DNA
ygygttgtyg

SEQ ID NO: 11698 - DNA, 26 bp, synthetic construct
  misc_feature 1..26: note = Description of Artificial Sequence: Synthetic oligonucleotide
  source 1..26: mol_type = other DNA
ygggtaggttygattaggyggtygyg

SEQ ID NO: 11699 - DNA, 934 bp, synthetic construct; identical to SEQ ID NO: 8942
  misc_feature 1..934: note = Description of Artificial Sequence: Synthetic polynucleotide
  source 1..934: mol_type = other DNA

SEQ ID NO: 11700 - DNA, 279 bp, synthetic construct; identical to SEQ ID NO: 8943
  misc_feature 1..279: note = Description of Artificial Sequence: Synthetic polynucleotide
  source 1..279: mol_type = other DNA

SEQ ID NO: 11701-11702 - skipped (2 entries)

SEQ ID NO: 11703 - DNA, 11 bp, synthetic construct
  misc_feature 1..11: note = Description of Artificial Sequence: Synthetic oligonucleotide
  source 1..11: mol_type = other DNA
ygagygtatyg

SEQ ID NO: 11704 - DNA, 30 bp, synthetic construct; identical to SEQ ID NO: 8947
  misc_feature 1..30: note = Description of Artificial Sequence: Synthetic oligonucleotide
  source 1..30: mol_type = other DNA

SEQ ID NO: 11705 - DNA, 10 bp, synthetic construct
  misc_feature 1..10: note = Description of Artificial Sequence: Synthetic oligonucleotide
  source 1..10: mol_type = other DNA
ygttttygyg

SEQ ID NO: 11706 - DNA, 56 bp, synthetic construct; identical to SEQ ID NO: 8949
  misc_feature 1..56: note = Description of Artificial Sequence: Synthetic oligonucleotide
  source 1..56: mol_type = other DNA

SEQ ID NO: 11707 - DNA, 98 bp, synthetic construct; identical to SEQ ID NO: 8950
  misc_feature 1..98: note = Description of Artificial Sequence: Synthetic oligonucleotide
  source 1..98: mol_type = other DNA

SEQ ID NO: 11708 - DNA, 33 bp, synthetic construct; identical to SEQ ID NO: 8951
  misc_feature 1..33: note = Description of Artificial Sequence: Synthetic oligonucleotide
  source 1..33: mol_type = other DNA

SEQ ID NO: 11709 - DNA, 48 bp, synthetic construct; identical to SEQ ID NO: 8952
  misc_feature 1..48: note = Description of Artificial Sequence: Synthetic oligonucleotide
  source 1..48: mol_type = other DNA

SEQ ID NO: 11710 - DNA, 42 bp, synthetic construct; identical to SEQ ID NO: 8961
  misc_feature 1..42: note = Description of Artificial Sequence: Synthetic oligonucleotide
  source 1..42: mol_type = other DNA

SEQ ID NO: 11711 - DNA, 40 bp, synthetic construct; identical to SEQ ID NO: 8972
  misc_feature 1..40: note = Description of Artificial Sequence: Synthetic oligonucleotide
  source 1..40: mol_type = other DNA

SEQ ID NO: 11712 - skipped

SEQ ID NO: 11713 - DNA, 42 bp, synthetic construct; identical to SEQ ID NO: 8994
  misc_feature 1..42: note = Description of Artificial Sequence: Synthetic oligonucleotide
  source 1..42: mol_type = other DNA

SEQ ID NO: 11714 - DNA, 20 bp, synthetic construct
  misc_feature 1..20: note = Description of Artificial Sequence: Synthetic oligonucleotide
  source 1..20: mol_type = other DNA
cgtggtgcgcgcggcgggcg

SEQ ID NO: 11715 - DNA, 116 bp, synthetic construct; identical to SEQ ID NO: 9006
  misc_feature 1..116: note = Description of Artificial Sequence: Synthetic polynucleotide
  source 1..116: mol_type = other DNA

SEQ ID NO: 11716 - DNA, 44 bp, synthetic construct; identical to SEQ ID NO: 9017
  misc_feature 1..44: note = Description of Artificial Sequence: Synthetic oligonucleotide
  source 1..44: mol_type = other DNA

SEQ ID NO: 11717 - DNA, 34 bp, synthetic construct; identical to SEQ ID NO: 9028
  misc_feature 1..34: note = Description of Artificial Sequence: Synthetic oligonucleotide
  source 1..34: mol_type = other DNA

SEQ ID NO: 11718 - DNA, 211 bp, synthetic construct; identical to SEQ ID NO: 9039
  misc_feature 1..211: note = Description of Artificial Sequence: Synthetic polynucleotide
  source 1..211: mol_type = other DNA

SEQ ID NO: 11719 - DNA, 95 bp, synthetic construct; identical to SEQ ID NO: 9050
  misc_feature 1..95: note = Description of Artificial Sequence: Synthetic oligonucleotide
  source 1..95: mol_type = other DNA

SEQ ID NO: 11720 - DNA, 264 bp, synthetic construct; identical to SEQ ID NO: 9061
  misc_feature 1..264: note = Description of Artificial Sequence: Synthetic polynucleotide
  source 1..264: mol_type = other DNA

SEQ ID NO: 11721 - DNA, 59 bp, synthetic construct; identical to SEQ ID NO: 9072
  misc_feature 1..59: note = Description of Artificial Sequence: Synthetic oligonucleotide
  source 1..59: mol_type = other DNA

SEQ ID NO: 11722 - skipped

SEQ ID NO: 11723 - DNA, 324 bp, synthetic construct; identical to SEQ ID NO: 9094
  misc_feature 1..324: note = Description of Artificial Sequence: Synthetic polynucleotide
  source 1..324: mol_type = other DNA

SEQ ID NO: 11724 - DNA, 102 bp, synthetic construct; identical to SEQ ID NO: 9102
  misc_feature 1..102: note = Description of Artificial Sequence: Synthetic polynucleotide
  source 1..102: mol_type = other DNA

SEQ ID NO: 11725 - DNA, 24 bp, synthetic construct
  misc_feature 1..24: note = Description of Artificial Sequence: Synthetic oligonucleotide
  source 1..24: mol_type = other DNA
cgtaacgattcgttgtcgtttacg

SEQ ID NO: 11726 - DNA, 521 bp, synthetic construct; identical to SEQ ID NO: 9104
  misc_feature 1..521: note = Description of Artificial Sequence: Synthetic polynucleotide
  source 1..521: mol_type = other DNA

SEQ ID NO: 11727 - DNA, 1484 bp, synthetic construct; identical to SEQ ID NO: 9105
  misc_feature 1..1484: note = Description of Artificial Sequence: Synthetic polynucleotide
  source 1..1484: mol_type = other DNA

SEQ ID NO: 11728 - DNA, 34 bp, synthetic construct; identical to SEQ ID NO: 9106
  misc_feature 1..34: note = Description of Artificial Sequence: Synthetic oligonucleotide
  source 1..34: mol_type = other DNA

SEQ ID NO: 11729 - DNA, 14 bp, synthetic construct
  misc_feature 1..14: note = Description of Artificial Sequence: Synthetic oligonucleotide
  source 1..14: mol_type = other DNA
cggcgaggggttcg

SEQ ID NO: 11730 - DNA, 37 bp, synthetic construct; identical to SEQ ID NO: 9108
  misc_feature 1..37: note = Description of Artificial Sequence: Synthetic oligonucleotide
  source 1..37: mol_type = other DNA

SEQ ID NO: 11731 - DNA, 34 bp, synthetic construct; identical to SEQ ID NO: 9109
  misc_feature 1..34: note = Description of Artificial Sequence: Synthetic oligonucleotide
  source 1..34: mol_type = other DNA

SEQ ID NO: 11732 - DNA, 538 bp, synthetic construct; identical to SEQ ID NO: 9110
  misc_feature 1..538: note = Description of Artificial Sequence: Synthetic polynucleotide
  source 1..538: mol_type = other DNA

SEQ ID NO: 11733 - DNA, 109 bp, synthetic construct; identical to SEQ ID NO: 9111
  misc_feature 1..109: note = Description of Artificial Sequence: Synthetic polynucleotide
  source 1..109: mol_type = other DNA

SEQ ID NO: 11734 - DNA, 901 bp, synthetic construct; identical to SEQ ID NO: 9112
  misc_feature 1..901: note = Description of Artificial Sequence: Synthetic polynucleotide
  source 1..901: mol_type = other DNA

SEQ ID NO: 11735 - DNA, 15 bp, synthetic construct
  misc_feature 1..15: note = Description of Artificial Sequence: Synthetic oligonucleotide
  source 1..15: mol_type = other DNA
cgggcggcgcgggcg

SEQ ID NO: 11736 - DNA, 383 bp, synthetic construct; identical to SEQ ID NO: 9114
  misc_feature 1..383: note = Description of Artificial Sequence: Synthetic polynucleotide
  source 1..383: mol_type = other DNA

SEQ ID NO: 11737 - skipped

SEQ ID NO: 11738 - DNA, 624 bp, synthetic construct; identical to SEQ ID NO: 9116
  misc_feature 1..624: note = Description of Artificial Sequence: Synthetic polynucleotide
  source 1..624: mol_type = other DNA

SEQ ID NO: 11739 - DNA, 94 bp, synthetic construct; identical to SEQ ID NO: 9117
  misc_feature 1..94: note = Description of Artificial Sequence: Synthetic oligonucleotide
  source 1..94: mol_type = other DNA

SEQ ID NO: 11740 - DNA, 63 bp, synthetic construct; identical to SEQ ID NO: 9118
  misc_feature 1..63: note = Description of Artificial Sequence: Synthetic oligonucleotide
  source 1..63: mol_type = other DNA

SEQ ID NO: 11741 - DNA, 41 bp, synthetic construct; identical to SEQ ID NO: 9119
  misc_feature 1..41: note = Description of Artificial Sequence: Synthetic oligonucleotide
  source 1..41: mol_type = other DNA

SEQ ID NO: 11742 - DNA, 1041 bp, synthetic construct; identical to SEQ ID NO: 9120
  misc_feature 1..1041: note = Description of Artificial Sequence: Synthetic polynucleotide
  source 1..1041: mol_type = other DNA

SEQ ID NO: 11743 - DNA, 23 bp, synthetic construct
  misc_feature 1..23: note = Description of Artificial Sequence: Synthetic oligonucleotide
  source 1..23: mol_type = other DNA
cgttttcggttcgggttatggcg

SEQ ID NO: 11744 - DNA, 515 bp, synthetic construct; identical to SEQ ID NO: 9122
  misc_feature 1..515: note = Description of Artificial Sequence: Synthetic polynucleotide
  source 1..515: mol_type = other DNA

SEQ ID NO: 11745 - DNA, 1017 bp, synthetic construct; identical to SEQ ID NO: 9123
  misc_feature 1..1017: note = Description of Artificial Sequence: Synthetic polynucleotide
  source 1..1017: mol_type = other DNA

SEQ ID NO: 11746 - skipped

SEQ ID NO: 11747 - DNA, 54 bp, synthetic construct; identical to SEQ ID NO: 9125
  misc_feature 1..54: note = Description of Artificial Sequence: Synthetic oligonucleotide
  source 1..54: mol_type = other DNA

SEQ ID NO: 11748 - DNA, 10 bp, synthetic construct
  misc_feature 1..10: note = Description of Artificial Sequence: Synthetic oligonucleotide
  source 1..10: mol_type = other DNA
cgcgttgtcg

SEQ ID NO: 11749 - DNA, 26 bp, synthetic construct
  misc_feature 1..26: note = Description of Artificial Sequence: Synthetic oligonucleotide
  source 1..26: mol_type = other DNA
cgggtaggttcgattaggcggtcgcg

SEQ ID NO: 11750 - DNA, 934 bp, synthetic construct; identical to SEQ ID NO: 9128
  misc_feature 1..934: note = Description of Artificial Sequence: Synthetic polynucleotide
  source 1..934: mol_type = other DNA

SEQ ID NO: 11751 - DNA, 279 bp, synthetic construct; identical to SEQ ID NO: 9129
  misc_feature 1..279: note = Description of Artificial Sequence: Synthetic polynucleotide
  source 1..279: mol_type = other DNA

SEQ ID NO: 11752-11753 - skipped (2 entries)

SEQ ID NO: 11754 - DNA, 11 bp, synthetic construct
  misc_feature 1..11: note = Description of Artificial Sequence: Synthetic oligonucleotide
  source 1..11: mol_type = other DNA
cgagcgtatcg

SEQ ID NO: 11755 - DNA, 30 bp, synthetic construct; identical to SEQ ID NO: 9133
  misc_feature 1..30: note = Description of Artificial Sequence: Synthetic oligonucleotide
  source 1..30: mol_type = other DNA

SEQ ID NO: 11756 - DNA, 10 bp, synthetic construct
  misc_feature 1..10: note = Description of Artificial Sequence: Synthetic oligonucleotide
  source 1..10: mol_type = other DNA
cgttttcgcg

SEQ ID NO: 11757 - DNA, 56 bp, synthetic construct; identical to SEQ ID NO: 9135
  misc_feature 1..56: note = Description of Artificial Sequence: Synthetic oligonucleotide
  source 1..56: mol_type = other DNA

SEQ ID NO: 11758 - DNA, 98 bp, synthetic construct; identical to SEQ ID NO: 9136
  misc_feature 1..98: note = Description of Artificial Sequence: Synthetic oligonucleotide
  source 1..98: mol_type = other DNA

SEQ ID NO: 11759 - DNA, 33 bp, synthetic construct; identical to SEQ ID NO: 9137
  misc_feature 1..33: note = Description of Artificial Sequence: Synthetic oligonucleotide
  source 1..33: mol_type = other DNA

SEQ ID NO: 11760 - DNA, 48 bp, synthetic construct; identical to SEQ ID NO: 9138
  misc_feature 1..48: note = Description of Artificial Sequence: Synthetic oligonucleotide
  source 1..48: mol_type = other DNA

SEQ ID NO: 11761 - DNA, 42 bp, synthetic construct; identical to SEQ ID NO: 9147
  misc_feature 1..42: note = Description of Artificial Sequence: Synthetic oligonucleotide
  source 1..42: mol_type = other DNA

SEQ ID NO: 11762 - DNA, 40 bp, synthetic construct; identical to SEQ ID NO: 9158
  misc_feature 1..40: note = Description of Artificial Sequence: Synthetic oligonucleotide
  source 1..40: mol_type = other DNA

SEQ ID NO: 11763 - skipped

SEQ ID NO: 11764 - DNA, 42 bp, synthetic construct; identical to SEQ ID NO: 9180
  misc_feature 1..42: note = Description of Artificial Sequence: Synthetic oligonucleotide
  source 1..42: mol_type = other DNA

SEQ ID NO: 11765 - DNA, 20 bp, synthetic construct
  misc_feature 1..20: note = Description of Artificial Sequence: Synthetic oligonucleotide
  source 1..20: mol_type = other DNA
ygttygtygygygtattayg

SEQ ID NO: 11766 - DNA, 116 bp, synthetic construct; identical to SEQ ID NO: 9192
  misc_feature 1..116: note = Description of Artificial Sequence: Synthetic polynucleotide
  source 1..116: mol_type = other DNA

SEQ ID NO: 11767 - DNA, 44 bp, synthetic construct; identical to SEQ ID NO: 9203
  misc_feature 1..44: note = Description of Artificial Sequence: Synthetic oligonucleotide
  source 1..44: mol_type = other DNA

SEQ ID NO: 11768 - DNA, 34 bp, synthetic construct; identical to SEQ ID NO: 9214
  misc_feature 1..34: note = Description of Artificial Sequence: Synthetic oligonucleotide
  source 1..34: mol_type = other DNA

SEQ ID NO: 11769 - DNA, 211 bp, synthetic construct; identical to SEQ ID NO: 9225
  misc_feature 1..211: note = Description of Artificial Sequence: Synthetic polynucleotide
  source 1..211: mol_type = other DNA

SEQ ID NO: 11770 - DNA, 95 bp, synthetic construct; identical to SEQ ID NO: 9236
  misc_feature 1..95: note = Description of Artificial Sequence: Synthetic oligonucleotide
  source 1..95: mol_type = other DNA

SEQ ID NO: 11771 - DNA, 264 bp, synthetic construct; identical to SEQ ID NO: 9247
  misc_feature 1..264: note = Description of Artificial Sequence: Synthetic polynucleotide
  source 1..264: mol_type = other DNA

SEQ ID NO: 11772 - DNA, 59 bp, synthetic construct; identical to SEQ ID NO: 9258
  misc_feature 1..59: note = Description of Artificial Sequence: Synthetic oligonucleotide
  source 1..59: mol_type = other DNA

SEQ ID NO: 11773 - skipped

SEQ ID NO: 11774 - DNA, 324 bp, synthetic construct; identical to SEQ ID NO: 9280
  misc_feature 1..324: note = Description of Artificial Sequence: Synthetic polynucleotide
  source 1..324: mol_type = other DNA

SEQ ID NO: 11775 - DNA, 102 bp, synthetic construct; identical to SEQ ID NO: 9288
  misc_feature 1..102: note = Description of Artificial Sequence: Synthetic polynucleotide
  source 1..102: mol_type = other DNA

SEQ ID NO: 11776 - DNA, 24 bp, synthetic construct
  misc_feature 1..24: note = Description of Artificial Sequence: Synthetic oligonucleotide
  source 1..24: mol_type = other DNA
ygtgggyggtagygagtygttgyg

SEQ ID NO: 11777 - DNA, 521 bp, synthetic construct; identical to SEQ ID NO: 9290
  misc_feature 1..521: note = Description of Artificial Sequence: Synthetic polynucleotide
  source 1..521: mol_type = other DNA

SEQ ID NO: 11778 - DNA, 1484 bp, synthetic construct; identical to SEQ ID NO: 9291
  misc_feature 1..1484: note = Description of Artificial Sequence: Synthetic polynucleotide
  source 1..1484: mol_type = other DNA

SEQ ID NO: 11779 - DNA, 34 bp, synthetic construct; identical to SEQ ID NO: 9292
  misc_feature 1..34: note = Description of Artificial Sequence: Synthetic oligonucleotide
  source 1..34: mol_type = other DNA

SEQ ID NO: 11780 - DNA, 14 bp, synthetic construct
  misc_feature 1..14: note = Description of Artificial Sequence: Synthetic oligonucleotide
  source 1..14: mol_type = other DNA
ygagtttttygtyg

SEQ ID NO: 11781 - DNA, 37 bp, synthetic construct; identical to SEQ ID NO: 9294
  misc_feature 1..37: note = Description of Artificial Sequence: Synthetic oligonucleotide
  source 1..37: mol_type = other DNA

SEQ ID NO: 11782 - DNA, 34 bp, synthetic construct; identical to SEQ ID NO: 9295
  misc_feature 1..34: note = Description of Artificial Sequence: Synthetic oligonucleotide
  source 1..34: mol_type = other DNA

SEQ ID NO: 11783 - DNA, 538 bp, synthetic construct; identical to SEQ ID NO: 9296
  misc_feature 1..538: note = Description of Artificial Sequence: Synthetic polynucleotide
  source 1..538: mol_type = other DNA

SEQ ID NO: 11784 - DNA, 109 bp, synthetic construct; identical to SEQ ID NO: 9297
  misc_feature 1..109: note = Description of Artificial Sequence: Synthetic polynucleotide
  source 1..109: mol_type = other DNA

SEQ ID NO: 11785 - DNA, 901 bp, synthetic construct; identical to SEQ ID NO: 9298
  misc_feature 1..901: note = Description of Artificial Sequence: Synthetic polynucleotide
  source 1..901: mol_type = other DNA

SEQ ID NO: 11786 - DNA, 15 bp, synthetic construct
  misc_feature 1..15: note = Description of Artificial Sequence: Synthetic oligonucleotide
  source 1..15: mol_type = other DNA
ygttygygtygttyg

SEQ ID NO: 11787 - DNA, 383 bp, synthetic construct; identical to SEQ ID NO: 9300
  misc_feature 1..383: note = Description of Artificial Sequence: Synthetic polynucleotide
  source 1..383: mol_type = other DNA

SEQ ID NO: 11788 - skipped

SEQ ID NO: 11789 - DNA, 624 bp, synthetic construct; identical to SEQ ID NO: 9302
  misc_feature 1..624: note = Description of Artificial Sequence: Synthetic polynucleotide
  source 1..624: mol_type = other DNA

SEQ ID NO: 11790 - DNA, 94 bp, synthetic construct; identical to SEQ ID NO: 9303
  misc_feature 1..94: note = Description of Artificial Sequence: Synthetic oligonucleotide
  source 1..94: mol_type = other DNA

SEQ ID NO: 11791 - DNA, 63 bp, synthetic construct; identical to SEQ ID NO: 9304
  misc_feature 1..63: note = Description of Artificial Sequence: Synthetic oligonucleotide
  source 1..63: mol_type = other DNA

SEQ ID NO: 11792 - DNA, 41 bp, synthetic construct; identical to SEQ ID NO: 9305
  misc_feature 1..41: note = Description of Artificial Sequence: Synthetic oligonucleotide
  source 1..41: mol_type = other DNA

SEQ ID NO: 11793 - DNA, 1041 bp, synthetic construct; identical to SEQ ID NO: 9306
  misc_feature 1..1041: note = Description of Artificial Sequence: Synthetic polynucleotide
  source 1..1041: mol_type = other DNA

SEQ ID NO: 11794 - DNA, 23 bp, synthetic construct
  misc_feature 1..23: note = Description of Artificial Sequence: Synthetic oligonucleotide
  source 1..23: mol_type = other DNA
ygttatggttygagtygaaggyg

SEQ ID NO: 11795 - DNA, 515 bp, synthetic construct; identical to SEQ ID NO: 9308
  misc_feature 1..515: note = Description of Artificial Sequence: Synthetic polynucleotide
  source 1..515: mol_type = other DNA

SEQ ID NO: 11796 - DNA, 1017 bp, synthetic construct; identical to SEQ ID NO: 9309
  misc_feature 1..1017: note = Description of Artificial Sequence: Synthetic polynucleotide
  source 1..1017: mol_type = other DNA

SEQ ID NO: 11797 - skipped

SEQ ID NO: 11798 - DNA, 54 bp, synthetic construct; identical to SEQ ID NO: 9311
  misc_feature 1..54: note = Description of Artificial Sequence: Synthetic oligonucleotide
  source 1..54: mol_type = other DNA

SEQ ID NO: 11799 - DNA, 10 bp, synthetic construct
  misc_feature 1..10: note = Description of Artificial Sequence: Synthetic oligonucleotide
  source 1..10: mol_type = other DNA
ygataaygyg

SEQ ID NO: 11800 - DNA, 26 bp, synthetic construct
  misc_feature 1..26: note = Description of Artificial Sequence: Synthetic oligonucleotide
  source 1..26: mol_type = other DNA
ygyggtygtttggtygaatttgttyg

SEQ ID NO: 11801 - DNA, 934 bp, synthetic construct; identical to SEQ ID NO: 9314
  misc_feature 1..934: note = Description of Artificial Sequence: Synthetic polynucleotide
  source 1..934: mol_type = other DNA

SEQ ID NO: 11802 - DNA, 279 bp, synthetic construct; identical to SEQ ID NO: 9315
  misc_feature 1..279: note = Description of Artificial Sequence: Synthetic polynucleotide
  source 1..279: mol_type = other DNA

SEQ ID NO: 11803-11804 - skipped (2 entries)

SEQ ID NO: 11805 - DNA, 11 bp, synthetic construct
  misc_feature 1..11: note = Description of Artificial Sequence: Synthetic oligonucleotide
  source 1..11: mol_type = other DNA
ygatgygttyg

SEQ ID NO: 11806 - DNA, 30 bp, synthetic construct; identical to SEQ ID NO: 9319
  misc_feature 1..30: note = Description of Artificial Sequence: Synthetic oligonucleotide
  source 1..30: mol_type = other DNA

SEQ ID NO: 11807 - DNA, 10 bp, synthetic construct
  misc_feature 1..10: note = Description of Artificial Sequence: Synthetic oligonucleotide
  source 1..10: mol_type = other DNA
ygygggagyg

SEQ ID NO: 11808 - DNA, 56 bp, synthetic construct; identical to SEQ ID NO: 9321
  misc_feature 1..56: note = Description of Artificial Sequence: Synthetic oligonucleotide
  source 1..56: mol_type = other DNA

SEQ ID NO: 11809 - DNA, 98 bp, synthetic construct; identical to SEQ ID NO: 9322
  misc_feature 1..98: note = Description of Artificial Sequence: Synthetic oligonucleotide
  source 1..98: mol_type = other DNA

SEQ ID NO: 11810 - DNA, 33 bp, synthetic construct; identical to SEQ ID NO: 9323
  misc_feature 1..33: note = Description of Artificial Sequence: Synthetic oligonucleotide
  source 1..33: mol_type = other DNA

SEQ ID NO: 11811 - DNA, 48 bp, synthetic construct; identical to SEQ ID NO: 9324
  misc_feature 1..48: note = Description of Artificial Sequence: Synthetic oligonucleotide
  source 1..48: mol_type = other DNA

SEQ ID NO: 11812 - DNA, 42 bp, synthetic construct; identical to SEQ ID NO: 9333
  misc_feature 1..42: note = Description of Artificial Sequence: Synthetic oligonucleotide
  source 1..42: mol_type = other DNA

SEQ ID NO: 11813 - DNA, 40 bp, synthetic construct; identical to SEQ ID NO: 9344
  misc_feature 1..40: note = Description of Artificial Sequence: Synthetic oligonucleotide
  source 1..40: mol_type = other DNA

SEQ ID NO: 11814 - skipped

SEQ ID NO: 11815 - DNA, 42 bp, synthetic construct; identical to SEQ ID NO: 9366
  misc_feature 1..42: note = Description of Artificial Sequence: Synthetic oligonucleotide
  source 1..42: mol_type = other DNA

SEQ ID NO: 11816 - DNA, 20 bp, synthetic construct
  misc_feature 1..20: note = Description of Artificial Sequence: Synthetic oligonucleotide
  source 1..20: mol_type = other DNA
cgttcgtcgcgcgtattacg

SEQ ID NO: 11817 - DNA, 116 bp, synthetic construct; identical to SEQ ID NO: 9378
  misc_feature 1..116: note = Description of Artificial Sequence: Synthetic polynucleotide
  source 1..116: mol_type = other DNA

SEQ ID NO: 11818 - DNA, 44 bp, synthetic construct; identical to SEQ ID NO: 9389
  misc_feature 1..44: note = Description of Artificial Sequence: Synthetic oligonucleotide
  source 1..44: mol_type = other DNA

SEQ ID NO: 11819 - DNA, 34 bp, synthetic construct; identical to SEQ ID NO: 9400
  misc_feature 1..34: note = Description of Artificial Sequence: Synthetic oligonucleotide
  source 1..34: mol_type = other DNA

SEQ ID NO: 11820 - DNA, 211 bp, synthetic construct; identical to SEQ ID NO: 9411
  misc_feature 1..211: note = Description of Artificial Sequence: Synthetic polynucleotide
  source 1..211: mol_type = other DNA

SEQ ID NO: 11821 - DNA, 95 bp, synthetic construct; identical to SEQ ID NO: 9422
  misc_feature 1..95: note = Description of Artificial Sequence: Synthetic oligonucleotide
  source 1..95: mol_type = other DNA

SEQ ID NO: 11822 - DNA, 264 bp, synthetic construct; identical to SEQ ID NO: 9433
  misc_feature 1..264: note = Description of Artificial Sequence: Synthetic polynucleotide
  source 1..264: mol_type = other DNA

SEQ ID NO: 11823 - DNA, 59 bp, synthetic construct; identical to SEQ ID NO: 9444
  misc_feature 1..59: note = Description of Artificial Sequence: Synthetic oligonucleotide
  source 1..59: mol_type = other DNA

SEQ ID NO: 11824 - skipped

SEQ ID NO: 11825 - DNA, 324 bp, synthetic construct; identical to SEQ ID NO: 9466
  misc_feature 1..324: note = Description of Artificial Sequence: Synthetic polynucleotide
  source 1..324: mol_type = other DNA

SEQ ID NO: 11826 - DNA, 102 bp, synthetic construct; identical to SEQ ID NO: 9474
  misc_feature 1..102: note = Description of Artificial Sequence: Synthetic polynucleotide
  source 1..102: mol_type = other DNA

SEQ ID NO: 11827 - DNA, 24 bp, synthetic construct
  misc_feature 1..24: note = Description of Artificial Sequence: Synthetic oligonucleotide
  source 1..24: mol_type = other DNA
cgtgggcggtagcgagtcgttgcg

SEQ ID NO: 11828 - DNA, 521 bp, synthetic construct; identical to SEQ ID NO: 9476
  misc_feature 1..521: note = Description of Artificial Sequence: Synthetic polynucleotide
  source 1..521: mol_type = other DNA

SEQ ID NO: 11829 - DNA, 1484 bp, synthetic construct; identical to SEQ ID NO: 9477
  misc_feature 1..1484: note = Description of Artificial Sequence: Synthetic polynucleotide
  source 1..1484: mol_type = other DNA

SEQ ID NO: 11830 - DNA, 34 bp, synthetic construct; identical to SEQ ID NO: 8734
  misc_feature 1..34: note = Description of Artificial Sequence: Synthetic oligonucleotide
  source 1..34: mol_type = other DNA

SEQ ID NO: 11831 - DNA, 14 bp, synthetic construct
  misc_feature 1..14: note = Description of Artificial Sequence: Synthetic oligonucleotide
  source 1..14: mol_type = other DNA
cgagtttttcgtcg

SEQ ID NO: 11832 - DNA, 37 bp, synthetic construct; identical to SEQ ID NO: 9480
  misc_feature 1..37: note = Description of Artificial Sequence: Synthetic oligonucleotide
  source 1..37: mol_type = other DNA

SEQ ID NO: 11833 - DNA, 34 bp, synthetic construct; identical to SEQ ID NO: 9481
  misc_feature 1..34: note = Description of Artificial Sequence: Synthetic oligonucleotide
  source 1..34: mol_type = other DNA

SEQ ID NO: 11834 - DNA, 538 bp, synthetic construct; identical to SEQ ID NO: 9482
  misc_feature 1..538: note = Description of Artificial Sequence: Synthetic polynucleotide
  source 1..538: mol_type = other DNA

SEQ ID NO: 11835 - DNA, 109 bp, synthetic construct; identical to SEQ ID NO: 9483
  misc_feature 1..109: note = Description of Artificial Sequence: Synthetic polynucleotide
  source 1..109: mol_type = other DNA

SEQ ID NO: 11836 - DNA, 901 bp, synthetic construct; identical to SEQ ID NO: 9484
  misc_feature 1..901: note = Description of Artificial Sequence: Synthetic polynucleotide
  source 1..901: mol_type = other DNA

SEQ ID NO: 11837 - DNA, 15 bp, synthetic construct
  misc_feature 1..15: note = Description of Artificial Sequence: Synthetic oligonucleotide
  source 1..15: mol_type = other DNA
cgttcgcgtcgttcg

SEQ ID NO: 11838 - DNA, 383 bp, synthetic construct; identical to SEQ ID NO: 9486
  misc_feature 1..383: note = Description of Artificial Sequence: Synthetic polynucleotide
  source 1..383: mol_type = other DNA

SEQ ID NO: 11839 - skipped

SEQ ID NO: 11840 - DNA, 624 bp, synthetic construct; identical to SEQ ID NO: 9488
  misc_feature 1..624: note = Description of Artificial Sequence: Synthetic polynucleotide
  source 1..624: mol_type = other DNA

SEQ ID NO: 11841 - DNA, 94 bp, synthetic construct; identical to SEQ ID NO: 9489
  misc_feature 1..94: note = Description of Artificial Sequence: Synthetic oligonucleotide
  source 1..94: mol_type = other DNA

SEQ ID NO: 11842 - DNA, 63 bp, synthetic construct; identical to SEQ ID NO: 9490
  misc_feature 1..63: note = Description of Artificial Sequence: Synthetic oligonucleotide
  source 1..63: mol_type = other DNA

SEQ ID NO: 11843 - DNA, 41 bp, synthetic construct; identical to SEQ ID NO: 9491
  misc_feature 1..41: note = Description of Artificial Sequence: Synthetic oligonucleotide
  source 1..41: mol_type = other DNA

SEQ ID NO: 11844 - DNA, 1041 bp, synthetic construct; identical to SEQ ID NO: 9492
  misc_feature 1..1041: note = Description of Artificial Sequence: Synthetic polynucleotide
  source 1..1041: mol_type = other DNA

SEQ ID NO: 11845 - DNA, 23 bp, synthetic construct
  misc_feature 1..23: note = Description of Artificial Sequence: Synthetic oligonucleotide
  source 1..23: mol_type = other DNA
cgttatggttcgagtcgaaggcg

SEQ ID NO: 11846 - DNA, 515 bp, synthetic construct; identical to SEQ ID NO: 9494
  misc_feature 1..515: note = Description of Artificial Sequence: Synthetic polynucleotide
  source 1..515: mol_type = other DNA

SEQ ID NO: 11847 - DNA, 1017 bp, synthetic construct; identical to SEQ ID NO: 9495
  misc_feature 1..1017: note = Description of Artificial Sequence: Synthetic polynucleotide
  source 1..1017: mol_type = other DNA

SEQ ID NO: 11848 - skipped

SEQ ID NO: 11849 - DNA, 54 bp, synthetic construct; identical to SEQ ID NO: 9497
  misc_feature 1..54: note = Description of Artificial Sequence: Synthetic oligonucleotide
  source 1..54: mol_type = other DNA

SEQ ID NO: 11850 - DNA, 10 bp, synthetic construct
  misc_feature 1..10: note = Description of Artificial Sequence: Synthetic oligonucleotide
  source 1..10: mol_type = other DNA
cgataacgcg

SEQ ID NO: 11851 - DNA, 26 bp, synthetic construct
  misc_feature 1..26: note = Description of Artificial Sequence: Synthetic oligonucleotide
  source 1..26: mol_type = other DNA
cgcggtcgtttggtcgaatttgttcg

SEQ ID NO: 11852 - DNA, 934 bp, synthetic construct; identical to SEQ ID NO: 9500
  misc_feature 1..934: note = Description of Artificial Sequence: Synthetic polynucleotide
  source 1..934: mol_type = other DNA

SEQ ID NO: 11853 - DNA, 279 bp, synthetic construct; identical to SEQ ID NO: 9501
  misc_feature 1..279: note = Description of Artificial Sequence: Synthetic polynucleotide
  source 1..279: mol_type = other DNA

SEQ ID NO: 11854-11855 - skipped (2 entries)

SEQ ID NO: 11856 - DNA, 11 bp, synthetic construct
  misc_feature 1..11: note = Description of Artificial Sequence: Synthetic oligonucleotide
  source 1..11: mol_type = other DNA
cgatgcgttcg

SEQ ID NO: 11857 - DNA, 30 bp, synthetic construct; identical to SEQ ID NO: 9505
  misc_feature 1..30: note = Description of Artificial Sequence: Synthetic oligonucleotide
  source 1..30: mol_type = other DNA

SEQ ID NO: 11858 - DNA, 10 bp, synthetic construct
  misc_feature 1..10: note = Description of Artificial Sequence: Synthetic oligonucleotide
  source 1..10: mol_type = other DNA
cgcgggagcg

SEQ ID NO: 11859 - DNA, 56 bp, synthetic construct; identical to SEQ ID NO: 9507
  misc_feature 1..56: note = Description of Artificial Sequence: Synthetic oligonucleotide
  source 1..56: mol_type = other DNA

SEQ ID NO: 11860 - DNA, 98 bp, synthetic construct; identical to SEQ ID NO: 9508
  misc_feature 1..98: note = Description of Artificial Sequence: Synthetic oligonucleotide
  source 1..98: mol_type = other DNA

SEQ ID NO: 11861 - DNA, 33 bp, synthetic construct; identical to SEQ ID NO: 9509
  misc_feature 1..33: note = Description of Artificial Sequence: Synthetic oligonucleotide
  source 1..33: mol_type = other DNA

SEQ ID NO: 11862 - DNA, 48 bp, synthetic construct; identical to SEQ ID NO: 8766
  misc_feature 1..48: note = Description of Artificial Sequence: Synthetic oligonucleotide
  source 1..48: mol_type = other DNA

SEQ ID NO: 11863 - DNA, 42 bp, synthetic construct; identical to SEQ ID NO: 9519
  misc_feature 1..42: note = Description of Artificial Sequence: Synthetic oligonucleotide
  source 1..42: mol_type = other DNA

SEQ ID NO: 11864 - DNA, 40 bp, synthetic construct; identical to SEQ ID NO: 9530
  misc_feature 1..40: note = Description of Artificial Sequence: Synthetic oligonucleotide
  source 1..40: mol_type = other DNA

SEQ ID NO: 11865 - skipped

SEQ ID NO: 11866 - DNA, 42 bp, synthetic construct; identical to SEQ ID NO: 9552
  misc_feature 1..42: note = Description of Artificial Sequence: Synthetic oligonucleotide
  source 1..42: mol_type = other DNA

SEQ ID NO: 11867 - DNA, 219 bp, Homo sapiens; identical to SEQ ID NO: 9563
  source 1..219: mol_type = unassigned DNA

SEQ ID NO: 11868 - DNA, 315 bp, Homo sapiens; identical to SEQ ID NO: 9564
  source 1..315: mol_type = unassigned DNA

SEQ ID NO: 11869 - DNA, 243 bp, Homo sapiens; identical to SEQ ID NO: 9575
  source 1..243: mol_type = unassigned DNA

SEQ ID NO: 11870 - DNA, 233 bp, Homo sapiens; identical to SEQ ID NO: 9586
  source 1..233: mol_type = unassigned DNA

SEQ ID NO: 11871 - DNA, 410 bp, Homo sapiens; identical to SEQ ID NO: 9597
  source 1..410: mol_type = unassigned DNA

SEQ ID NO: 11872 - DNA, 294 bp, Homo sapiens; identical to SEQ ID NO: 9608
  source 1..294: mol_type = unassigned DNA

SEQ ID NO: 11873 - DNA, 463 bp, Homo sapiens; identical to SEQ ID NO: 9619
  source 1..463: mol_type = unassigned DNA

SEQ ID NO: 11874 - DNA, 258 bp, Homo sapiens; identical to SEQ ID NO: 9630
  source 1..258: mol_type = unassigned DNA

SEQ ID NO: 11875 - DNA, 203 bp, Homo sapiens; identical to SEQ ID NO: 9641
  source 1..203: mol_type = unassigned DNA

SEQ ID NO: 11876 - DNA, 523 bp, Homo sapiens; identical to SEQ ID NO: 9652
  source 1..523: mol_type = unassigned DNA

SEQ ID NO: 11877 - DNA, 301 bp, Homo sapiens; identical to SEQ ID NO: 9660
  source 1..301: mol_type = unassigned DNA

SEQ ID NO: 11878 - DNA, 223 bp, Homo sapiens; identical to SEQ ID NO: 9661
  source 1..223: mol_type = unassigned DNA

SEQ ID NO: 11879 - DNA, 720 bp, Homo sapiens; identical to SEQ ID NO: 9662
  source 1..720: mol_type = unassigned DNA

SEQ ID NO: 11880 - DNA, 1683 bp, Homo sapiens; identical to SEQ ID NO: 9663
  source 1..1683: mol_type = unassigned DNA

SEQ ID NO: 11881 - DNA, 233 bp, Homo sapiens; identical to SEQ ID NO: 9664
  source 1..233: mol_type = unassigned DNA

SEQ ID NO: 11882 - DNA, 213 bp, Homo sapiens; identical to SEQ ID NO: 9665
  source 1..213: mol_type = unassigned DNA

SEQ ID NO: 11883 - DNA, 236 bp, Homo sapiens; identical to SEQ ID NO: 9666
  source 1..236: mol_type = unassigned DNA

SEQ ID NO: 11884 - DNA, 233 bp, Homo sapiens; identical to SEQ ID NO: 9667
  source 1..233: mol_type = unassigned DNA

SEQ ID NO: 11885 - DNA, 737 bp, Homo sapiens; identical to SEQ ID NO: 9668
  source 1..737: mol_type = unassigned DNA

SEQ ID NO: 11886 - DNA, 308 bp, Homo sapiens; identical to SEQ ID NO: 9669
  source 1..308: mol_type = unassigned DNA

SEQ ID NO: 11887 - DNA, 1100 bp, Homo sapiens; identical to SEQ ID NO: 9670
  source 1..1100: mol_type = unassigned DNA

SEQ ID NO: 11888 - DNA, 214 bp, Homo sapiens; identical to SEQ ID NO: 9671
  source 1..214: mol_type = unassigned DNA

SEQ ID NO: 11889 - DNA, 582 bp, Homo sapiens; identical to SEQ ID NO: 9672
  source 1..582: mol_type = unassigned DNA

SEQ ID NO: 11890 - DNA, 203 bp, Homo sapiens; identical to SEQ ID NO: 9673
  source 1..203: mol_type = unassigned DNA

SEQ ID NO: 11891 - DNA, 823 bp, Homo sapiens; identical to SEQ ID NO: 9674
  source 1..823: mol_type = unassigned DNA

SEQ ID NO: 11892 - DNA, 293 bp, Homo sapiens; identical to SEQ ID NO: 9675
  source 1..293: mol_type = unassigned DNA

SEQ ID NO: 11893 - DNA, 262 bp, Homo sapiens; identical to SEQ ID NO: 9676
  source 1..262: mol_type = unassigned DNA

SEQ ID NO: 11894 - DNA, 240 bp, Homo sapiens; identical to SEQ ID NO: 9677
  source 1..240: mol_type = unassigned DNA

SEQ ID NO: 11895 - DNA, 1240 bp, Homo sapiens; identical to SEQ ID NO: 9678
  source 1..1240: mol_type = unassigned DNA

SEQ ID NO: 11896 - DNA, 222 bp, Homo sapiens; identical to SEQ ID NO: 9679
  source 1..222: mol_type = unassigned DNA

SEQ ID NO: 11897 - DNA, 714 bp, Homo sapiens; identical to SEQ ID NO: 9680
  source 1..714: mol_type = unassigned DNA

SEQ ID NO: 11898 - DNA, 1216 bp, Homo sapiens; identical to SEQ ID NO: 9681
  source 1..1216: mol_type = unassigned DNA

SEQ ID NO: 11899 - DNA, 207 bp, Homo sapiens; identical to SEQ ID NO: 9682
  source 1..207: mol_type = unassigned DNA

SEQ ID NO: 11900 - DNA, 253 bp, Homo sapiens; identical to SEQ ID NO: 9683
  source 1..253: mol_type = unassigned DNA

SEQ ID NO: 11901 - DNA, 209 bp, Homo sapiens; identical to SEQ ID NO: 9684
  source 1..209: mol_type = unassigned DNA

SEQ ID NO: 11902 - DNA, 225 bp, Homo sapiens; identical to SEQ ID NO: 9685
  source 1..225: mol_type = unassigned DNA

SEQ ID NO: 11903 - DNA, 1133 bp, Homo sapiens; identical to SEQ ID NO: 9686
  source 1..1133: mol_type = unassigned DNA

SEQ ID NO: 11904 - DNA, 478 bp, Homo sapiens; identical to SEQ ID NO: 9687
  source 1..478: mol_type = unassigned DNA

SEQ ID NO: 11905 - DNA, 201 bp, Homo sapiens; identical to SEQ ID NO: 9688
  source 1..201: mol_type = unassigned DNA

SEQ ID NO: 11906 - DNA, 208 bp, Homo sapiens; identical to SEQ ID NO: 9689
  source 1..208: mol_type = unassigned DNA

SEQ ID NO: 11907 - DNA, 210 bp, Homo sapiens; identical to SEQ ID NO: 9690
  source 1..210: mol_type = unassigned DNA

SEQ ID NO: 11908 - DNA, 229 bp, Homo sapiens; identical to SEQ ID NO: 9691
  source 1..229: mol_type = unassigned DNA

SEQ ID NO: 11909 - DNA, 209 bp, Homo sapiens; identical to SEQ ID NO: 9692
  source 1..209: mol_type = unassigned DNA

SEQ ID NO: 11910 - DNA, 255 bp, Homo sapiens; identical to SEQ ID NO: 9693
  source 1..255: mol_type = unassigned DNA

SEQ ID NO: 11911 - DNA, 297 bp, Homo sapiens; identical to SEQ ID NO: 9694
  source 1..297: mol_type = unassigned DNA

SEQ ID NO: 11912 - DNA, 232 bp, Homo sapiens; identical to SEQ ID NO: 9695
  source 1..232: mol_type = unassigned DNA

SEQ ID NO: 11913 - DNA, 247 bp, Homo sapiens; identical to SEQ ID NO: 9696
  source 1..247: mol_type = unassigned DNA

SEQ ID NO: 11914 - DNA, 241 bp, Homo sapiens; identical to SEQ ID NO: 9705
  source 1..241: mol_type = unassigned DNA

SEQ ID NO: 11915 - DNA, 239 bp, Homo sapiens; identical to SEQ ID NO: 9716
  source 1..239: mol_type = unassigned DNA

SEQ ID NO: 11916 - DNA, 201 bp, Homo sapiens; identical to SEQ ID NO: 9727
  source 1..201: mol_type = unassigned DNA

SEQ ID NO: 11917 - DNA, 241 bp, Homo sapiens; identical to SEQ ID NO: 9738
  source 1..241: mol_type = unassigned DNA

SEQ ID NO: 11918 - DNA, 219 bp, Homo sapiens; identical to SEQ ID NO: 9749
  source 1..219: mol_type = unassigned DNA

SEQ ID NO: 11919 - DNA, 315 bp, Homo sapiens; identical to SEQ ID NO: 9750
  source 1..315: mol_type = unassigned DNA

SEQ ID NO: 11920 - DNA, 243 bp, Homo sapiens; identical to SEQ ID NO: 9761
  source 1..243: mol_type = unassigned DNA

SEQ ID NO: 11921 - DNA, 233 bp, Homo sapiens; identical to SEQ ID NO: 9772
  source 1..233: mol_type = unassigned DNA

SEQ ID NO: 11922 - DNA, 410 bp, Homo sapiens; identical to SEQ ID NO: 9783
  source 1..410: mol_type = unassigned DNA

SEQ ID NO: 11923 - DNA, 294 bp, Homo sapiens; identical to SEQ ID NO: 9794
  source 1..294: mol_type = unassigned DNA

SEQ ID NO: 11924 - DNA, 463 bp, Homo sapiens; identical to SEQ ID NO: 9805
  source 1..463: mol_type = unassigned DNA

SEQ ID NO: 11925 - DNA, 258 bp, Homo sapiens; identical to SEQ ID NO: 9816
  source 1..258: mol_type = unassigned DNA

SEQ ID NO: 11926 - DNA, 203 bp, Homo sapiens; identical to SEQ ID NO: 9827
  source 1..203: mol_type = unassigned DNA

SEQ ID NO: 11927 - DNA, 523 bp, Homo sapiens; identical to SEQ ID NO: 9838
  source 1..523: mol_type = unassigned DNA

SEQ ID NO: 11928 - DNA, 301 bp, Homo sapiens; identical to SEQ ID NO: 9846
  source 1..301: mol_type = unassigned DNA

SEQ ID NO: 11929 - DNA, 223 bp, Homo sapiens; identical to SEQ ID NO: 9847
  source 1..223: mol_type = unassigned DNA

SEQ ID NO: 11930 - DNA, 720 bp, Homo sapiens; identical to SEQ ID NO: 9848
  source 1..720: mol_type = unassigned DNA

SEQ ID NO: 11931 - DNA, 1683 bp, Homo sapiens; identical to SEQ ID NO: 9849
  source 1..1683: mol_type = unassigned DNA

SEQ ID NO: 11932 - DNA, 233 bp, Homo sapiens; identical to SEQ ID NO: 9850
  source 1..233: mol_type = unassigned DNA

SEQ ID NO: 11933 - DNA, 213 bp, Homo sapiens; identical to SEQ ID NO: 9851
  source 1..213: mol_type = unassigned DNA

SEQ ID NO: 11934 - DNA, 236 bp, Homo sapiens; identical to SEQ ID NO: 9852
  source 1..236: mol_type = unassigned DNA

SEQ ID NO: 11935 - DNA, 233 bp, Homo sapiens; identical to SEQ ID NO: 9853
  source 1..233: mol_type = unassigned DNA

SEQ ID NO: 11936 - DNA, 737 bp, Homo sapiens; identical to SEQ ID NO: 9854
  source 1..737: mol_type = unassigned DNA

SEQ ID NO: 11937 - DNA, 308 bp, Homo sapiens; identical to SEQ ID NO: 9855
  source 1..308: mol_type = unassigned DNA

SEQ ID NO: 11938 - DNA, 1100 bp, Homo sapiens; identical to SEQ ID NO: 9856
  source 1..1100: mol_type = unassigned DNA

SEQ ID NO: 11939 - DNA, 214 bp, Homo sapiens; identical to SEQ ID NO: 9857
  source 1..214: mol_type = unassigned DNA

SEQ ID NO: 11940 - DNA, 582 bp, Homo sapiens; identical to SEQ ID NO: 9858
  source 1..582: mol_type = unassigned DNA

SEQ ID NO: 11941 - DNA, 203 bp, Homo sapiens; identical to SEQ ID NO: 9859
  source 1..203: mol_type = unassigned DNA

SEQ ID NO: 11942 - DNA, 823 bp, Homo sapiens; identical to SEQ ID NO: 9860
  source 1..823: mol_type = unassigned DNA

SEQ ID NO: 11943 - DNA, 293 bp, Homo sapiens; identical to SEQ ID NO: 9861
  source 1..293: mol_type = unassigned DNA

SEQ ID NO: 11944 - DNA, 262 bp, Homo sapiens; identical to SEQ ID NO: 9862
  source 1..262: mol_type = unassigned DNA

SEQ ID NO: 11945 - DNA, 240 bp, Homo sapiens; identical to SEQ ID NO: 9863
  source 1..240: mol_type = unassigned DNA

SEQ ID NO: 11946 - DNA, 1240 bp, Homo sapiens; identical to SEQ ID NO: 9864
  source 1..1240: mol_type = unassigned DNA

SEQ ID NO: 11947 - DNA, 222 bp, Homo sapiens; identical to SEQ ID NO: 9865
  source 1..222: mol_type = unassigned DNA

SEQ ID NO: 11948 - DNA, 714 bp, Homo sapiens; identical to SEQ ID NO: 9866
  source 1..714: mol_type = unassigned DNA

SEQ ID NO: 11949 - DNA, 1216 bp, Homo sapiens; identical to SEQ ID NO: 9867
  source 1..1216: mol_type = unassigned DNA

SEQ ID NO: 11950 - DNA, 207 bp, Homo sapiens; identical to SEQ ID NO: 9868
  source 1..207: mol_type = unassigned DNA

SEQ ID NO: 11951 - DNA, 253 bp, Homo sapiens; identical to SEQ ID NO: 9869
  source 1..253: mol_type = unassigned DNA

SEQ ID NO: 11952 - DNA, 209 bp, Homo sapiens; identical to SEQ ID NO: 9870
  source 1..209: mol_type = unassigned DNA

SEQ ID NO: 11953 - DNA, 225 bp, Homo sapiens; identical to SEQ ID NO: 9871
  source 1..225: mol_type = unassigned DNA

SEQ ID NO: 11954 - DNA, 1133 bp, Homo sapiens; identical to SEQ ID NO: 9872
  source 1..1133: mol_type = unassigned DNA

SEQ ID NO: 11955 - DNA, 478 bp, Homo sapiens; identical to SEQ ID NO: 9873
  source 1..478: mol_type = unassigned DNA

SEQ ID NO: 11956 - DNA, 201 bp, Homo sapiens; identical to SEQ ID NO: 9874
  source 1..201: mol_type = unassigned DNA

SEQ ID NO: 11957 - DNA, 208 bp, Homo sapiens; identical to SEQ ID NO: 9875
  source 1..208: mol_type = unassigned DNA

SEQ ID NO: 11958 - DNA, 210 bp, Homo sapiens; identical to SEQ ID NO: 9876
  source 1..210: mol_type = unassigned DNA

SEQ ID NO: 11959 - DNA, 229 bp, Homo sapiens; identical to SEQ ID NO: 9877
  source 1..229: mol_type = unassigned DNA

SEQ ID NO: 11960 - DNA, 209 bp, Homo sapiens; identical to SEQ ID NO: 9878
  source 1..209: mol_type = unassigned DNA

SEQ ID NO: 11961 - DNA, 255 bp, Homo sapiens; identical to SEQ ID NO: 9879
  source 1..255: mol_type = unassigned DNA

SEQ ID NO: 11962 - DNA, 297 bp, Homo sapiens; identical to SEQ ID NO: 9880
  source 1..297: mol_type = unassigned DNA

SEQ ID NO: 11963 - DNA, 232 bp, Homo sapiens; identical to SEQ ID NO: 9881
  source 1..232: mol_type = unassigned DNA

SEQ ID NO: 11964 - DNA, 247 bp, Homo sapiens; identical to SEQ ID NO: 9882
  source 1..247: mol_type = unassigned DNA

SEQ ID NO: 11965 - DNA, 241 bp, Homo sapiens; identical to SEQ ID NO: 9891
  source 1..241: mol_type = unassigned DNA

SEQ ID NO: 11966 - DNA, 239 bp, Homo sapiens; identical to SEQ ID NO: 9902
  source 1..239: mol_type = unassigned DNA

SEQ ID NO: 11967 - DNA, 201 bp, Homo sapiens; identical to SEQ ID NO: 9913
  source 1..201: mol_type = unassigned DNA

SEQ ID NO: 11968 - DNA, 241 bp, Homo sapiens; identical to SEQ ID NO: 9924
  source 1..241: mol_type = unassigned DNA

SEQ ID NO: 11969 - DNA, 219 bp, synthetic construct; identical to SEQ ID NO: 9935
  misc_feature 1..219: note = Description of Artificial Sequence: Synthetic polynucleotide
  source 1..219: mol_type = other DNA

SEQ ID NO: 11970 - DNA, 315 bp, synthetic construct; identical to SEQ ID NO: 9936
  misc_feature 1..315: note = Description of Artificial Sequence: Synthetic polynucleotide
  source 1..315: mol_type = other DNA

SEQ ID NO: 11971 - DNA, 243 bp, synthetic construct; identical to SEQ ID NO: 9947
  misc_feature 1..243: note = Description of Artificial Sequence: Synthetic polynucleotide
  source 1..243: mol_type = other DNA

SEQ ID NO: 11972 - DNA, 233 bp, synthetic construct; identical to SEQ ID NO: 9958
  misc_feature 1..233: note = Description of Artificial Sequence: Synthetic polynucleotide
  source 1..233: mol_type = other DNA

SEQ ID NO: 11973 - DNA, 410 bp, synthetic construct; identical to SEQ ID NO: 9969
  misc_feature 1..410: note = Description of Artificial Sequence: Synthetic polynucleotide
  source 1..410: mol_type = other DNA

SEQ ID NO: 11974 - DNA, 294 bp, synthetic construct; identical to SEQ ID NO: 9980
  misc_feature 1..294: note = Description of Artificial Sequence: Synthetic polynucleotide
  source 1..294: mol_type = other DNA

SEQ ID NO: 11975 - DNA, 463 bp, synthetic construct; identical to SEQ ID NO: 9991
  misc_feature 1..463: note = Description of Artificial Sequence: Synthetic polynucleotide
  source 1..463: mol_type = other DNA

SEQ ID NO: 11976 - DNA, 258 bp, synthetic construct; identical to SEQ ID NO: 10002
  misc_feature 1..258: note = Description of Artificial Sequence: Synthetic polynucleotide
  source 1..258: mol_type = other DNA

SEQ ID NO: 11977 - DNA, 203 bp, synthetic construct; identical to SEQ ID NO: 10013
  misc_feature 1..203: note = Description of Artificial Sequence: Synthetic polynucleotide
  source 1..203: mol_type = other DNA

SEQ ID NO: 11978 - DNA, 523 bp, synthetic construct; identical to SEQ ID NO: 10024
  misc_feature 1..523: note = Description of Artificial Sequence: Synthetic polynucleotide
  source 1..523: mol_type = other DNA

SEQ ID NO: 11979 - DNA, 301 bp, synthetic construct; identical to SEQ ID NO: 10032
  misc_feature 1..301: note = Description of Artificial Sequence: Synthetic polynucleotide
  source 1..301: mol_type = other DNA

SEQ ID NO: 11980 - DNA, 223 bp, synthetic construct; identical to SEQ ID NO: 10033
  misc_feature 1..223: note = Description of Artificial Sequence: Synthetic polynucleotide
  source 1..223: mol_type = other DNA

SEQ ID NO: 11981 - DNA, 720 bp, synthetic construct; identical to SEQ ID NO: 10034
  misc_feature 1..720: note = Description of Artificial Sequence: Synthetic polynucleotide
  source 1..720: mol_type = other DNA

SEQ ID NO: 11982 - DNA, 1683 bp, synthetic construct; identical to SEQ ID NO: 10035
  misc_feature 1..1683: note = Description of Artificial Sequence: Synthetic polynucleotide
  source 1..1683: mol_type = other DNA

SEQ ID NO: 11983 - DNA, 233 bp, synthetic construct; identical to SEQ ID NO: 10036
  misc_feature 1..233: note = Description of Artificial Sequence: Synthetic polynucleotide
  source 1..233: mol_type = other DNA

SEQ ID NO: 11984 - DNA, 213 bp, synthetic construct; identical to SEQ ID NO: 10037
  misc_feature 1..213: note = Description of Artificial Sequence: Synthetic polynucleotide
  source 1..213: mol_type = other DNA

SEQ ID NO: 11985 - DNA, 236 bp, synthetic construct; identical to SEQ ID NO: 10038
  misc_feature 1..236: note = Description of Artificial Sequence: Synthetic polynucleotide
  source 1..236: mol_type = other DNA

SEQ ID NO: 11986 - DNA, 233 bp, synthetic construct; identical to SEQ ID NO: 10039
  misc_feature 1..233: note = Description of Artificial Sequence: Synthetic polynucleotide
  source 1..233: mol_type = other DNA

SEQ ID NO: 11987 - DNA, 737 bp, synthetic construct; identical to SEQ ID NO: 10040
  misc_feature 1..737: note = Description of Artificial Sequence: Synthetic polynucleotide
  source 1..737: mol_type = other DNA

SEQ ID NO: 11988 - DNA, 308 bp, synthetic construct; identical to SEQ ID NO: 10041
  misc_feature 1..308: note = Description of Artificial Sequence: Synthetic polynucleotide
  source 1..308: mol_type = other DNA

SEQ ID NO: 11989 - DNA, 1100 bp, synthetic construct; identical to SEQ ID NO: 10042
  misc_feature 1..1100: note = Description of Artificial Sequence: Synthetic polynucleotide
  source 1..1100: mol_type = other DNA

SEQ ID NO: 11990 - DNA, 214 bp, synthetic construct; identical to SEQ ID NO: 10043
  misc_feature 1..214: note = Description of Artificial Sequence: Synthetic polynucleotide
  source 1..214: mol_type = other DNA

SEQ ID NO: 11991 - DNA, 582 bp, synthetic construct; identical to SEQ ID NO: 10044
  misc_feature 1..582: note = Description of Artificial Sequence: Synthetic polynucleotide
  source 1..582: mol_type = other DNA

SEQ ID NO: 11992 - DNA, 203 bp, synthetic construct; identical to SEQ ID NO: 10045
  misc_feature 1..203: note = Description of Artificial Sequence: Synthetic polynucleotide
  source 1..203: mol_type = other DNA

SEQ ID NO: 11993 - DNA, 823 bp, synthetic construct; identical to SEQ ID NO: 10046
  misc_feature 1..823: note = Description of Artificial Sequence: Synthetic polynucleotide
  source 1..823: mol_type = other DNA

SEQ ID NO: 11994 - DNA, 293 bp, synthetic construct; identical to SEQ ID NO: 10047
  misc_feature 1..293: note = Description of Artificial Sequence: Synthetic polynucleotide
  source 1..293: mol_type = other DNA

SEQ ID NO: 11995 - DNA, 262 bp, synthetic construct; identical to SEQ ID NO: 10048
  misc_feature 1..262: note = Description of Artificial Sequence: Synthetic polynucleotide
  source 1..262: mol_type = other DNA

SEQ ID NO: 11996 - DNA, 240 bp, synthetic construct; identical to SEQ ID NO: 10049
  misc_feature 1..240: note = Description of Artificial Sequence: Synthetic polynucleotide
  source 1..240: mol_type = other DNA

SEQ ID NO: 11997 - DNA, 1240 bp, synthetic construct; identical to SEQ ID NO: 10050
  misc_feature 1..1240: note = Description of Artificial Sequence: Synthetic polynucleotide
  source 1..1240: mol_type = other DNA

SEQ ID NO: 11998 - DNA, 222 bp, synthetic construct; identical to SEQ ID NO: 10051
  misc_feature 1..222: note = Description of Artificial Sequence: Synthetic polynucleotide
  source 1..222: mol_type = other DNA

SEQ ID NO: 11999 - DNA, 714 bp, synthetic construct; identical to SEQ ID NO: 10052
  misc_feature 1..714: note = Description of Artificial Sequence: Synthetic polynucleotide
  source 1..714: mol_type = other DNA

SEQ ID NO: 12000 - DNA, 1216 bp, synthetic construct; identical to SEQ ID NO: 10053
  misc_feature 1..1216: note = Description of Artificial Sequence: Synthetic polynucleotide
  source 1..1216: mol_type = other DNA

SEQ ID NO: 12001 - DNA, 207 bp, synthetic construct; identical to SEQ ID NO: 10054
  misc_feature 1..207: note = Description of Artificial Sequence: Synthetic polynucleotide
  source 1..207: mol_type = other DNA

SEQ ID NO: 12002 - DNA, 253 bp, synthetic construct; identical to SEQ ID NO: 10055
  misc_feature 1..253: note = Description of Artificial Sequence: Synthetic polynucleotide
  source 1..253: mol_type = other DNA

SEQ ID NO: 12003 - DNA, 209 bp, synthetic construct; identical to SEQ ID NO: 10056
  misc_feature 1..209: note = Description of Artificial Sequence: Synthetic polynucleotide
  source 1..209: mol_type = other DNA

SEQ ID NO: 12004 - DNA, 225 bp, synthetic construct; identical to SEQ ID NO: 10057
  misc_feature 1..225: note = Description of Artificial Sequence: Synthetic polynucleotide
  source 1..225: mol_type = other DNA

SEQ ID NO: 12005 - DNA, 1133 bp, synthetic construct; identical to SEQ ID NO: 10058
  misc_feature 1..1133: note = Description of Artificial Sequence: Synthetic polynucleotide
  source 1..1133: mol_type = other DNA

SEQ ID NO: 12006 - DNA, 478 bp, synthetic construct; identical to SEQ ID NO: 10059
  misc_feature 1..478: note = Description of Artificial Sequence: Synthetic polynucleotide
  source 1..478: mol_type = other DNA

SEQ ID NO: 12007 - DNA, 201 bp, synthetic construct; identical to SEQ ID NO: 10060
  misc_feature 1..201: note = Description of Artificial Sequence: Synthetic polynucleotide
  source 1..201: mol_type = other DNA

SEQ ID NO: 12008 - DNA, 208 bp, synthetic construct; identical to SEQ ID NO: 10061
  misc_feature 1..208: note = Description of Artificial Sequence: Synthetic polynucleotide
  source 1..208: mol_type = other DNA

SEQ ID NO: 12009 - DNA, 210 bp, synthetic construct; identical to SEQ ID NO: 10062
  misc_feature 1..210: note = Description of Artificial Sequence: Synthetic polynucleotide
  source 1..210: mol_type = other DNA

SEQ ID NO: 12010 - DNA, 229 bp, synthetic construct; identical to SEQ ID NO: 10063
  misc_feature 1..229: note = Description of Artificial Sequence: Synthetic polynucleotide
  source 1..229: mol_type = other DNA

SEQ ID NO: 12011 - DNA, 209 bp, synthetic construct; identical to SEQ ID NO: 10064
  misc_feature 1..209: note = Description of Artificial Sequence: Synthetic polynucleotide
  source 1..209: mol_type = other DNA

SEQ ID NO: 12012 - DNA, 255 bp, synthetic construct; identical to SEQ ID NO: 10065
  misc_feature 1..255: note = Description of Artificial Sequence: Synthetic polynucleotide
  source 1..255: mol_type = other DNA

SEQ ID NO: 12013 - DNA, 297 bp, synthetic construct; identical to SEQ ID NO: 10066
  misc_feature 1..297: note = Description of Artificial Sequence: Synthetic polynucleotide
  source 1..297: mol_type = other DNA

SEQ ID NO: 12014 - DNA, 232 bp, synthetic construct; identical to SEQ ID NO: 10067
  misc_feature 1..232: note = Description of Artificial Sequence: Synthetic polynucleotide
  source 1..232: mol_type = other DNA

SEQ ID NO: 12015 - DNA, 247 bp, synthetic construct; identical to SEQ ID NO: 10068
  misc_feature 1..247: note = Description of Artificial Sequence: Synthetic polynucleotide
  source 1..247: mol_type = other DNA

SEQ ID NO: 12016 - DNA, 241 bp, synthetic construct; identical to SEQ ID NO: 10077
  misc_feature 1..241: note = Description of Artificial Sequence: Synthetic polynucleotide
  source 1..241: mol_type = other DNA

SEQ ID NO: 12017 - DNA, 239 bp, synthetic construct; identical to SEQ ID NO: 10088
  misc_feature 1..239: note = Description of Artificial Sequence: Synthetic polynucleotide
  source 1..239: mol_type = other DNA

SEQ ID NO: 12018 - DNA, 201 bp, synthetic construct; identical to SEQ ID NO: 10099
  misc_feature 1..201: note = Description of Artificial Sequence: Synthetic polynucleotide
  source 1..201: mol_type = other DNA

SEQ ID NO: 12019 - DNA, 241 bp, synthetic construct; identical to SEQ ID NO: 10110
  misc_feature 1..241: note = Description of Artificial Sequence: Synthetic polynucleotide
  source 1..241: mol_type = other DNA

SEQ ID NO: 12020 - DNA, 219 bp, synthetic construct; identical to SEQ ID NO: 10121
  misc_feature 1..219: note = Description of Artificial Sequence: Synthetic polynucleotide
  source 1..219: mol_type = other DNA

SEQ ID NO: 12021 - DNA, 315 bp, synthetic construct; identical to SEQ ID NO: 10122
  misc_feature 1..315: note = Description of Artificial Sequence: Synthetic polynucleotide
  source 1..315: mol_type = other DNA

SEQ ID NO: 12022 - DNA, 243 bp, synthetic construct; identical to SEQ ID NO: 10133
  misc_feature 1..243: note = Description of Artificial Sequence: Synthetic polynucleotide
  source 1..243: mol_type = other DNA

SEQ ID NO: 12023 - DNA, 233 bp, synthetic construct; identical to SEQ ID NO: 10144
  misc_feature 1..233: note = Description of Artificial Sequence: Synthetic polynucleotide
  source 1..233: mol_type = other DNA

SEQ ID NO: 12024 - DNA, 410 bp, synthetic construct; identical to SEQ ID NO: 10155
  misc_feature 1..410: note = Description of Artificial Sequence: Synthetic polynucleotide
  source 1..410: mol_type = other DNA

SEQ ID NO: 12025 - DNA, 294 bp, synthetic construct; identical to SEQ ID NO: 10166
  misc_feature 1..294: note = Description of Artificial Sequence: Synthetic polynucleotide
  source 1..294: mol_type = other DNA

SEQ ID NO: 12026 - DNA, 463 bp, synthetic construct; identical to SEQ ID NO: 10177
  misc_feature 1..463: note = Description of Artificial Sequence: Synthetic polynucleotide
  source 1..463: mol_type = other DNA

SEQ ID NO: 12027 - DNA, 258 bp, synthetic construct; identical to SEQ ID NO: 10188
  misc_feature 1..258: note = Description of Artificial Sequence: Synthetic polynucleotide
  source 1..258: mol_type = other DNA

SEQ ID NO: 12028 - DNA, 203 bp, synthetic construct; identical to SEQ ID NO: 10199
  misc_feature 1..203: note = Description of Artificial Sequence: Synthetic polynucleotide
  source 1..203: mol_type = other DNA

SEQ ID NO: 12029 - DNA, 523 bp, synthetic construct; identical to SEQ ID NO: 10210
  misc_feature 1..523: note = Description of Artificial Sequence: Synthetic polynucleotide
  source 1..523: mol_type = other DNA

SEQ ID NO: 12030 - DNA, 301 bp, synthetic construct; identical to SEQ ID NO: 10218
  misc_feature 1..301: note = Description of Artificial Sequence: Synthetic polynucleotide
  source 1..301: mol_type = other DNA

SEQ ID NO: 12031 - DNA, 223 bp, synthetic construct; identical to SEQ ID NO: 10219
  misc_feature 1..223: note = Description of Artificial Sequence: Synthetic polynucleotide
  source 1..223: mol_type = other DNA

SEQ ID NO: 12032 - DNA, 720 bp, synthetic construct; identical to SEQ ID NO: 10220
  misc_feature 1..720: note = Description of Artificial Sequence: Synthetic polynucleotide
  source 1..720: mol_type = other DNA

SEQ ID NO: 12033 - DNA, 1683 bp, synthetic construct; identical to SEQ ID NO: 10221
  misc_feature 1..1683: note = Description of Artificial Sequence: Synthetic polynucleotide
  source 1..1683: mol_type = other DNA

SEQ ID NO: 12034 - DNA, 233 bp, synthetic construct; identical to SEQ ID NO: 10222
  misc_feature 1..233: note = Description of Artificial Sequence: Synthetic polynucleotide
  source 1..233: mol_type = other DNA

SEQ ID NO: 12035 - DNA, 213 bp, synthetic construct; identical to SEQ ID NO: 10223
  misc_feature 1..213: note = Description of Artificial Sequence: Synthetic polynucleotide
  source 1..213: mol_type = other DNA

SEQ ID NO: 12036 - DNA, 236 bp, synthetic construct; identical to SEQ ID NO: 10224
  misc_feature 1..236: note = Description of Artificial Sequence: Synthetic polynucleotide
  source 1..236: mol_type = other DNA

SEQ ID NO: 12037 - DNA, 233 bp, synthetic construct; identical to SEQ ID NO: 10225
  misc_feature 1..233: note = Description of Artificial Sequence: Synthetic polynucleotide
  source 1..233: mol_type = other DNA

SEQ ID NO: 12038 - DNA, 737 bp, synthetic construct; identical to SEQ ID NO: 10226
  misc_feature 1..737: note = Description of Artificial Sequence: Synthetic polynucleotide
  source 1..737: mol_type = other DNA

SEQ ID NO: 12039 - DNA, 308 bp, synthetic construct; identical to SEQ ID NO: 10227
  misc_feature 1..308: note = Description of Artificial Sequence: Synthetic polynucleotide
  source 1..308: mol_type = other DNA

SEQ ID NO: 12040 - DNA, 1100 bp, synthetic construct; identical to SEQ ID NO: 10228
  misc_feature 1..1100: note = Description of Artificial Sequence: Synthetic polynucleotide
  source 1..1100: mol_type = other DNA

SEQ ID NO: 12041 - DNA, 214 bp, synthetic construct; identical to SEQ ID NO: 10229
  misc_feature 1..214: note = Description of Artificial Sequence: Synthetic polynucleotide
  source 1..214: mol_type = other DNA

SEQ ID NO: 12042 - DNA, 582 bp, synthetic construct; identical to SEQ ID NO: 10230
  misc_feature 1..582: note = Description of Artificial Sequence: Synthetic polynucleotide
  source 1..582: mol_type = other DNA

SEQ ID NO: 12043 - DNA, 203 bp, synthetic construct; identical to SEQ ID NO: 10231
  misc_feature 1..203: note = Description of Artificial Sequence: Synthetic polynucleotide
  source 1..203: mol_type = other DNA

SEQ ID NO: 12044 - DNA, 823 bp, synthetic construct; identical to SEQ ID NO: 10232
  misc_feature 1..823: note = Description of Artificial Sequence: Synthetic polynucleotide
  source 1..823: mol_type = other DNA

SEQ ID NO: 12045 - DNA, 293 bp, synthetic construct; identical to SEQ ID NO: 10233
  misc_feature 1..293: note = Description of Artificial Sequence: Synthetic polynucleotide
  source 1..293: mol_type = other DNA

SEQ ID NO: 12046 - DNA, 262 bp, synthetic construct; identical to SEQ ID NO: 10234
  misc_feature 1..262: note = Description of Artificial Sequence: Synthetic polynucleotide
  source 1..262: mol_type = other DNA

SEQ ID NO: 12047 - DNA, 240 bp, synthetic construct; identical to SEQ ID NO: 10235
  misc_feature 1..240: note = Description of Artificial Sequence: Synthetic polynucleotide
  source 1..240: mol_type = other DNA

SEQ ID NO: 12048 - DNA, 1240 bp, synthetic construct; identical to SEQ ID NO: 10236
  misc_feature 1..1240: note = Description of Artificial Sequence: Synthetic polynucleotide
  source 1..1240: mol_type = other DNA

SEQ ID NO: 12049 - DNA, 222 bp, synthetic construct; identical to SEQ ID NO: 10237
  misc_feature 1..222: note = Description of Artificial Sequence: Synthetic polynucleotide
  source 1..222: mol_type = other DNA

SEQ ID NO: 12050 - DNA, 714 bp, synthetic construct; identical to SEQ ID NO: 10238
  misc_feature 1..714: note = Description of Artificial Sequence: Synthetic polynucleotide
  source 1..714: mol_type = other DNA

SEQ ID NO: 12051 - DNA, 1216 bp, synthetic construct; identical to SEQ ID NO: 10239
  misc_feature 1..1216: note = Description of Artificial Sequence: Synthetic polynucleotide
  source 1..1216: mol_type = other DNA

SEQ ID NO: 12052 - DNA, 207 bp, synthetic construct; identical to SEQ ID NO: 10240
  misc_feature 1..207: note = Description of Artificial Sequence: Synthetic polynucleotide
  source 1..207: mol_type = other DNA

SEQ ID NO: 12053 - DNA, 253 bp, synthetic construct; identical to SEQ ID NO: 10241
  misc_feature 1..253: note = Description of Artificial Sequence: Synthetic polynucleotide
  source 1..253: mol_type = other DNA

SEQ ID NO: 12054 - DNA, 209 bp, synthetic construct; identical to SEQ ID NO: 10242
  misc_feature 1..209: note = Description of Artificial Sequence: Synthetic polynucleotide
  source 1..209: mol_type = other DNA

SEQ ID NO: 12055 - DNA, 225 bp, synthetic construct; identical to SEQ ID NO: 10243
  misc_feature 1..225: note = Description of Artificial Sequence: Synthetic polynucleotide
  source 1..225: mol_type = other DNA

SEQ ID NO: 12056 - DNA, 1133 bp, synthetic construct; identical to SEQ ID NO: 10244
  misc_feature 1..1133: note = Description of Artificial Sequence: Synthetic polynucleotide
  source 1..1133: mol_type = other DNA

SEQ ID NO: 12057 - DNA, 478 bp, synthetic construct; identical to SEQ ID NO: 10245
  misc_feature 1..478: note = Description of Artificial Sequence: Synthetic polynucleotide
  source 1..478: mol_type = other DNA

SEQ ID NO: 12058 - DNA, 201 bp, synthetic construct; identical to SEQ ID NO: 10246
  misc_feature 1..201: note = Description of Artificial Sequence: Synthetic polynucleotide
  source 1..201: mol_type = other DNA

SEQ ID NO: 12059 - DNA, 208 bp, synthetic construct; identical to SEQ ID NO: 10247
  misc_feature 1..208: note = Description of Artificial Sequence: Synthetic polynucleotide
  source 1..208: mol_type = other DNA

SEQ ID NO: 12060 - DNA, 210 bp, synthetic construct; identical to SEQ ID NO: 10248
  misc_feature 1..210: note = Description of Artificial Sequence: Synthetic polynucleotide
  source 1..210: mol_type = other DNA

SEQ ID NO: 12061 - DNA, 229 bp, synthetic construct; identical to SEQ ID NO: 10249
  misc_feature 1..229: note = Description of Artificial Sequence: Synthetic polynucleotide
  source 1..229: mol_type = other DNA

SEQ ID NO: 12062 - DNA, 209 bp, synthetic construct; identical to SEQ ID NO: 10250
  misc_feature 1..209: note = Description of Artificial Sequence: Synthetic polynucleotide
  source 1..209: mol_type = other DNA

SEQ ID NO: 12063 - DNA, 255 bp, synthetic construct; identical to SEQ ID NO: 10251
  misc_feature 1..255: note = Description of Artificial Sequence: Synthetic polynucleotide
  source 1..255: mol_type = other DNA

SEQ ID NO: 12064 - DNA, 297 bp, synthetic construct; identical to SEQ ID NO: 10252
  misc_feature 1..297: note = Description of Artificial Sequence: Synthetic polynucleotide
  source 1..297: mol_type = other DNA

SEQ ID NO: 12065 - DNA, 232 bp, synthetic construct; identical to SEQ ID NO: 10253
  misc_feature 1..232: note = Description of Artificial Sequence: Synthetic polynucleotide
  source 1..232: mol_type = other DNA

SEQ ID NO: 12066 - DNA, 247 bp, synthetic construct; identical to SEQ ID NO: 10254
  misc_feature 1..247: note = Description of Artificial Sequence: Synthetic polynucleotide
  source 1..247: mol_type = other DNA

SEQ ID NO: 12067 - DNA, 241 bp, synthetic construct; identical to SEQ ID NO: 10263
  misc_feature 1..241: note = Description of Artificial Sequence: Synthetic polynucleotide
  source 1..241: mol_type = other DNA

SEQ ID NO: 12068 - DNA, 239 bp, synthetic construct; identical to SEQ ID NO: 10274
  misc_feature 1..239: note = Description of Artificial Sequence: Synthetic polynucleotide
  source 1..239: mol_type = other DNA

SEQ ID NO: 12069 - DNA, 201 bp, synthetic construct; identical to SEQ ID NO: 10285
  misc_feature 1..201: note = Description of Artificial Sequence: Synthetic polynucleotide
  source 1..201: mol_type = other DNA

SEQ ID NO: 12070 - DNA, 241 bp, synthetic construct; identical to SEQ ID NO: 10296
  misc_feature 1..241: note = Description of Artificial Sequence: Synthetic polynucleotide
  source 1..241: mol_type = other DNA

SEQ ID NO: 12071 - DNA, 219 bp, synthetic construct; identical to SEQ ID NO: 10307
  misc_feature 1..219: note = Description of Artificial Sequence: Synthetic polynucleotide
  source 1..219: mol_type = other DNA

SEQ ID NO: 12072 - DNA, 315 bp, synthetic construct; identical to SEQ ID NO: 10308
  misc_feature 1..315: note = Description of Artificial Sequence: Synthetic polynucleotide
  source 1..315: mol_type = other DNA

SEQ ID NO: 12073 - DNA, 243 bp, synthetic construct; identical to SEQ ID NO: 10319
  misc_feature 1..243: note = Description of Artificial Sequence: Synthetic polynucleotide
  source 1..243: mol_type = other DNA

SEQ ID NO: 12074 - DNA, 233 bp, synthetic construct; identical to SEQ ID NO: 10330
  misc_feature 1..233: note = Description of Artificial Sequence: Synthetic polynucleotide
  source 1..233: mol_type = other DNA

SEQ ID NO: 12075 - DNA, 410 bp, synthetic construct; identical to SEQ ID NO: 10341
  misc_feature 1..410: note = Description of Artificial Sequence: Synthetic polynucleotide
  source 1..410: mol_type = other DNA

SEQ ID NO: 12076 - DNA, 294 bp, synthetic construct; identical to SEQ ID NO: 10352
  misc_feature 1..294: note = Description of Artificial Sequence: Synthetic polynucleotide
  source 1..294: mol_type = other DNA

SEQ ID NO: 12077 - DNA, 463 bp, synthetic construct; identical to SEQ ID NO: 10363
  misc_feature 1..463: note = Description of Artificial Sequence: Synthetic polynucleotide
  source 1..463: mol_type = other DNA

SEQ ID NO: 12078 - DNA, 258 bp, synthetic construct; identical to SEQ ID NO: 10374
  misc_feature 1..258: note = Description of Artificial Sequence: Synthetic polynucleotide
  source 1..258: mol_type = other DNA

SEQ ID NO: 12079 - DNA, 203 bp, synthetic construct; identical to SEQ ID NO: 10385
  misc_feature 1..203: note = Description of Artificial Sequence: Synthetic polynucleotide
  source 1..203: mol_type = other DNA

SEQ ID NO: 12080 - DNA, 523 bp, synthetic construct; identical to SEQ ID NO: 10396
  misc_feature 1..523: note = Description of Artificial Sequence: Synthetic polynucleotide
  source 1..523: mol_type = other DNA

SEQ ID NO: 12081 - DNA, 301 bp, synthetic construct; identical to SEQ ID NO: 10404
  misc_feature 1..301: note = Description of Artificial Sequence: Synthetic polynucleotide
  source 1..301: mol_type = other DNA

SEQ ID NO: 12082 - DNA, 223 bp, synthetic construct; identical to SEQ ID NO: 10405
  misc_feature 1..223: note = Description of Artificial Sequence: Synthetic polynucleotide
  source 1..223: mol_type = other DNA

SEQ ID NO: 12083 - DNA, 720 bp, synthetic construct; identical to SEQ ID NO: 10406
  misc_feature 1..720: note = Description of Artificial Sequence: Synthetic polynucleotide
  source 1..720: mol_type = other DNA

SEQ ID NO: 12084 - DNA, 1683 bp, synthetic construct; identical to SEQ ID NO: 10407
  misc_feature 1..1683: note = Description of Artificial Sequence: Synthetic polynucleotide
  source 1..1683: mol_type = other DNA

SEQ ID NO: 12085 - DNA, 233 bp, synthetic construct; identical to SEQ ID NO: 10408
  misc_feature 1..233: note = Description of Artificial Sequence: Synthetic polynucleotide
  source 1..233: mol_type = other DNA

SEQ ID NO: 12086 - DNA, 213 bp, synthetic construct; identical to SEQ ID NO: 10409
  misc_feature 1..213: note = Description of Artificial Sequence: Synthetic polynucleotide
  source 1..213: mol_type = other DNA

SEQ ID NO: 12087 - DNA, 236 bp, synthetic construct; identical to SEQ ID NO: 10410
  misc_feature 1..236: note = Description of Artificial Sequence: Synthetic polynucleotide
  source 1..236: mol_type = other DNA

SEQ ID NO: 12088 - DNA, 233 bp, synthetic construct; identical to SEQ ID NO: 10411
  misc_feature 1..233: note = Description of Artificial Sequence: Synthetic polynucleotide
  source 1..233: mol_type = other DNA

SEQ ID NO: 12089 - DNA, 737 bp, synthetic construct; identical to SEQ ID NO: 10412
  misc_feature 1..737: note = Description of Artificial Sequence: Synthetic polynucleotide
  source 1..737: mol_type = other DNA

SEQ ID NO: 12090 - DNA, 308 bp, synthetic construct; identical to SEQ ID NO: 10413
  misc_feature 1..308: note = Description of Artificial Sequence: Synthetic polynucleotide
  source 1..308: mol_type = other DNA

SEQ ID NO: 12091 - DNA, 1100 bp, synthetic construct; identical to SEQ ID NO: 10414
  misc_feature 1..1100: note = Description of Artificial Sequence: Synthetic polynucleotide
  source 1..1100: mol_type = other DNA

SEQ ID NO: 12092 - DNA, 214 bp, synthetic construct; identical to SEQ ID NO: 10415
  misc_feature 1..214: note = Description of Artificial Sequence: Synthetic polynucleotide
  source 1..214: mol_type = other DNA

SEQ ID NO: 12093 - DNA, 582 bp, synthetic construct; identical to SEQ ID NO: 10416
  misc_feature 1..582: note = Description of Artificial Sequence: Synthetic polynucleotide
  source 1..582: mol_type = other DNA

SEQ ID NO: 12094 - DNA, 203 bp, synthetic construct; identical to SEQ ID NO: 10417
  misc_feature 1..203: note = Description of Artificial Sequence: Synthetic polynucleotide
  source 1..203: mol_type = other DNA

SEQ ID NO: 12095 - DNA, 823 bp, synthetic construct; identical to SEQ ID NO: 10418
  misc_feature 1..823: note = Description of Artificial Sequence: Synthetic polynucleotide
  source 1..823: mol_type = other DNA

SEQ ID NO: 12096 - DNA, 293 bp, synthetic construct; identical to SEQ ID NO: 10419
  misc_feature 1..293: note = Description of Artificial Sequence: Synthetic polynucleotide
  source 1..293: mol_type = other DNA

SEQ ID NO: 12097 - DNA, 262 bp, synthetic construct; identical to SEQ ID NO: 10420
  misc_feature 1..262: note = Description of Artificial Sequence: Synthetic polynucleotide
  source 1..262: mol_type = other DNA

SEQ ID NO: 12098 - DNA, 240 bp, synthetic construct; identical to SEQ ID NO: 10421
  misc_feature 1..240: note = Description of Artificial Sequence: Synthetic polynucleotide
  source 1..240: mol_type = other DNA

SEQ ID NO: 12099 - DNA, 1240 bp, synthetic construct; identical to SEQ ID NO: 10422
  misc_feature 1..1240: note = Description of Artificial Sequence: Synthetic polynucleotide
  source 1..1240: mol_type = other DNA

SEQ ID NO: 12100 - DNA, 222 bp, synthetic construct; identical to SEQ ID NO: 10423
  misc_feature 1..222: note = Description of Artificial Sequence: Synthetic polynucleotide
  source 1..222: mol_type = other DNA

SEQ ID NO: 12101 - DNA, 714 bp, synthetic construct; identical to SEQ ID NO: 10424
  misc_feature 1..714: note = Description of Artificial Sequence: Synthetic polynucleotide
  source 1..714: mol_type = other DNA

SEQ ID NO: 12102 - DNA, 1216 bp, synthetic construct; identical to SEQ ID NO: 10425
  misc_feature 1..1216: note = Description of Artificial Sequence: Synthetic polynucleotide
  source 1..1216: mol_type = other DNA

SEQ ID NO: 12103 - DNA, 207 bp, synthetic construct; identical to SEQ ID NO: 10426
  misc_feature 1..207: note = Description of Artificial Sequence: Synthetic polynucleotide
  source 1..207: mol_type = other DNA

SEQ ID NO: 12104 - DNA, 253 bp, synthetic construct; identical to SEQ ID NO: 10427
  misc_feature 1..253: note = Description of Artificial Sequence: Synthetic polynucleotide
  source 1..253: mol_type = other DNA

SEQ ID NO: 12105 - DNA, 209 bp, synthetic construct; identical to SEQ ID NO: 10428
  misc_feature 1..209: note = Description of Artificial Sequence: Synthetic polynucleotide
  source 1..209: mol_type = other DNA

SEQ ID NO: 12106 - DNA, 225 bp, synthetic construct; identical to SEQ ID NO: 10429
  misc_feature 1..225: note = Description of Artificial Sequence: Synthetic polynucleotide
  source 1..225: mol_type = other DNA

SEQ ID NO: 12107 - DNA, 1133 bp, synthetic construct; identical to SEQ ID NO: 10430
  misc_feature 1..1133: note = Description of Artificial Sequence: Synthetic polynucleotide
  source 1..1133: mol_type = other DNA

SEQ ID NO: 12108 - DNA, 478 bp, synthetic construct; identical to SEQ ID NO: 10431
  misc_feature 1..478: note = Description of Artificial Sequence: Synthetic polynucleotide
  source 1..478: mol_type = other DNA

SEQ ID NO: 12109 - DNA, 201 bp, synthetic construct; identical to SEQ ID NO: 10432
  misc_feature 1..201: note = Description of Artificial Sequence: Synthetic polynucleotide
  source 1..201: mol_type = other DNA

SEQ ID NO: 12110 - DNA, 208 bp, synthetic construct; identical to SEQ ID NO: 10433
  misc_feature 1..208: note = Description of Artificial Sequence: Synthetic polynucleotide
  source 1..208: mol_type = other DNA

SEQ ID NO: 12111 - DNA, 210 bp, synthetic construct; identical to SEQ ID NO: 10434
  misc_feature 1..210: note = Description of Artificial Sequence: Synthetic polynucleotide
  source 1..210: mol_type = other DNA

SEQ ID NO: 12112 - DNA, 229 bp, synthetic construct; identical to SEQ ID NO: 10435
  misc_feature 1..229: note = Description of Artificial Sequence: Synthetic polynucleotide
  source 1..229: mol_type = other DNA

SEQ ID NO: 12113 - DNA, 209 bp, synthetic construct; identical to SEQ ID NO: 10436
  misc_feature 1..209: note = Description of Artificial Sequence: Synthetic polynucleotide
  source 1..209: mol_type = other DNA

SEQ ID NO: 12114 - DNA, 255 bp, synthetic construct; identical to SEQ ID NO: 10437
  misc_feature 1..255: note = Description of Artificial Sequence: Synthetic polynucleotide
  source 1..255: mol_type = other DNA

SEQ ID NO: 12115 - DNA, 297 bp, synthetic construct; identical to SEQ ID NO: 10438
  misc_feature 1..297: note = Description of Artificial Sequence: Synthetic polynucleotide
  source 1..297: mol_type = other DNA

SEQ ID NO: 12116 - DNA, 232 bp, synthetic construct; identical to SEQ ID NO: 10439
  misc_feature 1..232: note = Description of Artificial Sequence: Synthetic polynucleotide
  source 1..232: mol_type = other DNA

SEQ ID NO: 12117 - DNA, 247 bp, synthetic construct; identical to SEQ ID NO: 10440
  misc_feature 1..247: note = Description of Artificial Sequence: Synthetic polynucleotide
  source 1..247: mol_type = other DNA

SEQ ID NO: 12118 - DNA, 241 bp, synthetic construct; identical to SEQ ID NO: 10449
  misc_feature 1..241: note = Description of Artificial Sequence: Synthetic polynucleotide
  source 1..241: mol_type = other DNA

SEQ ID NO: 12119 - DNA, 239 bp, synthetic construct; identical to SEQ ID NO: 10460
  misc_feature 1..239: note = Description of Artificial Sequence: Synthetic polynucleotide
  source 1..239: mol_type = other DNA

SEQ ID NO: 12120 - DNA, 201 bp, synthetic construct; identical to SEQ ID NO: 10471
  misc_feature 1..201: note = Description of Artificial Sequence: Synthetic polynucleotide
  source 1..201: mol_type = other DNA

SEQ ID NO: 12121 - DNA, 241 bp, synthetic construct; identical to SEQ ID NO: 10482
  misc_feature 1..241: note = Description of Artificial Sequence: Synthetic polynucleotide
  source 1..241: mol_type = other DNA

SEQ ID NO: 12122 - DNA, 219 bp, synthetic construct; identical to SEQ ID NO: 10493
  misc_feature 1..219: note = Description of Artificial Sequence: Synthetic polynucleotide
  source 1..219: mol_type = other DNA

SEQ ID NO: 12123 - DNA, 315 bp, synthetic construct; identical to SEQ ID NO: 10494
  misc_feature 1..315: note = Description of Artificial Sequence: Synthetic polynucleotide
  source 1..315: mol_type = other DNA

SEQ ID NO: 12124 - DNA, 243 bp, synthetic construct; identical to SEQ ID NO: 10505
  misc_feature 1..243: note = Description of Artificial Sequence: Synthetic polynucleotide
  source 1..243: mol_type = other DNA

SEQ ID NO: 12125 - DNA, 233 bp, synthetic construct; identical to SEQ ID NO: 10516
  misc_feature 1..233: note = Description of Artificial Sequence: Synthetic polynucleotide
  source 1..233: mol_type = other DNA

SEQ ID NO: 12126 - DNA, 410 bp, synthetic construct; identical to SEQ ID NO: 10527
  misc_feature 1..410: note = Description of Artificial Sequence: Synthetic polynucleotide
  source 1..410: mol_type = other DNA

SEQ ID NO: 12127 - DNA, 294 bp, synthetic construct; identical to SEQ ID NO: 10538
  misc_feature 1..294: note = Description of Artificial Sequence: Synthetic polynucleotide
  source 1..294: mol_type = other DNA

SEQ ID NO: 12128 - DNA, 463 bp, synthetic construct; identical to SEQ ID NO: 10549
  misc_feature 1..463: note = Description of Artificial Sequence: Synthetic polynucleotide
  source 1..463: mol_type = other DNA

SEQ ID NO: 12129 - DNA, 258 bp, synthetic construct; identical to SEQ ID NO: 10560
  misc_feature 1..258: note = Description of Artificial Sequence: Synthetic polynucleotide
  source 1..258: mol_type = other DNA

SEQ ID NO: 12130 - DNA, 203 bp, synthetic construct; identical to SEQ ID NO: 10571
  misc_feature 1..203: note = Description of Artificial Sequence: Synthetic polynucleotide
  source 1..203: mol_type = other DNA

SEQ ID NO: 12131 - DNA, 523 bp, synthetic construct; identical to SEQ ID NO: 10582
  misc_feature 1..523: note = Description of Artificial Sequence: Synthetic polynucleotide
  source 1..523: mol_type = other DNA

SEQ ID NO: 12132 - DNA, 301 bp, synthetic construct; identical to SEQ ID NO: 10590
  misc_feature 1..301: note = Description of Artificial Sequence: Synthetic polynucleotide
  source 1..301: mol_type = other DNA

SEQ ID NO: 12133 - DNA, 223 bp, synthetic construct; identical to SEQ ID NO: 10591
  misc_feature 1..223: note = Description of Artificial Sequence: Synthetic polynucleotide
  source 1..223: mol_type = other DNA

SEQ ID NO: 12134 - DNA, 720 bp, synthetic construct; identical to SEQ ID NO: 10592
  misc_feature 1..720: note = Description of Artificial Sequence: Synthetic polynucleotide
  source 1..720: mol_type = other DNA

SEQ ID NO: 12135 - DNA, 1683 bp, synthetic construct; identical to SEQ ID NO: 10593
  misc_feature 1..1683: note = Description of Artificial Sequence: Synthetic polynucleotide
  source 1..1683: mol_type = other DNA

SEQ ID NO: 12136 - DNA, 233 bp, synthetic construct; identical to SEQ ID NO: 10594
  misc_feature 1..233: note = Description of Artificial Sequence: Synthetic polynucleotide
  source 1..233: mol_type = other DNA

SEQ ID NO: 12137 - DNA, 213 bp, synthetic construct; identical to SEQ ID NO: 10595
  misc_feature 1..213: note = Description of Artificial Sequence: Synthetic polynucleotide
  source 1..213: mol_type = other DNA

SEQ ID NO: 12138 - DNA, 236 bp, synthetic construct; identical to SEQ ID NO: 10596
  misc_feature 1..236: note = Description of Artificial Sequence: Synthetic polynucleotide
  source 1..236: mol_type = other DNA

SEQ ID NO: 12139 - DNA, 233 bp, synthetic construct; identical to SEQ ID NO: 10597
  misc_feature 1..233: note = Description of Artificial Sequence: Synthetic polynucleotide
  source 1..233: mol_type = other DNA

SEQ ID NO: 12140 - DNA, 737 bp, synthetic construct; identical to SEQ ID NO: 10598
  misc_feature 1..737: note = Description of Artificial Sequence: Synthetic polynucleotide
  source 1..737: mol_type = other DNA

SEQ ID NO: 12141 - DNA, 308 bp, synthetic construct; identical to SEQ ID NO: 10599
  misc_feature 1..308: note = Description of Artificial Sequence: Synthetic polynucleotide
  source 1..308: mol_type = other DNA

SEQ ID NO: 12142 - DNA, 1100 bp, synthetic construct; identical to SEQ ID NO: 10600
  misc_feature 1..1100: note = Description of Artificial Sequence: Synthetic polynucleotide
  source 1..1100: mol_type = other DNA

SEQ ID NO: 12143 - DNA, 214 bp, synthetic construct; identical to SEQ ID NO: 10601
  misc_feature 1..214: note = Description of Artificial Sequence: Synthetic polynucleotide
  source 1..214: mol_type = other DNA

SEQ ID NO: 12144 - DNA, 582 bp, synthetic construct; identical to SEQ ID NO: 10602
  misc_feature 1..582: note = Description of Artificial Sequence: Synthetic polynucleotide
  source 1..582: mol_type = other DNA

SEQ ID NO: 12145 - DNA, 203 bp, synthetic construct; identical to SEQ ID NO: 10603
  misc_feature 1..203: note = Description of Artificial Sequence: Synthetic polynucleotide
  source 1..203: mol_type = other DNA

SEQ ID NO: 12146 - DNA, 823 bp, synthetic construct; identical to SEQ ID NO: 10604
  misc_feature 1..823: note = Description of Artificial Sequence: Synthetic polynucleotide
  source 1..823: mol_type = other DNA

SEQ ID NO: 12147 - DNA, 293 bp, synthetic construct; identical to SEQ ID NO: 10605
  misc_feature 1..293: note = Description of Artificial Sequence: Synthetic polynucleotide
  source 1..293: mol_type = other DNA

SEQ ID NO: 12148 - DNA, 262 bp, synthetic construct; identical to SEQ ID NO: 10606
  misc_feature 1..262: note = Description of Artificial Sequence: Synthetic polynucleotide
  source 1..262: mol_type = other DNA

SEQ ID NO: 12149 - DNA, 240 bp, synthetic construct; identical to SEQ ID NO: 10607
  misc_feature 1..240: note = Description of Artificial Sequence: Synthetic polynucleotide
  source 1..240: mol_type = other DNA

SEQ ID NO: 12150 - DNA, 1240 bp, synthetic construct; identical to SEQ ID NO: 10608
  misc_feature 1..1240: note = Description of Artificial Sequence: Synthetic polynucleotide
  source 1..1240: mol_type = other DNA

SEQ ID NO: 12151 - DNA, 222 bp, synthetic construct; identical to SEQ ID NO: 10609
  misc_feature 1..222: note = Description of Artificial Sequence: Synthetic polynucleotide
  source 1..222: mol_type = other DNA

SEQ ID NO: 12152 - DNA, 714 bp, synthetic construct; identical to SEQ ID NO: 10610
  misc_feature 1..714: note = Description of Artificial Sequence: Synthetic polynucleotide
  source 1..714: mol_type = other DNA

SEQ ID NO: 12153 - DNA, 1216 bp, synthetic construct; identical to SEQ ID NO: 10611
  misc_feature 1..1216: note = Description of Artificial Sequence: Synthetic polynucleotide
  source 1..1216: mol_type = other DNA

SEQ ID NO: 12154 - DNA, 207 bp, synthetic construct; identical to SEQ ID NO: 10612
  misc_feature 1..207: note = Description of Artificial Sequence: Synthetic polynucleotide
  source 1..207: mol_type = other DNA

SEQ ID NO: 12155 - DNA, 253 bp, synthetic construct; identical to SEQ ID NO: 10613
  misc_feature 1..253: note = Description of Artificial Sequence: Synthetic polynucleotide
  source 1..253: mol_type = other DNA

SEQ ID NO: 12156 - DNA, 209 bp, synthetic construct; identical to SEQ ID NO: 10614
  misc_feature 1..209: note = Description of Artificial Sequence: Synthetic polynucleotide
  source 1..209: mol_type = other DNA

SEQ ID NO: 12157 - DNA, 225 bp, synthetic construct; identical to SEQ ID NO: 10615
  misc_feature 1..225: note = Description of Artificial Sequence: Synthetic polynucleotide
  source 1..225: mol_type = other DNA

SEQ ID NO: 12158 - DNA, 1133 bp, synthetic construct; identical to SEQ ID NO: 10616
  misc_feature 1..1133: note = Description of Artificial Sequence: Synthetic polynucleotide
  source 1..1133: mol_type = other DNA

SEQ ID NO: 12159 - DNA, 478 bp, synthetic construct; identical to SEQ ID NO: 10617
  misc_feature 1..478: note = Description of Artificial Sequence: Synthetic polynucleotide
  source 1..478: mol_type = other DNA

SEQ ID NO: 12160 - DNA, 201 bp, synthetic construct; identical to SEQ ID NO: 10618
  misc_feature 1..201: note = Description of Artificial Sequence: Synthetic polynucleotide
  source 1..201: mol_type = other DNA

SEQ ID NO: 12161 - DNA, 208 bp, synthetic construct; identical to SEQ ID NO: 10619
  misc_feature 1..208: note = Description of Artificial Sequence: Synthetic polynucleotide
  source 1..208: mol_type = other DNA

SEQ ID NO: 12162 - DNA, 210 bp, synthetic construct; identical to SEQ ID NO: 10620
  misc_feature 1..210: note = Description of Artificial Sequence: Synthetic polynucleotide
  source 1..210: mol_type = other DNA

SEQ ID NO: 12163 - DNA, 229 bp, synthetic construct; identical to SEQ ID NO: 10621
  misc_feature 1..229: note = Description of Artificial Sequence: Synthetic polynucleotide
  source 1..229: mol_type = other DNA

SEQ ID NO: 12164 - DNA, 209 bp, synthetic construct; identical to SEQ ID NO: 10622
  misc_feature 1..209: note = Description of Artificial Sequence: Synthetic polynucleotide
  source 1..209: mol_type = other DNA

SEQ ID NO: 12165 - DNA, 255 bp, synthetic construct; identical to SEQ ID NO: 10623
  misc_feature 1..255: note = Description of Artificial Sequence: Synthetic polynucleotide
  source 1..255: mol_type = other DNA

SEQ ID NO: 12166 - DNA, 297 bp, synthetic construct; identical to SEQ ID NO: 10624
  misc_feature 1..297: note = Description of Artificial Sequence: Synthetic polynucleotide
  source 1..297: mol_type = other DNA

SEQ ID NO: 12167 - DNA, 232 bp, synthetic construct; identical to SEQ ID NO: 10625
  misc_feature 1..232: note = Description of Artificial Sequence: Synthetic polynucleotide
  source 1..232: mol_type = other DNA

SEQ ID NO: 12168 - DNA, 247 bp, synthetic construct; identical to SEQ ID NO: 10626
  misc_feature 1..247: note = Description of Artificial Sequence: Synthetic polynucleotide
  source 1..247: mol_type = other DNA

SEQ ID NO: 12169 - DNA, 241 bp, synthetic construct; identical to SEQ ID NO: 10635
  misc_feature 1..241: note = Description of Artificial Sequence: Synthetic polynucleotide
  source 1..241: mol_type = other DNA

SEQ ID NO: 12170 - DNA, 239 bp, synthetic construct; identical to SEQ ID NO: 10646
  misc_feature 1..239: note = Description of Artificial Sequence: Synthetic polynucleotide
  source 1..239: mol_type = other DNA

SEQ ID NO: 12171 - DNA, 201 bp, synthetic construct; identical to SEQ ID NO: 10657
  misc_feature 1..201: note = Description of Artificial Sequence: Synthetic polynucleotide
  source 1..201: mol_type = other DNA

SEQ ID NO: 12172 - DNA, 241 bp, synthetic construct; identical to SEQ ID NO: 10668
  misc_feature 1..241: note = Description of Artificial Sequence: Synthetic polynucleotide
  source 1..241: mol_type = other DNA

SEQ ID NO: 12173 - DNA, 848 bp, Homo sapiens; identical to SEQ ID NO: 10679
  source 1..848: mol_type = unassigned DNA

SEQ ID NO: 12174 - DNA, 1230 bp, Homo sapiens; identical to SEQ ID NO: 10680
  source 1..1230: mol_type = unassigned DNA

SEQ ID NO: 12175 - DNA, 2172 bp, Homo sapiens; identical to SEQ ID NO: 10695
  source 1..2172: mol_type = unassigned DNA

SEQ ID NO: 12176 - DNA, 338 bp, Homo sapiens; identical to SEQ ID NO: 10703
  source 1..338: mol_type = unassigned DNA

SEQ ID NO: 12177 - DNA, 5715 bp, Homo sapiens; identical to SEQ ID NO: 10711
  source 1..5715: mol_type = unassigned DNA

SEQ ID NO: 12178 - DNA, 1059 bp, Homo sapiens; identical to SEQ ID NO: 10717
  source 1..1059: mol_type = unassigned DNA

SEQ ID NO: 12179 - DNA, 1503 bp, Homo sapiens; identical to SEQ ID NO: 10725
  source 1..1503: mol_type = unassigned DNA

SEQ ID NO: 12180 - DNA, 1437 bp, Homo sapiens; identical to SEQ ID NO: 10734
  source 1..1437: mol_type = unassigned DNA

SEQ ID NO: 12181 - DNA, 1203 bp, Homo sapiens; identical to SEQ ID NO: 10743
  source 1..1203: mol_type = unassigned DNA

SEQ ID NO: 12182 - DNA, 206 bp, Homo sapiens; identical to SEQ ID NO: 10749
  source 1..206: mol_type = unassigned DNA

SEQ ID NO: 12183 - DNA, 1141 bp, Homo sapiens; identical to SEQ ID NO: 10750
  source 1..1141: mol_type = unassigned DNA

SEQ ID NO: 12184 - DNA, 1819 bp, Homo sapiens; identical to SEQ ID NO: 10751
  source 1..1819: mol_type = unassigned DNA

SEQ ID NO: 12185 - DNA, 1813 bp, Homo sapiens; identical to SEQ ID NO: 10752
  source 1..1813: mol_type = unassigned DNA

SEQ ID NO: 12186 - DNA, 1872 bp, Homo sapiens; identical to SEQ ID NO: 10753
  source 1..1872: mol_type = unassigned DNA

SEQ ID NO: 12187 - DNA, 652 bp, Homo sapiens; identical to SEQ ID NO: 10754
  source 1..652: mol_type = unassigned DNA

SEQ ID NO: 12188 - DNA, 722 bp, Homo sapiens; identical to SEQ ID NO: 10755
  source 1..722: mol_type = unassigned DNA

SEQ ID NO: 12189 - DNA, 858 bp, Homo sapiens; identical to SEQ ID NO: 10756
  source 1..858: mol_type = unassigned DNA

SEQ ID NO: 12190 - DNA, 598 bp, Homo sapiens; identical to SEQ ID NO: 10757
  source 1..598: mol_type = unassigned DNA

SEQ ID NO: 12191 - DNA, 1281 bp, Homo sapiens; identical to SEQ ID NO: 10758
  source 1..1281: mol_type = unassigned DNA

SEQ ID NO: 12192 - DNA, 1788 bp, Homo sapiens; identical to SEQ ID NO: 10759
  source 1..1788: mol_type = unassigned DNA

SEQ ID NO: 12193 - DNA, 626 bp, Homo sapiens; identical to SEQ ID NO: 10760
  source 1..626: mol_type = unassigned DNA

SEQ ID NO: 12194 - DNA, 1037 bp, Homo sapiens; identical to SEQ ID NO: 10761
  source 1..1037: mol_type = unassigned DNA

SEQ ID NO: 12195 - DNA, 977 bp, Homo sapiens; identical to SEQ ID NO: 10762
  source 1..977: mol_type = unassigned DNA

SEQ ID NO: 12196 - DNA, 6206 bp, Homo sapiens; identical to SEQ ID NO: 10763
  source 1..6206: mol_type = unassigned DNA

SEQ ID NO: 12197 - DNA, 574 bp, Homo sapiens; identical to SEQ ID NO: 10764
  source 1..574: mol_type = unassigned DNA

SEQ ID NO: 12198 - DNA, 3438 bp, Homo sapiens; identical to SEQ ID NO: 10765
  source 1..3438: mol_type = unassigned DNA

SEQ ID NO: 12199 - DNA, 4088 bp, Homo sapiens; identical to SEQ ID NO: 10766
  source 1..4088: mol_type = unassigned DNA

SEQ ID NO: 12200 - DNA, 522 bp, Homo sapiens; identical to SEQ ID NO: 10767
  source 1..522: mol_type = unassigned DNA

SEQ ID NO: 12201 - DNA, 2260 bp, Homo sapiens; identical to SEQ ID NO: 10768
  source 1..2260: mol_type = unassigned DNA

SEQ ID NO: 12202 - DNA, 1502 bp, Homo sapiens; identical to SEQ ID NO: 10769
  source 1..1502: mol_type = unassigned DNA

SEQ ID NO: 12203 - DNA, 510 bp, Homo sapiens; identical to SEQ ID NO: 10770
  source 1..510: mol_type = unassigned DNA

SEQ ID NO: 12204 - DNA, 940 bp, Homo sapiens; identical to SEQ ID NO: 10771
  source 1..940: mol_type = unassigned DNA

SEQ ID NO: 12205 - DNA, 2718 bp, Homo sapiens; identical to SEQ ID NO: 10772
  source 1..2718: mol_type = unassigned DNA

SEQ ID NO: 12206 - DNA, 2661 bp, Homo sapiens; identical to SEQ ID NO: 10773
  source 1..2661: mol_type = unassigned DNA

SEQ ID NO: 12207 - DNA, 801 bp, Homo sapiens; identical to SEQ ID NO: 10774
  source 1..801: mol_type = unassigned DNA

SEQ ID NO: 12208 - DNA, 311 bp, Homo sapiens; identical to SEQ ID NO: 10775
  source 1..311: mol_type = unassigned DNA

SEQ ID NO: 12209 - DNA, 1048 bp, Homo sapiens; identical to SEQ ID NO: 10776
  source 1..1048: mol_type = unassigned DNA

SEQ ID NO: 12210 - DNA, 301 bp, Homo sapiens; identical to SEQ ID NO: 10777
  source 1..301: mol_type = unassigned DNA

SEQ ID NO: 12211 - DNA, 1395 bp, Homo sapiens; identical to SEQ ID NO: 10778
  source 1..1395: mol_type = unassigned DNA

SEQ ID NO: 12212 - DNA, 766 bp, Homo sapiens; identical to SEQ ID NO: 10779
  source 1..766: mol_type = unassigned DNA

SEQ ID NO: 12213 - DNA, 691 bp, Homo sapiens; identical to SEQ ID NO: 10780
  source 1..691: mol_type = unassigned DNA

SEQ ID NO: 12214 - DNA, 1024 bp, Homo sapiens; identical to SEQ ID NO: 10781
  source 1..1024: mol_type = unassigned DNA

SEQ ID NO: 12215 - DNA, 1339 bp, Homo sapiens; identical to SEQ ID NO: 10782
  source 1..1339: mol_type = unassigned DNA

SEQ ID NO: 12216 - DNA, 1376 bp, Homo sapiens; identical to SEQ ID NO: 10791
  source 1..1376: mol_type = unassigned DNA

SEQ ID NO: 12217 - DNA, 3843 bp, Homo sapiens; identical to SEQ ID NO: 10798
  source 1..3843: mol_type = unassigned DNA

SEQ ID NO: 12218 - DNA, 1622 bp, Homo sapiens; identical to SEQ ID NO: 10806
  source 1..1622: mol_type = unassigned DNA

SEQ ID NO: 12219 - DNA, 1441 bp, Homo sapiens; identical to SEQ ID NO: 10817
  source 1..1441: mol_type = unassigned DNA

SEQ ID NO: 12220 - DNA, 848 bp, Homo sapiens; identical to SEQ ID NO: 10826
  source 1..848: mol_type = unassigned DNA

SEQ ID NO: 12221 - DNA, 1230 bp, Homo sapiens; identical to SEQ ID NO: 10827
  source 1..1230: mol_type = unassigned DNA

SEQ ID NO: 12222 - DNA, 2172 bp, Homo sapiens; identical to SEQ ID NO: 10842
  source 1..2172: mol_type = unassigned DNA

SEQ ID NO: 12223 - DNA, 338 bp, Homo sapiens; identical to SEQ ID NO: 10850
  source 1..338: mol_type = unassigned DNA

SEQ ID NO: 12224 - DNA, 5715 bp, Homo sapiens; identical to SEQ ID NO: 10858
  source 1..5715: mol_type = unassigned DNA

SEQ ID NO: 12225 - DNA, 1059 bp, Homo sapiens; identical to SEQ ID NO: 10864
  source 1..1059: mol_type = unassigned DNA

SEQ ID NO: 12226 - DNA, 1503 bp, Homo sapiens; identical to SEQ ID NO: 10872
  source 1..1503: mol_type = unassigned DNA

SEQ ID NO: 12227 - DNA, 1437 bp, Homo sapiens; identical to SEQ ID NO: 10881
  source 1..1437: mol_type = unassigned DNA

SEQ ID NO: 12228 - DNA, 1203 bp, Homo sapiens; identical to SEQ ID NO: 10890
  source 1..1203: mol_type = unassigned DNA

SEQ ID NO: 12229 - DNA, 206 bp, Homo sapiens; identical to SEQ ID NO: 10896
  source 1..206: mol_type = unassigned DNA

SEQ ID NO: 12230 - DNA, 1141 bp, Homo sapiens; identical to SEQ ID NO: 10897
  source 1..1141: mol_type = unassigned DNA

SEQ ID NO: 12231 - DNA, 1819 bp, Homo sapiens; identical to SEQ ID NO: 10898
  source 1..1819: mol_type = unassigned DNA

SEQ ID NO: 12232 - DNA, 1813 bp, Homo sapiens; identical to SEQ ID NO: 10899
  source 1..1813: mol_type = unassigned DNA

SEQ ID NO: 12233 - DNA, 1872 bp, Homo sapiens; identical to SEQ ID NO: 10900
  source 1..1872: mol_type = unassigned DNA

SEQ ID NO: 12234 - DNA, 652 bp, Homo sapiens; identical to SEQ ID NO: 10901
  source 1..652: mol_type = unassigned DNA

SEQ ID NO: 12235 - DNA, 722 bp, Homo sapiens; identical to SEQ ID NO: 10902
  source 1..722: mol_type = unassigned DNA

SEQ ID NO: 12236 - DNA, 858 bp, Homo sapiens; identical to SEQ ID NO: 10903
  source 1..858: mol_type = unassigned DNA

SEQ ID NO: 12237 - DNA, 598 bp, Homo sapiens; identical to SEQ ID NO: 10904
  source 1..598: mol_type = unassigned DNA

SEQ ID NO: 12238 - DNA, 1281 bp, Homo sapiens; identical to SEQ ID NO: 10905
  source 1..1281: mol_type = unassigned DNA

SEQ ID NO: 12239 - DNA, 1788 bp, Homo sapiens; identical to SEQ ID NO: 10906
  source 1..1788: mol_type = unassigned DNA

SEQ ID NO: 12240 - DNA, 626 bp, Homo sapiens; identical to SEQ ID NO: 10907
  source 1..626: mol_type = unassigned DNA

SEQ ID NO: 12241 - DNA, 1037 bp, Homo sapiens; identical to SEQ ID NO: 10908
  source 1..1037: mol_type = unassigned DNA

SEQ ID NO: 12242 - DNA, 977 bp, Homo sapiens; identical to SEQ ID NO: 10909
  source 1..977: mol_type = unassigned DNA

SEQ ID NO: 12243 - DNA, 6206 bp, Homo sapiens; identical to SEQ ID NO: 10910
  source 1..6206: mol_type = unassigned DNA

SEQ ID NO: 12244 - DNA, 574 bp, Homo sapiens; identical to SEQ ID NO: 10911
  source 1..574: mol_type = unassigned DNA

SEQ ID NO: 12245 - DNA, 3438 bp, Homo sapiens; identical to SEQ ID NO: 10912
  source 1..3438: mol_type = unassigned DNA

SEQ ID NO: 12246 - DNA, 4088 bp, Homo sapiens; identical to SEQ ID NO: 10913
  source 1..4088: mol_type = unassigned DNA

SEQ ID NO: 12247 - DNA, 522 bp, Homo sapiens; identical to SEQ ID NO: 10914
  source 1..522: mol_type = unassigned DNA

SEQ ID NO: 12248 - DNA, 2260 bp, Homo sapiens; identical to SEQ ID NO: 10915
  source 1..2260: mol_type = unassigned DNA

SEQ ID NO: 12249 - DNA, 1502 bp, Homo sapiens; identical to SEQ ID NO: 10916
  source 1..1502: mol_type = unassigned DNA

SEQ ID NO: 12250 - DNA, 510 bp, Homo sapiens; identical to SEQ ID NO: 10917
  source 1..510: mol_type = unassigned DNA

SEQ ID NO: 12251 - DNA, 940 bp, Homo sapiens; identical to SEQ ID NO: 10918
  source 1..940: mol_type = unassigned DNA

SEQ ID NO: 12252 - DNA, 2718 bp, Homo sapiens; identical to SEQ ID NO: 10919
  source 1..2718: mol_type = unassigned DNA

SEQ ID NO: 12253 - DNA, 2661 bp, Homo sapiens; identical to SEQ ID NO: 10920
  source 1..2661: mol_type = unassigned DNA

SEQ ID NO: 12254 - DNA, 801 bp, Homo sapiens; identical to SEQ ID NO: 10921
  source 1..801: mol_type = unassigned DNA

SEQ ID NO: 12255 - DNA, 311 bp, Homo sapiens; identical to SEQ ID NO: 10922
  source 1..311: mol_type = unassigned DNA

SEQ ID NO: 12256 - DNA, 1048 bp, Homo sapiens; identical to SEQ ID NO: 10923
  source 1..1048: mol_type = unassigned DNA

SEQ ID NO: 12257 - DNA, 301 bp, Homo sapiens; identical to SEQ ID NO: 10924
  source 1..301: mol_type = unassigned DNA

SEQ ID NO: 12258 - DNA, 1395 bp, Homo sapiens; identical to SEQ ID NO: 10925
  source 1..1395: mol_type = unassigned DNA

SEQ ID NO: 12259 - DNA, 766 bp, Homo sapiens; identical to SEQ ID NO: 10926
  source 1..766: mol_type = unassigned DNA

SEQ ID NO: 12260 - DNA, 691 bp, Homo sapiens; identical to SEQ ID NO: 10927
  source 1..691: mol_type = unassigned DNA

SEQ ID NO: 12261 - DNA, 1024 bp, Homo sapiens; identical to SEQ ID NO: 10928
  source 1..1024: mol_type = unassigned DNA

SEQ ID NO: 12262 - DNA, 1339 bp, Homo sapiens; identical to SEQ ID NO: 10929
  source 1..1339: mol_type = unassigned DNA

SEQ ID NO: 12263 - DNA, 1376 bp, Homo sapiens; identical to SEQ ID NO: 10938
  source 1..1376: mol_type = unassigned DNA

SEQ ID NO: 12264 - DNA, 3843 bp, Homo sapiens; identical to SEQ ID NO: 10945
  source 1..3843: mol_type = unassigned DNA

SEQ ID NO: 12265 - DNA, 1622 bp, Homo sapiens; identical to SEQ ID NO: 10953
  source 1..1622: mol_type = unassigned DNA

SEQ ID NO: 12266 - DNA, 1441 bp, Homo sapiens; identical to SEQ ID NO: 10964
  source 1..1441: mol_type = unassigned DNA

SEQ ID NO: 12267 - DNA, 848 bp, synthetic construct; identical to SEQ ID NO: 10973
  misc_feature 1..848: note = Description of Artificial Sequence: Synthetic polynucleotide
  source 1..848: mol_type = other DNA

SEQ ID NO: 12268 - DNA, 1230 bp, synthetic construct; identical to SEQ ID NO: 10974
  misc_feature 1..1230: note = Description of Artificial Sequence: Synthetic polynucleotide
  source 1..1230: mol_type = other DNA

SEQ ID NO: 12269 - DNA, 2172 bp, synthetic construct; identical to SEQ ID NO: 10989
  misc_feature 1..2172: note = Description of Artificial Sequence: Synthetic polynucleotide
  source 1..2172: mol_type = other DNA

SEQ ID NO: 12270 - DNA, 338 bp, synthetic construct; identical to SEQ ID NO: 10997
  misc_feature 1..338: note = Description of Artificial Sequence: Synthetic polynucleotide
  source 1..338: mol_type = other DNA

SEQ ID NO: 12271 - DNA, 5715 bp, synthetic construct; identical to SEQ ID NO: 11005
  misc_feature 1..5715: note = Description of Artificial Sequence: Synthetic polynucleotide
  source 1..5715: mol_type = other DNA

SEQ ID NO: 12272 - DNA, 1059 bp, synthetic construct; identical to SEQ ID NO: 11011
  misc_feature 1..1059: note = Description of Artificial Sequence: Synthetic polynucleotide
  source 1..1059: mol_type = other DNA

SEQ ID NO: 12273 - DNA, 1503 bp, synthetic construct; identical to SEQ ID NO: 11019
  misc_feature 1..1503: note = Description of Artificial Sequence: Synthetic polynucleotide
  source 1..1503: mol_type = other DNA

SEQ ID NO: 12274 - DNA, 1437 bp, synthetic construct; identical to SEQ ID NO: 11028
  misc_feature 1..1437: note = Description of Artificial Sequence: Synthetic polynucleotide
  source 1..1437: mol_type = other DNA

SEQ ID NO: 12275 - DNA, 1203 bp, synthetic construct; identical to SEQ ID NO: 11037
  misc_feature 1..1203: note = Description of Artificial Sequence: Synthetic polynucleotide
  source 1..1203: mol_type = other DNA

SEQ ID NO: 12276 - DNA, 206 bp, synthetic construct; identical to SEQ ID NO: 11043
  misc_feature 1..206: note = Description of Artificial Sequence: Synthetic polynucleotide
  source 1..206: mol_type = other DNA

SEQ ID NO: 12277 - DNA, 1141 bp, synthetic construct; identical to SEQ ID NO: 11044
  misc_feature 1..1141: note = Description of Artificial Sequence: Synthetic polynucleotide
  source 1..1141: mol_type = other DNA

SEQ ID NO: 12278 - DNA, 1819 bp, synthetic construct; identical to SEQ ID NO: 11045
  misc_feature 1..1819: note = Description of Artificial Sequence: Synthetic polynucleotide
  source 1..1819: mol_type = other DNA

SEQ ID NO: 12279 - DNA, 1813 bp, synthetic construct; identical to SEQ ID NO: 11046
  misc_feature 1..1813: note = Description of Artificial Sequence: Synthetic polynucleotide
  source 1..1813: mol_type = other DNA

SEQ ID NO: 12280 - DNA, 1872 bp, synthetic construct; identical to SEQ ID NO: 11047
  misc_feature 1..1872: note = Description of Artificial Sequence: Synthetic polynucleotide
  source 1..1872: mol_type = other DNA

SEQ ID NO: 12281 - DNA, 652 bp, synthetic construct; identical to SEQ ID NO: 11048
  misc_feature 1..652: note = Description of Artificial Sequence: Synthetic polynucleotide
  source 1..652: mol_type = other DNA

SEQ ID NO: 12282 - DNA, 722 bp, synthetic construct; identical to SEQ ID NO: 11049
  misc_feature 1..722: note = Description of Artificial Sequence: Synthetic polynucleotide
  source 1..722: mol_type = other DNA

SEQ ID NO: 12283 - DNA, 858 bp, synthetic construct; identical to SEQ ID NO: 11050
  misc_feature 1..858: note = Description of Artificial Sequence: Synthetic polynucleotide
  source 1..858: mol_type = other DNA

SEQ ID NO: 12284 - DNA, 598 bp, synthetic construct; identical to SEQ ID NO: 11051
  misc_feature 1..598: note = Description of Artificial Sequence: Synthetic polynucleotide
  source 1..598: mol_type = other DNA

SEQ ID NO: 12285 - DNA, 1281 bp, synthetic construct; identical to SEQ ID NO: 11052
  misc_feature 1..1281: note = Description of Artificial Sequence: Synthetic polynucleotide
  source 1..1281: mol_type = other DNA

SEQ ID NO: 12286 - DNA, 1788 bp, synthetic construct; identical to SEQ ID NO: 11053
  misc_feature 1..1788: note = Description of Artificial Sequence: Synthetic polynucleotide
  source 1..1788: mol_type = other DNA

SEQ ID NO: 12287 - DNA, 626 bp, synthetic construct; identical to SEQ ID NO: 11054
  misc_feature 1..626: note = Description of Artificial Sequence: Synthetic polynucleotide
  source 1..626: mol_type = other DNA

SEQ ID NO: 12288 - DNA, 1037 bp, synthetic construct; identical to SEQ ID NO: 11055
  misc_feature 1..1037: note = Description of Artificial Sequence: Synthetic polynucleotide
  source 1..1037: mol_type = other DNA

SEQ ID NO: 12289 - DNA, 977 bp, synthetic construct; identical to SEQ ID NO: 11056
  misc_feature 1..977: note = Description of Artificial Sequence: Synthetic polynucleotide
  source 1..977: mol_type = other DNA

SEQ ID NO: 12290 - DNA, 6206 bp, synthetic construct; identical to SEQ ID NO: 11057
  misc_feature 1..6206: note = Description of Artificial Sequence: Synthetic polynucleotide
  source 1..6206: mol_type = other DNA

SEQ ID NO: 12291 - DNA, 574 bp, synthetic construct; identical to SEQ ID NO: 11058
  misc_feature 1..574: note = Description of Artificial Sequence: Synthetic polynucleotide
  source 1..574: mol_type = other DNA

SEQ ID NO: 12292 - DNA, 3438 bp, synthetic construct; identical to SEQ ID NO: 11059
  misc_feature 1..3438: note = Description of Artificial Sequence: Synthetic polynucleotide
  source 1..3438: mol_type = other DNA

SEQ ID NO: 12293 - DNA, 4088 bp, synthetic construct; identical to SEQ ID NO: 11060
  misc_feature 1..4088: note = Description of Artificial Sequence: Synthetic polynucleotide
  source 1..4088: mol_type = other DNA

SEQ ID NO: 12294 - DNA, 522 bp, synthetic construct; identical to SEQ ID NO: 11061
  misc_feature 1..522: note = Description of Artificial Sequence: Synthetic polynucleotide
  source 1..522: mol_type = other DNA

SEQ ID NO: 12295 - DNA, 2260 bp, synthetic construct; identical to SEQ ID NO: 11062
  misc_feature 1..2260: note = Description of Artificial Sequence: Synthetic polynucleotide
  source 1..2260: mol_type = other DNA

SEQ ID NO: 12296 - DNA, 1502 bp, synthetic construct; identical to SEQ ID NO: 11063
  misc_feature 1..1502: note = Description of Artificial Sequence: Synthetic polynucleotide
  source 1..1502: mol_type = other DNA

SEQ ID NO: 12297 - DNA, 510 bp, synthetic construct; identical to SEQ ID NO: 11064
  misc_feature 1..510: note = Description of Artificial Sequence: Synthetic polynucleotide
  source 1..510: mol_type = other DNA

SEQ ID NO: 12298 - DNA, 940 bp, synthetic construct; identical to SEQ ID NO: 11065
  misc_feature 1..940: note = Description of Artificial Sequence: Synthetic polynucleotide
  source 1..940: mol_type = other DNA

SEQ ID NO: 12299 - DNA, 2718 bp, synthetic construct; identical to SEQ ID NO: 11066
  misc_feature 1..2718: note = Description of Artificial Sequence: Synthetic polynucleotide
  source 1..2718: mol_type = other DNA

SEQ ID NO: 12300 - DNA, 2661 bp, synthetic construct; identical to SEQ ID NO: 11067
  misc_feature 1..2661: note = Description of Artificial Sequence: Synthetic polynucleotide
  source 1..2661: mol_type = other DNA

SEQ ID NO: 12301 - DNA, 801 bp, synthetic construct; identical to SEQ ID NO: 11068
  misc_feature 1..801: note = Description of Artificial Sequence: Synthetic polynucleotide
  source 1..801: mol_type = other DNA

SEQ ID NO: 12302 - DNA, 311 bp, synthetic construct; identical to SEQ ID NO: 11069
  misc_feature 1..311: note = Description of Artificial Sequence: Synthetic polynucleotide
  source 1..311: mol_type = other DNA

SEQ ID NO: 12303 - DNA, 1048 bp, synthetic construct; identical to SEQ ID NO: 11070
  misc_feature 1..1048: note = Description of Artificial Sequence: Synthetic polynucleotide
  source 1..1048: mol_type = other DNA

SEQ ID NO: 12304 - DNA, 301 bp, synthetic construct; identical to SEQ ID NO: 11071
  misc_feature 1..301: note = Description of Artificial Sequence: Synthetic polynucleotide
  source 1..301: mol_type = other DNA

SEQ ID NO: 12305 - DNA, 1395 bp, synthetic construct; identical to SEQ ID NO: 11072
  misc_feature 1..1395: note = Description of Artificial Sequence: Synthetic polynucleotide
  source 1..1395: mol_type = other DNA

SEQ ID NO: 12306 - DNA, 766 bp, synthetic construct; identical to SEQ ID NO: 11073
  misc_feature 1..766: note = Description of Artificial Sequence: Synthetic polynucleotide
  source 1..766: mol_type = other DNA

SEQ ID NO: 12307 - DNA, 691 bp, synthetic construct; identical to SEQ ID NO: 11074
  misc_feature 1..691: note = Description of Artificial Sequence: Synthetic polynucleotide
  source 1..691: mol_type = other DNA

SEQ ID NO: 12308 - DNA, 1024 bp, synthetic construct; identical to SEQ ID NO: 11075
  misc_feature 1..1024: note = Description of Artificial Sequence: Synthetic polynucleotide
  source 1..1024: mol_type = other DNA

SEQ ID NO: 12309 - DNA, 1339 bp, synthetic construct; identical to SEQ ID NO: 11076
  misc_feature 1..1339: note = Description of Artificial Sequence: Synthetic polynucleotide
  source 1..1339: mol_type = other DNA

SEQ ID NO: 12310 - DNA, 1376 bp, synthetic construct; identical to SEQ ID NO: 11085
  misc_feature 1..1376: note = Description of Artificial Sequence: Synthetic polynucleotide
  source 1..1376: mol_type = other DNA

SEQ ID NO: 12311 - DNA, 3843 bp, synthetic construct; identical to SEQ ID NO: 11092
  misc_feature 1..3843: note = Description of Artificial Sequence: Synthetic polynucleotide
  source 1..3843: mol_type = other DNA

SEQ ID NO: 12312 - DNA, 1622 bp, synthetic construct; identical to SEQ ID NO: 11100
  misc_feature 1..1622: note = Description of Artificial Sequence: Synthetic polynucleotide
  source 1..1622: mol_type = other DNA

SEQ ID NO: 12313 - DNA, 1441 bp, synthetic construct; identical to SEQ ID NO: 11111
  misc_feature 1..1441: note = Description of Artificial Sequence: Synthetic polynucleotide
  source 1..1441: mol_type = other DNA

SEQ ID NO: 12314 - DNA, 848 bp, synthetic construct; identical to SEQ ID NO: 11120
  misc_feature 1..848: note = Description of Artificial Sequence: Synthetic polynucleotide
  source 1..848: mol_type = other DNA

SEQ ID NO: 12315 - DNA, 1230 bp, synthetic construct; identical to SEQ ID NO: 11121
  misc_feature 1..1230: note = Description of Artificial Sequence: Synthetic polynucleotide
  source 1..1230: mol_type = other DNA

SEQ ID NO: 12316 - DNA, 2172 bp, synthetic construct; identical to SEQ ID NO: 11136
  misc_feature 1..2172: note = Description of Artificial Sequence: Synthetic polynucleotide
  source 1..2172: mol_type = other DNA

SEQ ID NO: 12317 - DNA, 338 bp, synthetic construct; identical to SEQ ID NO: 11144
  misc_feature 1..338: note = Description of Artificial Sequence: Synthetic polynucleotide
  source 1..338: mol_type = other DNA

SEQ ID NO: 12318 - DNA, 5715 bp, synthetic construct; identical to SEQ ID NO: 11152
  misc_feature 1..5715: note = Description of Artificial Sequence: Synthetic polynucleotide
  source 1..5715: mol_type = other DNA

SEQ ID NO: 12319 - DNA, 1059 bp, synthetic construct; identical to SEQ ID NO: 11158
  misc_feature 1..1059: note = Description of Artificial Sequence: Synthetic polynucleotide
  source 1..1059: mol_type = other DNA

SEQ ID NO: 12320 - DNA, 1503 bp, synthetic construct; identical to SEQ ID NO: 11166
  misc_feature 1..1503: note = Description of Artificial Sequence: Synthetic polynucleotide
  source 1..1503: mol_type = other DNA

SEQ ID NO: 12321 - DNA, 1437 bp, synthetic construct; identical to SEQ ID NO: 11175
  misc_feature 1..1437: note = Description of Artificial Sequence: Synthetic polynucleotide
  source 1..1437: mol_type = other DNA

SEQ ID NO: 12322 - DNA, 1203 bp, synthetic construct; identical to SEQ ID NO: 11184
  misc_feature 1..1203: note = Description of Artificial Sequence: Synthetic polynucleotide
  source 1..1203: mol_type = other DNA

SEQ ID NO: 12323 - DNA, 206 bp, synthetic construct; identical to SEQ ID NO: 11190
  misc_feature 1..206: note = Description of Artificial Sequence: Synthetic polynucleotide
  source 1..206: mol_type = other DNA

SEQ ID NO: 12324 - DNA, 1141 bp, synthetic construct; identical to SEQ ID NO: 11191
  misc_feature 1..1141: note = Description of Artificial Sequence: Synthetic polynucleotide
  source 1..1141: mol_type = other DNA

SEQ ID NO: 12325 - DNA, 1819 bp, synthetic construct; identical to SEQ ID NO: 11192
  misc_feature 1..1819: note = Description of Artificial Sequence: Synthetic polynucleotide
  source 1..1819: mol_type = other DNA

SEQ ID NO: 12326 - DNA, 1813 bp, synthetic construct; identical to SEQ ID NO: 11193
  misc_feature 1..1813: note = Description of Artificial Sequence: Synthetic polynucleotide
  source 1..1813: mol_type = other DNA

SEQ ID NO: 12327 - DNA, 1872 bp, synthetic construct; identical to SEQ ID NO: 11194
  misc_feature 1..1872: note = Description of Artificial Sequence: Synthetic polynucleotide
  source 1..1872: mol_type = other DNA

SEQ ID NO: 12328 - DNA, 652 bp, synthetic construct; identical to SEQ ID NO: 11195
  misc_feature 1..652: note = Description of Artificial Sequence: Synthetic polynucleotide
  source 1..652: mol_type = other DNA

SEQ ID NO: 12329 - DNA, 722 bp, synthetic construct; identical to SEQ ID NO: 11196
  misc_feature 1..722: note = Description of Artificial Sequence: Synthetic polynucleotide
  source 1..722: mol_type = other DNA

SEQ ID NO: 12330 - DNA, 858 bp, synthetic construct; identical to SEQ ID NO: 11197
  misc_feature 1..858: note = Description of Artificial Sequence: Synthetic polynucleotide
  source 1..858: mol_type = other DNA

SEQ ID NO: 12331 - DNA, 598 bp, synthetic construct; identical to SEQ ID NO: 11198
  misc_feature 1..598: note = Description of Artificial Sequence: Synthetic polynucleotide
  source 1..598: mol_type = other DNA

SEQ ID NO: 12332 - DNA, 1281 bp, synthetic construct; identical to SEQ ID NO: 11199
  misc_feature 1..1281: note = Description of Artificial Sequence: Synthetic polynucleotide
  source 1..1281: mol_type = other DNA

SEQ ID NO: 12333 - DNA, 1788 bp, synthetic construct; identical to SEQ ID NO: 11200
  misc_feature 1..1788: note = Description of Artificial Sequence: Synthetic polynucleotide
  source 1..1788: mol_type = other DNA

SEQ ID NO: 12334 - DNA, 626 bp, synthetic construct; identical to SEQ ID NO: 11201
  misc_feature 1..626: note = Description of Artificial Sequence: Synthetic polynucleotide
  source 1..626: mol_type = other DNA

SEQ ID NO: 12335 - DNA, 1037 bp, synthetic construct; identical to SEQ ID NO: 11202
  misc_feature 1..1037: note = Description of Artificial Sequence: Synthetic polynucleotide
  source 1..1037: mol_type = other DNA

SEQ ID NO: 12336 - DNA, 977 bp, synthetic construct; identical to SEQ ID NO: 11203
  misc_feature 1..977: note = Description of Artificial Sequence: Synthetic polynucleotide
  source 1..977: mol_type = other DNA

SEQ ID NO: 12337 - DNA, 6206 bp, synthetic construct; identical to SEQ ID NO: 11204
  misc_feature 1..6206: note = Description of Artificial Sequence: Synthetic polynucleotide
  source 1..6206: mol_type = other DNA

SEQ ID NO: 12338 - DNA, 574 bp, synthetic construct; identical to SEQ ID NO: 11205
  misc_feature 1..574: note = Description of Artificial Sequence: Synthetic polynucleotide
  source 1..574: mol_type = other DNA

SEQ ID NO: 12339 - DNA, 3438 bp, synthetic construct; identical to SEQ ID NO: 11206
  misc_feature 1..3438: note = Description of Artificial Sequence: Synthetic polynucleotide
  source 1..3438: mol_type = other DNA

SEQ ID NO: 12340 - DNA, 4088 bp, synthetic construct; identical to SEQ ID NO: 11207
  misc_feature 1..4088: note = Description of Artificial Sequence: Synthetic polynucleotide
  source 1..4088: mol_type = other DNA

SEQ ID NO: 12341 - DNA, 522 bp, synthetic construct; identical to SEQ ID NO: 11208
  misc_feature 1..522: note = Description of Artificial Sequence: Synthetic polynucleotide
  source 1..522: mol_type = other DNA

SEQ ID NO: 12342 - DNA, 2260 bp, synthetic construct; identical to SEQ ID NO: 11209
  misc_feature 1..2260: note = Description of Artificial Sequence: Synthetic polynucleotide
  source 1..2260: mol_type = other DNA

SEQ ID NO: 12343 - DNA, 1502 bp, synthetic construct; identical to SEQ ID NO: 11210
  misc_feature 1..1502: note = Description of Artificial Sequence: Synthetic polynucleotide
  source 1..1502: mol_type = other DNA

SEQ ID NO: 12344 - DNA, 510 bp, synthetic construct; identical to SEQ ID NO: 11211
  misc_feature 1..510: note = Description of Artificial Sequence: Synthetic polynucleotide
  source 1..510: mol_type = other DNA

SEQ ID NO: 12345 - DNA, 940 bp, synthetic construct; identical to SEQ ID NO: 11212
  misc_feature 1..940: note = Description of Artificial Sequence: Synthetic polynucleotide
  source 1..940: mol_type = other DNA

SEQ ID NO: 12346 - DNA, 2718 bp, synthetic construct; identical to SEQ ID NO: 11213
  misc_feature 1..2718: note = Description of Artificial Sequence: Synthetic polynucleotide
  source 1..2718: mol_type = other DNA

SEQ ID NO: 12347 - DNA, 2661 bp, synthetic construct; identical to SEQ ID NO: 11214
  misc_feature 1..2661: note = Description of Artificial Sequence: Synthetic polynucleotide
  source 1..2661: mol_type = other DNA

SEQ ID NO: 12348 - DNA, 801 bp, synthetic construct; identical to SEQ ID NO: 11215
  misc_feature 1..801: note = Description of Artificial Sequence: Synthetic polynucleotide
  source 1..801: mol_type = other DNA

SEQ ID NO: 12349 - DNA, 311 bp, synthetic construct; identical to SEQ ID NO: 11216
  misc_feature 1..311: note = Description of Artificial Sequence: Synthetic polynucleotide
  source 1..311: mol_type = other DNA

SEQ ID NO: 12350 - DNA, 1048 bp, synthetic construct; identical to SEQ ID NO: 11217
  misc_feature 1..1048: note = Description of Artificial Sequence: Synthetic polynucleotide
  source 1..1048: mol_type = other DNA

SEQ ID NO: 12351 - DNA, 301 bp, synthetic construct; identical to SEQ ID NO: 11218
  misc_feature 1..301: note = Description of Artificial Sequence: Synthetic polynucleotide
  source 1..301: mol_type = other DNA

SEQ ID NO: 12352 - DNA, 1395 bp, synthetic construct; identical to SEQ ID NO: 11219
  misc_feature 1..1395: note = Description of Artificial Sequence: Synthetic polynucleotide
  source 1..1395: mol_type = other DNA

SEQ ID NO: 12353 - DNA, 766 bp, synthetic construct; identical to SEQ ID NO: 11220
  misc_feature 1..766: note = Description of Artificial Sequence: Synthetic polynucleotide
  source 1..766: mol_type = other DNA

SEQ ID NO: 12354 - DNA, 691 bp, synthetic construct; identical to SEQ ID NO: 11221
  misc_feature 1..691: note = Description of Artificial Sequence: Synthetic polynucleotide
  source 1..691: mol_type = other DNA

SEQ ID NO: 12355 - DNA, 1024 bp, synthetic construct; identical to SEQ ID NO: 11222
  misc_feature 1..1024: note = Description of Artificial Sequence: Synthetic polynucleotide
  source 1..1024: mol_type = other DNA

SEQ ID NO: 12356 - DNA, 1339 bp, synthetic construct; identical to SEQ ID NO: 11223
  misc_feature 1..1339: note = Description of Artificial Sequence: Synthetic polynucleotide
  source 1..1339: mol_type = other DNA

SEQ ID NO: 12357 - DNA, 1376 bp, synthetic construct; identical to SEQ ID NO: 11232
  misc_feature 1..1376: note = Description of Artificial Sequence: Synthetic polynucleotide
  source 1..1376: mol_type = other DNA

SEQ ID NO: 12358 - DNA, 3843 bp, synthetic construct; identical to SEQ ID NO: 11239
  misc_feature 1..3843: note = Description of Artificial Sequence: Synthetic polynucleotide
  source 1..3843: mol_type = other DNA

SEQ ID NO: 12359 - DNA, 1622 bp, synthetic construct; identical to SEQ ID NO: 11247
  misc_feature 1..1622: note = Description of Artificial Sequence: Synthetic polynucleotide
  source 1..1622: mol_type = other DNA

SEQ ID NO: 12360 - DNA, 1441 bp, synthetic construct; identical to SEQ ID NO: 11258
  misc_feature 1..1441: note = Description of Artificial Sequence: Synthetic polynucleotide
  source 1..1441: mol_type = other DNA

SEQ ID NO: 12361 - DNA, 848 bp, synthetic construct; identical to SEQ ID NO: 11267
  misc_feature 1..848: note = Description of Artificial Sequence: Synthetic polynucleotide
  source 1..848: mol_type = other DNA

SEQ ID NO: 12362 - DNA, 1230 bp, synthetic construct; identical to SEQ ID NO: 11268
  misc_feature 1..1230: note = Description of Artificial Sequence: Synthetic polynucleotide
  source 1..1230: mol_type = other DNA

SEQ ID NO: 12363 - DNA, 2172 bp, synthetic construct; identical to SEQ ID NO: 11283
  misc_feature 1..2172: note = Description of Artificial Sequence: Synthetic polynucleotide
  source 1..2172: mol_type = other DNA

SEQ ID NO: 12364 - DNA, 338 bp, synthetic construct; identical to SEQ ID NO: 11291
  misc_feature 1..338: note = Description of Artificial Sequence: Synthetic polynucleotide
  source 1..338: mol_type = other DNA

SEQ ID NO: 12365 - DNA, 5715 bp, synthetic construct; identical to SEQ ID NO: 11299
  misc_feature 1..5715: note = Description of Artificial Sequence: Synthetic polynucleotide
  source 1..5715: mol_type = other DNA

SEQ ID NO: 12366 - DNA, 1059 bp, synthetic construct; identical to SEQ ID NO: 11305
  misc_feature 1..1059: note = Description of Artificial Sequence: Synthetic polynucleotide
  source 1..1059: mol_type = other DNA

SEQ ID NO: 12367 - DNA, 1503 bp, synthetic construct; identical to SEQ ID NO: 11313
  misc_feature 1..1503: note = Description of Artificial Sequence: Synthetic polynucleotide
  source 1..1503: mol_type = other DNA

SEQ ID NO: 12368 - DNA, 1437 bp, synthetic construct; identical to SEQ ID NO: 11322
  misc_feature 1..1437: note = Description of Artificial Sequence: Synthetic polynucleotide
  source 1..1437: mol_type = other DNA

SEQ ID NO: 12369 - DNA, 1203 bp, synthetic construct; identical to SEQ ID NO: 11331
  misc_feature 1..1203: note = Description of Artificial Sequence: Synthetic polynucleotide
  source 1..1203: mol_type = other DNA

SEQ ID NO: 12370 - DNA, 206 bp, synthetic construct; identical to SEQ ID NO: 11337
  misc_feature 1..206: note = Description of Artificial Sequence: Synthetic polynucleotide
  source 1..206: mol_type = other DNA

SEQ ID NO: 12371 - DNA, 1141 bp, synthetic construct; identical to SEQ ID NO: 11338
  misc_feature 1..1141: note = Description of Artificial Sequence: Synthetic polynucleotide
  source 1..1141: mol_type = other DNA

SEQ ID NO: 12372 - DNA, 1819 bp, synthetic construct; identical to SEQ ID NO: 11339
  misc_feature 1..1819: note = Description of Artificial Sequence: Synthetic polynucleotide
  source 1..1819: mol_type = other DNA

SEQ ID NO: 12373 - DNA, 1813 bp, synthetic construct; identical to SEQ ID NO: 11340
  misc_feature 1..1813: note = Description of Artificial Sequence: Synthetic polynucleotide
  source 1..1813: mol_type = other DNA

SEQ ID NO: 12374 - DNA, 1872 bp, synthetic construct; identical to SEQ ID NO: 11341
  misc_feature 1..1872: note = Description of Artificial Sequence: Synthetic polynucleotide
  source 1..1872: mol_type = other DNA

SEQ ID NO: 12375 - DNA, 652 bp, synthetic construct; identical to SEQ ID NO: 11342
  misc_feature 1..652: note = Description of Artificial Sequence: Synthetic polynucleotide
  source 1..652: mol_type = other DNA

SEQ ID NO: 12376 - DNA, 722 bp, synthetic construct; identical to SEQ ID NO: 11343
  misc_feature 1..722: note = Description of Artificial Sequence: Synthetic polynucleotide
  source 1..722: mol_type = other DNA

SEQ ID NO: 12377 - DNA, 858 bp, synthetic construct; identical to SEQ ID NO: 11344
  misc_feature 1..858: note = Description of Artificial Sequence: Synthetic polynucleotide
  source 1..858: mol_type = other DNA

SEQ ID NO: 12378 - DNA, 598 bp, synthetic construct; identical to SEQ ID NO: 11345
  misc_feature 1..598: note = Description of Artificial Sequence: Synthetic polynucleotide
  source 1..598: mol_type = other DNA

SEQ ID NO: 12379 - DNA, 1281 bp, synthetic construct; identical to SEQ ID NO: 11346
  misc_feature 1..1281: note = Description of Artificial Sequence: Synthetic polynucleotide
  source 1..1281: mol_type = other DNA

SEQ ID NO: 12380 - DNA, 1788 bp, synthetic construct; identical to SEQ ID NO: 11347
  misc_feature 1..1788: note = Description of Artificial Sequence: Synthetic polynucleotide
  source 1..1788: mol_type = other DNA

SEQ ID NO: 12381 - DNA, 626 bp, synthetic construct; identical to SEQ ID NO: 11348
  misc_feature 1..626: note = Description of Artificial Sequence: Synthetic polynucleotide
  source 1..626: mol_type = other DNA

SEQ ID NO: 12382 - DNA, 1037 bp, synthetic construct; identical to SEQ ID NO: 11349
  misc_feature 1..1037: note = Description of Artificial Sequence: Synthetic polynucleotide
  source 1..1037: mol_type = other DNA

SEQ ID NO: 12383 - DNA, 977 bp, synthetic construct; identical to SEQ ID NO: 11350
  misc_feature 1..977: note = Description of Artificial Sequence: Synthetic polynucleotide
  source 1..977: mol_type = other DNA

SEQ ID NO: 12384 - DNA, 6206 bp, synthetic construct; identical to SEQ ID NO: 11351
  misc_feature 1..6206: note = Description of Artificial Sequence: Synthetic polynucleotide
  source 1..6206: mol_type = other DNA

SEQ ID NO: 12385 - DNA, 574 bp, synthetic construct; identical to SEQ ID NO: 11352
  misc_feature 1..574: note = Description of Artificial Sequence: Synthetic polynucleotide
  source 1..574: mol_type = other DNA

SEQ ID NO: 12386 - DNA, 3438 bp, synthetic construct; identical to SEQ ID NO: 11353
  misc_feature 1..3438: note = Description of Artificial Sequence: Synthetic polynucleotide
  source 1..3438: mol_type = other DNA

SEQ ID NO: 12387 - DNA, 4088 bp, synthetic construct; identical to SEQ ID NO: 11354
  misc_feature 1..4088: note = Description of Artificial Sequence: Synthetic polynucleotide
  source 1..4088: mol_type = other DNA

SEQ ID NO: 12388 - DNA, 522 bp, synthetic construct; identical to SEQ ID NO: 11355
  misc_feature 1..522: note = Description of Artificial Sequence: Synthetic polynucleotide
  source 1..522: mol_type = other DNA

SEQ ID NO: 12389 - DNA, 2260 bp, synthetic construct; identical to SEQ ID NO: 11356
  misc_feature 1..2260: note = Description of Artificial Sequence: Synthetic polynucleotide
  source 1..2260: mol_type = other DNA

SEQ ID NO: 12390 - DNA, 1502 bp, synthetic construct; identical to SEQ ID NO: 11357
  misc_feature 1..1502: note = Description of Artificial Sequence: Synthetic polynucleotide
  source 1..1502: mol_type = other DNA

SEQ ID NO: 12391 - DNA, 510 bp, synthetic construct; identical to SEQ ID NO: 11358
  misc_feature 1..510: note = Description of Artificial Sequence: Synthetic polynucleotide
  source 1..510: mol_type = other DNA

SEQ ID NO: 12392 - DNA, 940 bp, synthetic construct; identical to SEQ ID NO: 11359
  misc_feature 1..940: note = Description of Artificial Sequence: Synthetic polynucleotide
  source 1..940: mol_type = other DNA

SEQ ID NO: 12393 - DNA, 2718 bp, synthetic construct; identical to SEQ ID NO: 11360
  misc_feature 1..2718: note = Description of Artificial Sequence: Synthetic polynucleotide
  source 1..2718: mol_type = other DNA

SEQ ID NO: 12394 - DNA, 2661 bp, synthetic construct; identical to SEQ ID NO: 11361
  misc_feature 1..2661: note = Description of Artificial Sequence: Synthetic polynucleotide
  source 1..2661: mol_type = other DNA

SEQ ID NO: 12395 - DNA, 801 bp, synthetic construct; identical to SEQ ID NO: 11362
  misc_feature 1..801: note = Description of Artificial Sequence: Synthetic polynucleotide
  source 1..801: mol_type = other DNA

SEQ ID NO: 12396 - DNA, 311 bp, synthetic construct; identical to SEQ ID NO: 11363
  misc_feature 1..311: note = Description of Artificial Sequence: Synthetic polynucleotide
  source 1..311: mol_type = other DNA

SEQ ID NO: 12397 - DNA, 1048 bp, synthetic construct; identical to SEQ ID NO: 11364
  misc_feature 1..1048: note = Description of Artificial Sequence: Synthetic polynucleotide
  source 1..1048: mol_type = other DNA

SEQ ID NO: 12398 - DNA, 301 bp, synthetic construct; identical to SEQ ID NO: 11365
  misc_feature 1..301: note = Description of Artificial Sequence: Synthetic polynucleotide
  source 1..301: mol_type = other DNA

SEQ ID NO: 12399 - DNA, 1395 bp, synthetic construct; identical to SEQ ID NO: 11366
  misc_feature 1..1395: note = Description of Artificial Sequence: Synthetic polynucleotide
  source 1..1395: mol_type = other DNA

SEQ ID NO: 12400 - DNA, 766 bp, synthetic construct; identical to SEQ ID NO: 11367
  misc_feature 1..766: note = Description of Artificial Sequence: Synthetic polynucleotide
  source 1..766: mol_type = other DNA

SEQ ID NO: 12401 - DNA, 691 bp, synthetic construct; identical to SEQ ID NO: 11368
  misc_feature 1..691: note = Description of Artificial Sequence: Synthetic polynucleotide
  source 1..691: mol_type = other DNA

SEQ ID NO: 12402 - DNA, 1024 bp, synthetic construct; identical to SEQ ID NO: 11369
  misc_feature 1..1024: note = Description of Artificial Sequence: Synthetic polynucleotide
  source 1..1024: mol_type = other DNA

SEQ ID NO: 12403 - DNA, 1339 bp, synthetic construct; identical to SEQ ID NO: 11370
  misc_feature 1..1339: note = Description of Artificial Sequence: Synthetic polynucleotide
  source 1..1339: mol_type = other DNA

SEQ ID NO: 12404 - DNA, 1376 bp, synthetic construct; identical to SEQ ID NO: 11379
  misc_feature 1..1376: note = Description of Artificial Sequence: Synthetic polynucleotide
  source 1..1376: mol_type = other DNA

SEQ ID NO: 12405 - DNA, 3843 bp, synthetic construct; identical to SEQ ID NO: 11386
  misc_feature 1..3843: note = Description of Artificial Sequence: Synthetic polynucleotide
  source 1..3843: mol_type = other DNA

SEQ ID NO: 12406 - DNA, 1622 bp, synthetic construct; identical to SEQ ID NO: 11394
  misc_feature 1..1622: note = Description of Artificial Sequence: Synthetic polynucleotide
  source 1..1622: mol_type = other DNA

SEQ ID NO: 12407 - DNA, 1441 bp, synthetic construct; identical to SEQ ID NO: 11405
  misc_feature 1..1441: note = Description of Artificial Sequence: Synthetic polynucleotide
  source 1..1441: mol_type = other DNA

SEQ ID NO: 12408 - DNA, 848 bp, synthetic construct; identical to SEQ ID NO: 11414
  misc_feature 1..848: note = Description of Artificial Sequence: Synthetic polynucleotide
  source 1..848: mol_type = other DNA

SEQ ID NO: 12409 - DNA, 1230 bp, synthetic construct; identical to SEQ ID NO: 11415
  misc_feature 1..1230: note = Description of Artificial Sequence: Synthetic polynucleotide
  source 1..1230: mol_type = other DNA

SEQ ID NO: 12410 - DNA, 2172 bp, synthetic construct; identical to SEQ ID NO: 11430
  misc_feature 1..2172: note = Description of Artificial Sequence: Synthetic polynucleotide
  source 1..2172: mol_type = other DNA

SEQ ID NO: 12411 - DNA, 338 bp, synthetic construct; identical to SEQ ID NO: 11438
  misc_feature 1..338: note = Description of Artificial Sequence: Synthetic polynucleotide
  source 1..338: mol_type = other DNA

SEQ ID NO: 12412 - DNA, 5715 bp, synthetic construct; identical to SEQ ID NO: 11446
  misc_feature 1..5715: note = Description of Artificial Sequence: Synthetic polynucleotide
  source 1..5715: mol_type = other DNA

SEQ ID NO: 12413 - DNA, 1059 bp, synthetic construct; identical to SEQ ID NO: 11452
  misc_feature 1..1059: note = Description of Artificial Sequence: Synthetic polynucleotide
  source 1..1059: mol_type = other DNA

SEQ ID NO: 12414 - DNA, 1503 bp, synthetic construct; identical to SEQ ID NO: 11460
  misc_feature 1..1503: note = Description of Artificial Sequence: Synthetic polynucleotide
  source 1..1503: mol_type = other DNA

SEQ ID NO: 12415 - DNA, 1437 bp, synthetic construct; identical to SEQ ID NO: 11469
  misc_feature 1..1437: note = Description of Artificial Sequence: Synthetic polynucleotide
  source 1..1437: mol_type = other DNA

SEQ ID NO: 12416 - DNA, 1203 bp, synthetic construct; identical to SEQ ID NO: 11478
  misc_feature 1..1203: note = Description of Artificial Sequence: Synthetic polynucleotide
  source 1..1203: mol_type = other DNA

SEQ ID NO: 12417 - DNA, 206 bp, synthetic construct; identical to SEQ ID NO: 11484
  misc_feature 1..206: note = Description of Artificial Sequence: Synthetic polynucleotide
  source 1..206: mol_type = other DNA

SEQ ID NO: 12418 - DNA, 1141 bp, synthetic construct; identical to SEQ ID NO: 11485
  misc_feature 1..1141: note = Description of Artificial Sequence: Synthetic polynucleotide
  source 1..1141: mol_type = other DNA

SEQ ID NO: 12419 - DNA, 1819 bp, synthetic construct; identical to SEQ ID NO: 11486
  misc_feature 1..1819: note = Description of Artificial Sequence: Synthetic polynucleotide
  source 1..1819: mol_type = other DNA

SEQ ID NO: 12420 - DNA, 1813 bp, synthetic construct; identical to SEQ ID NO: 11487
  misc_feature 1..1813: note = Description of Artificial Sequence: Synthetic polynucleotide
  source 1..1813: mol_type = other DNA

SEQ ID NO: 12421 - DNA, 1872 bp, synthetic construct; identical to SEQ ID NO: 11488
  misc_feature 1..1872: note = Description of Artificial Sequence: Synthetic polynucleotide
  source 1..1872: mol_type = other DNA

SEQ ID NO: 12422 - DNA, 652 bp, synthetic construct; identical to SEQ ID NO: 11489
  misc_feature 1..652: note = Description of Artificial Sequence: Synthetic polynucleotide
  source 1..652: mol_type = other DNA

SEQ ID NO: 12423 - DNA, 722 bp, synthetic construct; identical to SEQ ID NO: 11490
  misc_feature 1..722: note = Description of Artificial Sequence: Synthetic polynucleotide
  source 1..722: mol_type = other DNA

SEQ ID NO: 12424 - DNA, 858 bp, synthetic construct; identical to SEQ ID NO: 11491
  misc_feature 1..858: note = Description of Artificial Sequence: Synthetic polynucleotide
  source 1..858: mol_type = other DNA

SEQ ID NO: 12425 - DNA, 598 bp, synthetic construct; identical to SEQ ID NO: 11492
  misc_feature 1..598: note = Description of Artificial Sequence: Synthetic polynucleotide
  source 1..598: mol_type = other DNA

SEQ ID NO: 12426 - DNA, 1281 bp, synthetic construct; identical to SEQ ID NO: 11493
  misc_feature 1..1281: note = Description of Artificial Sequence: Synthetic polynucleotide
  source 1..1281: mol_type = other DNA

SEQ ID NO: 12427 - DNA, 1788 bp, synthetic construct; identical to SEQ ID NO: 11494
  misc_feature 1..1788: note = Description of Artificial Sequence: Synthetic polynucleotide
  source 1..1788: mol_type = other DNA

SEQ ID NO: 12428 - DNA, 626 bp, synthetic construct; identical to SEQ ID NO: 11495
  misc_feature 1..626: note = Description of Artificial Sequence: Synthetic polynucleotide
  source 1..626: mol_type = other DNA

SEQ ID NO: 12429 - DNA, 1037 bp, synthetic construct; identical to SEQ ID NO: 11496
  misc_feature 1..1037: note = Description of Artificial Sequence: Synthetic polynucleotide
  source 1..1037: mol_type = other DNA

SEQ ID NO: 12430 - DNA, 977 bp, synthetic construct; identical to SEQ ID NO: 11497
  misc_feature 1..977: note = Description of Artificial Sequence: Synthetic polynucleotide
  source 1..977: mol_type = other DNA

SEQ ID NO: 12431 - DNA, 6206 bp, synthetic construct; identical to SEQ ID NO: 11498
  misc_feature 1..6206: note = Description of Artificial Sequence: Synthetic polynucleotide
  source 1..6206: mol_type = other DNA

SEQ ID NO: 12432 - DNA, 574 bp, synthetic construct; identical to SEQ ID NO: 11499
  misc_feature 1..574: note = Description of Artificial Sequence: Synthetic polynucleotide
  source 1..574: mol_type = other DNA

SEQ ID NO: 12433 - DNA, 3438 bp, synthetic construct; identical to SEQ ID NO: 11500
  misc_feature 1..3438: note = Description of Artificial Sequence: Synthetic polynucleotide
  source 1..3438: mol_type = other DNA

SEQ ID NO: 12434 - DNA, 4088 bp, synthetic construct; identical to SEQ ID NO: 11501
  misc_feature 1..4088: note = Description of Artificial Sequence: Synthetic polynucleotide
  source 1..4088: mol_type = other DNA

SEQ ID NO: 12435 - DNA, 522 bp, synthetic construct; identical to SEQ ID NO: 11502
  misc_feature 1..522: note = Description of Artificial Sequence: Synthetic polynucleotide
  source 1..522: mol_type = other DNA

SEQ ID NO: 12436 - DNA, 2260 bp, synthetic construct; identical to SEQ ID NO: 11503
  misc_feature 1..2260: note = Description of Artificial Sequence: Synthetic polynucleotide
  source 1..2260: mol_type = other DNA

SEQ ID NO: 12437 - DNA, 1502 bp, synthetic construct; identical to SEQ ID NO: 11504
  misc_feature 1..1502: note = Description of Artificial Sequence: Synthetic polynucleotide
  source 1..1502: mol_type = other DNA

SEQ ID NO: 12438 - DNA, 510 bp, synthetic construct; identical to SEQ ID NO: 11505
  misc_feature 1..510: note = Description of Artificial Sequence: Synthetic polynucleotide
  source 1..510: mol_type = other DNA

SEQ ID NO: 12439 - DNA, 940 bp, synthetic construct; identical to SEQ ID NO: 11506
  misc_feature 1..940: note = Description of Artificial Sequence: Synthetic polynucleotide
  source 1..940: mol_type = other DNA

SEQ ID NO: 12440 - DNA, 2718 bp, synthetic construct; identical to SEQ ID NO: 11507
  misc_feature 1..2718: note = Description of Artificial Sequence: Synthetic polynucleotide
  source 1..2718: mol_type = other DNA

SEQ ID NO: 12441 - DNA, 2661 bp, synthetic construct; identical to SEQ ID NO: 11508
  misc_feature 1..2661: note = Description of Artificial Sequence: Synthetic polynucleotide
  source 1..2661: mol_type = other DNA

SEQ ID NO: 12442 - DNA, 801 bp, synthetic construct; identical to SEQ ID NO: 11509
  misc_feature 1..801: note = Description of Artificial Sequence: Synthetic polynucleotide
  source 1..801: mol_type = other DNA

SEQ ID NO: 12443 - DNA, 311 bp, synthetic construct; identical to SEQ ID NO: 11510
  misc_feature 1..311: note = Description of Artificial Sequence: Synthetic polynucleotide
  source 1..311: mol_type = other DNA

SEQ ID NO: 12444 - DNA, 1048 bp, synthetic construct; identical to SEQ ID NO: 11511
  misc_feature 1..1048: note = Description of Artificial Sequence: Synthetic polynucleotide
  source 1..1048: mol_type = other DNA

SEQ ID NO: 12445 - DNA, 301 bp, synthetic construct; identical to SEQ ID NO: 11512
  misc_feature 1..301: note = Description of Artificial Sequence: Synthetic polynucleotide
  source 1..301: mol_type = other DNA

SEQ ID NO: 12446 - DNA, 1395 bp, synthetic construct; identical to SEQ ID NO: 11513
  misc_feature 1..1395: note = Description of Artificial Sequence: Synthetic polynucleotide
  source 1..1395: mol_type = other DNA

SEQ ID NO: 12447 - DNA, 766 bp, synthetic construct; identical to SEQ ID NO: 11514
  misc_feature 1..766: note = Description of Artificial Sequence: Synthetic polynucleotide
  source 1..766: mol_type = other DNA

SEQ ID NO: 12448 - DNA, 691 bp, synthetic construct; identical to SEQ ID NO: 11515
  misc_feature 1..691: note = Description of Artificial Sequence: Synthetic polynucleotide
  source 1..691: mol_type = other DNA

SEQ ID NO: 12449 - DNA, 1024 bp, synthetic construct; identical to SEQ ID NO: 11516
  misc_feature 1..1024: note = Description of Artificial Sequence: Synthetic polynucleotide
  source 1..1024: mol_type = other DNA

SEQ ID NO: 12450 - DNA, 1339 bp, synthetic construct; identical to SEQ ID NO: 11517
  misc_feature 1..1339: note = Description of Artificial Sequence: Synthetic polynucleotide
  source 1..1339: mol_type = other DNA

SEQ ID NO: 12451 - DNA, 1376 bp, synthetic construct; identical to SEQ ID NO: 11526
  misc_feature 1..1376: note = Description of Artificial Sequence: Synthetic polynucleotide
  source 1..1376: mol_type = other DNA

SEQ ID NO: 12452 - DNA, 3843 bp, synthetic construct; identical to SEQ ID NO: 11533
  misc_feature 1..3843: note = Description of Artificial Sequence: Synthetic polynucleotide
  source 1..3843: mol_type = other DNA

SEQ ID NO: 12453 - DNA, 1622 bp, synthetic construct; identical to SEQ ID NO: 11541
  misc_feature 1..1622: note = Description of Artificial Sequence: Synthetic polynucleotide
  source 1..1622: mol_type = other DNA

SEQ ID NO: 12454 - DNA, 1441 bp, synthetic construct; identical to SEQ ID NO: 11552
  misc_feature 1..1441: note = Description of Artificial Sequence: Synthetic polynucleotide
  source 1..1441: mol_type = other DNA

SEQ ID NO: 12455 - DNA, 383 bp, Homo sapiens; identical to SEQ ID NO: 8556
  source 1..383: mol_type = unassigned DNA

SEQ ID NO: 12456 - DNA, 116 bp, Homo sapiens; identical to SEQ ID NO: 8448
  source 1..116: mol_type = unassigned DNA

SEQ ID NO: 12457 - DNA, 264 bp, Homo sapiens; identical to SEQ ID NO: 8503
  source 1..264: mol_type = unassigned DNA

SEQ ID NO: 12458 - DNA, 521 bp, Homo sapiens; identical to SEQ ID NO: 8546
  source 1..521: mol_type = unassigned DNA

SEQ ID NO: 12459 - DNA, 109 bp, Homo sapiens; identical to SEQ ID NO: 8553
  source 1..109: mol_type = unassigned DNA

SEQ ID NO: 12460 - DNA, 1041 bp, Homo sapiens; identical to SEQ ID NO: 8562
  source 1..1041: mol_type = unassigned DNA

SEQ ID NO: 12461 - DNA, 383 bp, Homo sapiens; identical to SEQ ID NO: 8742
  source 1..383: mol_type = unassigned DNA

SEQ ID NO: 12462 - DNA, 116 bp, Homo sapiens; identical to SEQ ID NO: 8634
  source 1..116: mol_type = unassigned DNA

SEQ ID NO: 12463 - DNA, 264 bp, Homo sapiens; identical to SEQ ID NO: 8689
  source 1..264: mol_type = unassigned DNA

SEQ ID NO: 12464 - DNA, 521 bp, Homo sapiens; identical to SEQ ID NO: 8732
  source 1..521: mol_type = unassigned DNA

SEQ ID NO: 12465 - DNA, 109 bp, Homo sapiens; identical to SEQ ID NO: 8739
  source 1..109: mol_type = unassigned DNA

SEQ ID NO: 12466 - DNA, 1041 bp, Homo sapiens; identical to SEQ ID NO: 8748
  source 1..1041: mol_type = unassigned DNA

SEQ ID NO: 12467 - DNA, 383 bp, synthetic construct; identical to SEQ ID NO: 8928
  misc_feature 1..383: note = Description of Artificial Sequence: Synthetic polynucleotide
  source 1..383: mol_type = other DNA

SEQ ID NO: 12468 - DNA, 116 bp, synthetic construct; identical to SEQ ID NO: 8820
  misc_feature 1..116: note = Description of Artificial Sequence: Synthetic polynucleotide
  source 1..116: mol_type = other DNA

SEQ ID NO: 12469 - DNA, 264 bp, synthetic construct; identical to SEQ ID NO: 8875
  misc_feature 1..264: note = Description of Artificial Sequence: Synthetic polynucleotide
  source 1..264: mol_type = other DNA

SEQ ID NO: 12470 - DNA, 521 bp, synthetic construct; identical to SEQ ID NO: 8918
  misc_feature 1..521: note = Description of Artificial Sequence: Synthetic polynucleotide
  source 1..521: mol_type = other DNA

SEQ ID NO: 12471 - DNA, 109 bp, synthetic construct; identical to SEQ ID NO: 8925
  misc_feature 1..109: note = Description of Artificial Sequence: Synthetic polynucleotide
  source 1..109: mol_type = other DNA

SEQ ID NO: 12472 - DNA, 1041 bp, synthetic construct; identical to SEQ ID NO: 8934
  misc_feature 1..1041: note = Description of Artificial Sequence: Synthetic polynucleotide
  source 1..1041: mol_type = other DNA

SEQ ID NO: 12473 - DNA, 383 bp, synthetic construct; identical to SEQ ID NO: 9114
  misc_feature 1..383: note = Description of Artificial Sequence: Synthetic polynucleotide
  source 1..383: mol_type = other DNA

SEQ ID NO: 12474 - DNA, 116 bp, synthetic construct; identical to SEQ ID NO: 9006
  misc_feature 1..116: note = Description of Artificial Sequence: Synthetic polynucleotide
  source 1..116: mol_type = other DNA

SEQ ID NO: 12475 - DNA, 264 bp, synthetic construct; identical to SEQ ID NO: 9061
  misc_feature 1..264: note = Description of Artificial Sequence: Synthetic polynucleotide
  source 1..264: mol_type = other DNA

SEQ ID NO: 12476 - DNA, 521 bp, synthetic construct; identical to SEQ ID NO: 9104
  misc_feature 1..521: note = Description of Artificial Sequence: Synthetic polynucleotide
  source 1..521: mol_type = other DNA

SEQ ID NO: 12477 - DNA, 109 bp, synthetic construct; identical to SEQ ID NO: 9111
  misc_feature 1..109: note = Description of Artificial Sequence: Synthetic polynucleotide
  source 1..109: mol_type = other DNA

SEQ ID NO: 12478 - DNA, 1041 bp, synthetic construct; identical to SEQ ID NO: 9120
  misc_feature 1..1041: note = Description of Artificial Sequence: Synthetic polynucleotide
  source 1..1041: mol_type = other DNA

SEQ ID NO: 12479 - DNA, 383 bp, synthetic construct; identical to SEQ ID NO: 9300
  misc_feature 1..383: note = Description of Artificial Sequence: Synthetic polynucleotide
  source 1..383: mol_type = other DNA

SEQ ID NO: 12480 - DNA, 116 bp, synthetic construct; identical to SEQ ID NO: 9192
  misc_feature 1..116: note = Description of Artificial Sequence: Synthetic polynucleotide
  source 1..116: mol_type = other DNA

SEQ ID NO: 12481 - DNA, 264 bp, synthetic construct; identical to SEQ ID NO: 9247
  misc_feature 1..264: note = Description of Artificial Sequence: Synthetic polynucleotide
  source 1..264: mol_type = other DNA

SEQ ID NO: 12482 - DNA, 521 bp, synthetic construct; identical to SEQ ID NO: 9290
  misc_feature 1..521: note = Description of Artificial Sequence: Synthetic polynucleotide
  source 1..521: mol_type = other DNA

SEQ ID NO: 12483 - DNA, 109 bp, synthetic construct; identical to SEQ ID NO: 9297
  misc_feature 1..109: note = Description of Artificial Sequence: Synthetic polynucleotide
  source 1..109: mol_type = other DNA

SEQ ID NO: 12484 - DNA, 1041 bp, synthetic construct; identical to SEQ ID NO: 9306
  misc_feature 1..1041: note = Description of Artificial Sequence: Synthetic polynucleotide
  source 1..1041: mol_type = other DNA

SEQ ID NO: 12485 - DNA, 383 bp, synthetic construct; identical to SEQ ID NO: 9486
  misc_feature 1..383: note = Description of Artificial Sequence: Synthetic polynucleotide
  source 1..383: mol_type = other DNA

SEQ ID NO: 12486 - DNA, 116 bp, synthetic construct; identical to SEQ ID NO: 9378
  misc_feature 1..116: note = Description of Artificial Sequence: Synthetic polynucleotide
  source 1..116: mol_type = other DNA

SEQ ID NO: 12487 - DNA, 264 bp, synthetic construct; identical to SEQ ID NO: 9433
  misc_feature 1..264: note = Description of Artificial Sequence: Synthetic polynucleotide
  source 1..264: mol_type = other DNA

SEQ ID NO: 12488 - DNA, 521 bp, synthetic construct; identical to SEQ ID NO: 9476
  misc_feature 1..521: note = Description of Artificial Sequence: Synthetic polynucleotide
  source 1..521: mol_type = other DNA

SEQ ID NO: 12489 - DNA, 109 bp, synthetic construct; identical to SEQ ID NO: 9483
  misc_feature 1..109: note = Description of Artificial Sequence: Synthetic polynucleotide
  source 1..109: mol_type = other DNA

SEQ ID NO: 12490 - DNA, 1041 bp, synthetic construct; identical to SEQ ID NO: 9492
  misc_feature 1..1041: note = Description of Artificial Sequence: Synthetic polynucleotide
  source 1..1041: mol_type = other DNA

SEQ ID NO: 12491 - DNA, 582 bp, Homo sapiens; identical to SEQ ID NO: 9672
  source 1..582: mol_type = unassigned DNA

SEQ ID NO: 12492 - DNA, 315 bp, Homo sapiens; identical to SEQ ID NO: 9564
  source 1..315: mol_type = unassigned DNA

SEQ ID NO: 12493 - DNA, 463 bp, Homo sapiens; identical to SEQ ID NO: 9619
  source 1..463: mol_type = unassigned DNA

SEQ ID NO: 12494 - DNA, 720 bp, Homo sapiens; identical to SEQ ID NO: 9662
  source 1..720: mol_type = unassigned DNA

SEQ ID NO: 12495 - DNA, 308 bp, Homo sapiens; identical to SEQ ID NO: 9669
  source 1..308: mol_type = unassigned DNA

SEQ ID NO: 12496 - DNA, 1240 bp, Homo sapiens; identical to SEQ ID NO: 9678
  source 1..1240: mol_type = unassigned DNA

SEQ ID NO: 12497 - DNA, 582 bp, Homo sapiens; identical to SEQ ID NO: 9858
  source 1..582: mol_type = unassigned DNA

SEQ ID NO: 12498 - DNA, 315 bp, Homo sapiens; identical to SEQ ID NO: 9750
  source 1..315: mol_type = unassigned DNA

SEQ ID NO: 12499 - DNA, 463 bp, Homo sapiens; identical to SEQ ID NO: 9805
  source 1..463: mol_type = unassigned DNA

SEQ ID NO: 12500 - DNA, 720 bp, Homo sapiens; identical to SEQ ID NO: 9848
  source 1..720: mol_type = unassigned DNA

SEQ ID NO: 12501 - DNA, 308 bp, Homo sapiens; identical to SEQ ID NO: 9855
  source 1..308: mol_type = unassigned DNA

SEQ ID NO: 12502 - DNA, 1240 bp, Homo sapiens; identical to SEQ ID NO: 9864
  source 1..1240: mol_type = unassigned DNA

SEQ ID NO: 12503 - DNA, 582 bp, synthetic construct; identical to SEQ ID NO: 10044
  misc_feature 1..582: note = Description of Artificial Sequence: Synthetic polynucleotide
  source 1..582: mol_type = other DNA

SEQ ID NO: 12504 - DNA, 315 bp, synthetic construct; identical to SEQ ID NO: 9936
  misc_feature 1..315: note = Description of Artificial Sequence: Synthetic polynucleotide
  source 1..315: mol_type = other DNA

SEQ ID NO: 12505 - DNA, 463 bp, synthetic construct; identical to SEQ ID NO: 9991
  misc_feature 1..463: note = Description of Artificial Sequence: Synthetic polynucleotide
  source 1..463: mol_type = other DNA

SEQ ID NO: 12506 - DNA, 720 bp, synthetic construct; identical to SEQ ID NO: 10034
  misc_feature 1..720: note = Description of Artificial Sequence: Synthetic polynucleotide
  source 1..720: mol_type = other DNA

SEQ ID NO: 12507 - DNA, 308 bp, synthetic construct; identical to SEQ ID NO: 10041
  misc_feature 1..308: note = Description of Artificial Sequence: Synthetic polynucleotide
  source 1..308: mol_type = other DNA

SEQ ID NO: 12508 - DNA, 1240 bp, synthetic construct; identical to SEQ ID NO: 10050
  misc_feature 1..1240: note = Description of Artificial Sequence: Synthetic polynucleotide
  source 1..1240: mol_type = other DNA

SEQ ID NO: 12509 - DNA, 582 bp, synthetic construct; identical to SEQ ID NO: 10230
  misc_feature 1..582: note = Description of Artificial Sequence: Synthetic polynucleotide
  source 1..582: mol_type = other DNA

SEQ ID NO: 12510 - DNA, 315 bp, synthetic construct; identical to SEQ ID NO: 10122
  misc_feature 1..315: note = Description of Artificial Sequence: Synthetic polynucleotide
  source 1..315: mol_type = other DNA

SEQ ID NO: 12511 - DNA, 463 bp, synthetic construct; identical to SEQ ID NO: 10177
  misc_feature 1..463: note = Description of Artificial Sequence: Synthetic polynucleotide
  source 1..463: mol_type = other DNA

SEQ ID NO: 12512 - DNA, 720 bp, synthetic construct; identical to SEQ ID NO: 10220
  misc_feature 1..720: note = Description of Artificial Sequence: Synthetic polynucleotide
  source 1..720: mol_type = other DNA

SEQ ID NO: 12513 - DNA, 308 bp, synthetic construct; identical to SEQ ID NO: 10227
  misc_feature 1..308: note = Description of Artificial Sequence: Synthetic polynucleotide
  source 1..308: mol_type = other DNA

SEQ ID NO: 12514 - DNA, 1240 bp, synthetic construct; identical to SEQ ID NO: 10236
  misc_feature 1..1240: note = Description of Artificial Sequence: Synthetic polynucleotide
  source 1..1240: mol_type = other DNA

SEQ ID NO: 12515 - DNA, 582 bp, synthetic construct; identical to SEQ ID NO: 10416
  misc_feature 1..582: note = Description of Artificial Sequence: Synthetic polynucleotide
  source 1..582: mol_type = other DNA

SEQ ID NO: 12516 - DNA, 315 bp, synthetic construct; identical to SEQ ID NO: 10308
  misc_feature 1..315: note = Description of Artificial Sequence: Synthetic polynucleotide
  source 1..315: mol_type = other DNA

SEQ ID NO: 12517 - DNA, 463 bp, synthetic construct; identical to SEQ ID NO: 10363
  misc_feature 1..463: note = Description of Artificial Sequence: Synthetic polynucleotide
  source 1..463: mol_type = other DNA

SEQ ID NO: 12518 - DNA, 720 bp, synthetic construct; identical to SEQ ID NO: 10406
  misc_feature 1..720: note = Description of Artificial Sequence: Synthetic polynucleotide
  source 1..720: mol_type = other DNA

SEQ ID NO: 12519 - DNA, 308 bp, synthetic construct; identical to SEQ ID NO: 10413
  misc_feature 1..308: note = Description of Artificial Sequence: Synthetic polynucleotide
  source 1..308: mol_type = other DNA

SEQ ID NO: 12520 - DNA, 1240 bp, synthetic construct; identical to SEQ ID NO: 10422
  misc_feature 1..1240: note = Description of Artificial Sequence: Synthetic polynucleotide
  source 1..1240: mol_type = other DNA

SEQ ID NO: 12521 - DNA, 582 bp, synthetic construct; identical to SEQ ID NO: 10602
  misc_feature 1..582: note = Description of Artificial Sequence: Synthetic polynucleotide
  source 1..582: mol_type = other DNA

SEQ ID NO: 12522 - DNA, 315 bp, synthetic construct; identical to SEQ ID NO: 10494
  misc_feature 1..315: note = Description of Artificial Sequence: Synthetic polynucleotide
  source 1..315: mol_type = other DNA

SEQ ID NO: 12523 - DNA, 463 bp, synthetic construct; identical to SEQ ID NO: 10549
  misc_feature 1..463: note = Description of Artificial Sequence: Synthetic polynucleotide
  source 1..463: mol_type = other DNA

SEQ ID NO: 12524 - DNA, 720 bp, synthetic construct; identical to SEQ ID NO: 10592
  misc_feature 1..720: note = Description of Artificial Sequence: Synthetic polynucleotide
  source 1..720: mol_type = other DNA

SEQ ID NO: 12525 - DNA, 308 bp, synthetic construct; identical to SEQ ID NO: 10599
  misc_feature 1..308: note = Description of Artificial Sequence: Synthetic polynucleotide
  source 1..308: mol_type = other DNA

SEQ ID NO: 12526 - DNA, 1240 bp, synthetic construct; identical to SEQ ID NO: 10608
  misc_feature 1..1240: note = Description of Artificial Sequence: Synthetic polynucleotide
  source 1..1240: mol_type = other DNA

SEQ ID NO: 12527 - DNA, 1788 bp, Homo sapiens; identical to SEQ ID NO: 10759
  source 1..1788: mol_type = unassigned DNA

SEQ ID NO: 12528 - DNA, 1230 bp, Homo sapiens; identical to SEQ ID NO: 10680
  source 1..1230: mol_type = unassigned DNA

SEQ ID NO: 12529 - DNA, 1059 bp, Homo sapiens; identical to SEQ ID NO: 10717
  source 1..1059: mol_type = unassigned DNA

SEQ ID NO: 12530 - DNA, 1819 bp, Homo sapiens; identical to SEQ ID NO: 10751
  source 1..1819: mol_type = unassigned DNA

SEQ ID NO: 12531 - DNA, 598 bp, Homo sapiens; identical to SEQ ID NO: 10757
  source 1..598: mol_type = unassigned DNA

SEQ ID NO: 12532 - DNA, 3438 bp, Homo sapiens; identical to SEQ ID NO: 10765
  source 1..3438: mol_type = unassigned DNA

SEQ ID NO: 12533 - DNA, 1788 bp, Homo sapiens; identical to SEQ ID NO: 10906
  source 1..1788: mol_type = unassigned DNA

SEQ ID NO: 12534 - DNA, 1230 bp, Homo sapiens; identical to SEQ ID NO: 10827
  source 1..1230: mol_type = unassigned DNA

SEQ ID NO: 12535 - DNA, 1059 bp, Homo sapiens; identical to SEQ ID NO: 10864
  source 1..1059: mol_type = unassigned DNA

SEQ ID NO: 12536 - DNA, 1819 bp, Homo sapiens; identical to SEQ ID NO: 10898
  source 1..1819: mol_type = unassigned DNA

SEQ ID NO: 12537 - DNA, 598 bp, Homo sapiens; identical to SEQ ID NO: 10904
  source 1..598: mol_type = unassigned DNA

SEQ ID NO: 12538 - DNA, 3438 bp, Homo sapiens; identical to SEQ ID NO: 10912
  source 1..3438: mol_type = unassigned DNA

SEQ ID NO: 12539 - DNA, 1788 bp, synthetic construct; identical to SEQ ID NO: 11053
  misc_feature 1..1788: note = Description of Artificial Sequence: Synthetic polynucleotide
  source 1..1788: mol_type = other DNA

SEQ ID NO: 12540 - DNA, 1230 bp, synthetic construct; identical to SEQ ID NO: 10974
  misc_feature 1..1230: note = Description of Artificial Sequence: Synthetic polynucleotide
  source 1..1230: mol_type = other DNA

SEQ ID NO: 12541 - DNA, 1059 bp, synthetic construct; identical to SEQ ID NO: 11011
  misc_feature 1..1059: note = Description of Artificial Sequence: Synthetic polynucleotide
  source 1..1059: mol_type = other DNA

SEQ ID NO: 12542 - DNA, 1819 bp, synthetic construct; identical to SEQ ID NO: 11045
  misc_feature 1..1819: note = Description of Artificial Sequence: Synthetic polynucleotide
  source 1..1819: mol_type = other DNA

SEQ ID NO: 12543 - DNA, 598 bp, synthetic construct; identical to SEQ ID NO: 11051
  misc_feature 1..598: note = Description of Artificial Sequence: Synthetic polynucleotide
  source 1..598: mol_type = other DNA

SEQ ID NO: 12544 - DNA, 3438 bp, synthetic construct; identical to SEQ ID NO: 11059
  misc_feature 1..3438: note = Description of Artificial Sequence: Synthetic polynucleotide
  source 1..3438: mol_type = other DNA

SEQ ID NO: 12545 - DNA, 1788 bp, synthetic construct; identical to SEQ ID NO: 11200
  misc_feature 1..1788: note = Description of Artificial Sequence: Synthetic polynucleotide
  source 1..1788: mol_type = other DNA

SEQ ID NO: 12546 - DNA, 1230 bp, synthetic construct; identical to SEQ ID NO: 11121
  misc_feature 1..1230: note = Description of Artificial Sequence: Synthetic polynucleotide
  source 1..1230: mol_type = other DNA

SEQ ID NO: 12547 - DNA, 1059 bp, synthetic construct; identical to SEQ ID NO: 11158
  misc_feature 1..1059: note = Description of Artificial Sequence: Synthetic polynucleotide
  source 1..1059: mol_type = other DNA

SEQ ID NO: 12548 - DNA, 1819 bp, synthetic construct; identical to SEQ ID NO: 11192
  misc_feature 1..1819: note = Description of Artificial Sequence: Synthetic polynucleotide
  source 1..1819: mol_type = other DNA

SEQ ID NO: 12549 - DNA, 598 bp, synthetic construct; identical to SEQ ID NO: 11198
  misc_feature 1..598: note = Description of Artificial Sequence: Synthetic polynucleotide
  source 1..598: mol_type = other DNA

SEQ ID NO: 12550 - DNA, 3438 bp, synthetic construct; identical to SEQ ID NO: 11206
  misc_feature 1..3438: note = Description of Artificial Sequence: Synthetic polynucleotide
  source 1..3438: mol_type = other DNA

SEQ ID NO: 12551 - DNA, 1788 bp, synthetic construct; identical to SEQ ID NO: 11347
  misc_feature 1..1788: note = Description of Artificial Sequence: Synthetic polynucleotide
  source 1..1788: mol_type = other DNA

SEQ ID NO: 12552 - DNA, 1230 bp, synthetic construct; identical to SEQ ID NO: 11268
  misc_feature 1..1230: note = Description of Artificial Sequence: Synthetic polynucleotide
  source 1..1230: mol_type = other DNA

SEQ ID NO: 12553 - DNA, 1059 bp, synthetic construct; identical to SEQ ID NO: 11305
  misc_feature 1..1059: note = Description of Artificial Sequence: Synthetic polynucleotide
  source 1..1059: mol_type = other DNA

SEQ ID NO: 12554 - DNA, 1819 bp, synthetic construct; identical to SEQ ID NO: 11339
  misc_feature 1..1819: note = Description of Artificial Sequence: Synthetic polynucleotide
  source 1..1819: mol_type = other DNA

SEQ ID NO: 12555 - DNA, 598 bp, synthetic construct; identical to SEQ ID NO: 11345
  misc_feature 1..598: note = Description of Artificial Sequence: Synthetic polynucleotide
  source 1..598: mol_type = other DNA

SEQ ID NO: 12556 - DNA, 3438 bp, synthetic construct; identical to SEQ ID NO: 11353
  misc_feature 1..3438: note = Description of Artificial Sequence: Synthetic polynucleotide
  source 1..3438: mol_type = other DNA

SEQ ID NO: 12557 - DNA, 1788 bp, synthetic construct; identical to SEQ ID NO: 11494
  misc_feature 1..1788: note = Description of Artificial Sequence: Synthetic polynucleotide
  source 1..1788: mol_type = other DNA

SEQ ID NO: 12558 - DNA, 1230 bp, synthetic construct; identical to SEQ ID NO: 11415
  misc_feature 1..1230: note = Description of Artificial Sequence: Synthetic polynucleotide
  source 1..1230: mol_type = other DNA

SEQ ID NO: 12559 - DNA, 1059 bp, synthetic construct; identical to SEQ ID NO: 11452
  misc_feature 1..1059: note = Description of Artificial Sequence: Synthetic polynucleotide
  source 1..1059: mol_type = other DNA

SEQ ID NO: 12560 - DNA, 1819 bp, synthetic construct; identical to SEQ ID NO: 11486
  misc_feature 1..1819: note = Description of Artificial Sequence: Synthetic polynucleotide
  source 1..1819: mol_type = other DNA

SEQ ID NO: 12561 - DNA, 598 bp, synthetic construct; identical to SEQ ID NO: 11492
  misc_feature 1..598: note = Description of Artificial Sequence: Synthetic polynucleotide
  source 1..598: mol_type = other DNA

SEQ ID NO: 12562 - DNA, 3438 bp, synthetic construct; identical to SEQ ID NO: 11500
  misc_feature 1..3438: note = Description of Artificial Sequence: Synthetic polynucleotide
  source 1..3438: mol_type = other DNA

SEQ ID NO: 12563 - DNA, 782 bp, Homo sapiens
  source 1..782: mol_type = unassigned DNA
gcgcttccgagccacgcagaggcgccccctcccgccggagacgggaaagccccggcgcccccagactgggctccgtttccagctcccggaggggctggggctctcccgcgtgcgccccgcacctgccgggggcccgtacccgccctcgccggggctccagggggcacgacggccgtggcccggcgctcttgggaggggagcgggacatccccgaaggcggcgcgctggaggcggggagcggccggggcgcacggagagggcggggagcccgcgggagggggaggagggggaggagggggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaacgtaagtggggaccggggaggcgagggtggaggtggccgcggcaggggctgcacggg

SEQ ID NO: 12564 - DNA, 615 bp, Homo sapiens
  source 1..615: mol_type = unassigned DNA
ccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgc

SEQ ID NO: 12565 - DNA, 763 bp, Homo sapiens
  source 1..763: mol_type = unassigned DNA
gggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgg

SEQ ID NO: 12566 - DNA, 1020 bp, Homo sapiens
  source 1..1020: mol_type = unassigned DNA
ttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcat

SEQ ID NO: 12567 - DNA, 608 bp, Homo sapiens
  source 1..608: mol_type = unassigned DNA
gcgggtcccaccctctctcctgccaggggtagaccctgggaccactcagctcgctctcgcaggccctgagcgtctgacgcctgcgcactgagcgcgggcgggcgggcactcccagaaacctccggggcgctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaaggtaggagtgtccgggatgccggagcggacacgcgcggagaaagcgtcgctggggttactcgtgtggccgtgtctccggttttgtgtgcaggctacagcctgcctggtattggcgactgcctgtgcatacacgactggacgtgtgtg

SEQ ID NO: 12568 - DNA, 1539 bp, Homo sapiens
  source 1..1539: mol_type = unassigned DNA
tctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcagctgactggcggcccgagcggccccggagcggcggaggcctggcggagcgctggagcggagtgggacggccagcctgggcccacccccgtaccctgcaggtcccggcccacgcacgctcgcctggagtgcgcgccccacctctaggccaaatcaccgctttcccctcctcgcgcactctcctccctcagttccctttgcaccccacccccatcccgtgtcacccccaaggaggctcagaatgagcgccgggacaacgcctcctgggccctttgttcccaagcggcccccgcccagtgggcgacgctctgtgtgtcctcgcggcttctggccgtgtgtgtcgtgcgttcctgtttctggagatctgcgcgtatttgtatgttggggagggcgggctcgaggctccgagagttgtgttcagacccaactcttaacctcaggggacctttctcaggccaagcgagggcccctcctggcgggtgcagtcgcagagccctgaggttcgactccactggccccgccgctccccgcgttcaccccaccgcacaatgttcacagtgaaggcgacgggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgcgaccccaagtggccactgtgcgcaaaggcgccgcgaccgcccggcccacggccggaaggcttggacggcgcctcgtacccagccaggtctcccctacctggcccaacccaagccagcccagaacgcatactatgtgtgcaccagagcccaggacaggttcccctcgagcgatgtacaggtc

SEQ ID NO: 12569 - DNA, 782 bp, synthetic construct
  misc_feature 1..782: note = Description of Artificial Sequence: Synthetic polynucleotide
  source 1..782: mol_type = other DNA
gygttttygagttaygtagaggygttttttttygtyggagaygggaaagtttyggygtttttagattgggtttygtttttagttttyggaggggttggggttttttygygtgygtttygtatttgtygggggttygtattygttttygtyggggttttagggggtaygayggtygtggttyggygtttttgggaggggagygggatattttygaaggyggygygttggaggyggggagyggtyggggygtayggagagggyggggagttygygggagggggaggagggggaggagggggaggaggygygaggtgggggggagygyggygggyggtagggagggagygggagggaggtaagaaagtagtagaaagtgaggttggtaggyggyggtaaaggagtyggygygyggyggyggtaggaagtttgtgttygagaatagtagaaataagagttagggagggatygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaagattttygagtttaaagagattttyggaaygtaagtggggatyggggaggygagggtggaggtggtygyggtaggggttgtayggg

SEQ ID NO: 12570 - DNA, 615 bp, synthetic construct
  misc_feature 1..615: note = Description of Artificial Sequence: Synthetic polynucleotide
  source 1..615: mol_type = other DNA
tygtgattttttttattttttygattttttaggttttttatagtgattttttatygtgttttattttatgaatygttagagttattygtttttaaattttaaattttgygtaatgtttttttatagatttttttaggtattaygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygattygyggttygttyggttggtattttttagtygtygttagtttygtygaggggagttagygtygtttttgaggggygttyggygtyggagttatgatttttygtygatttaggaagttgtagtagaaggaggaggyggyggttatttyggatttygtygttyggattttygattyggaagtygygttygtygtttyggtttygatttygggattttttgtygtagtygt

SEQ ID NO: 12571 - DNA, 763 bp, synthetic construct
  misc_feature 1..763: note = Description of Artificial Sequence: Synthetic polynucleotide
  source 1..763: mol_type = other DNA
gggaaygagatattgttgagttggaagatttygygggttataggtatagtttttttgttgttggyggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatygttttygtgttttttttygggttgatgttyggttgttatagygtgaygttggtayggttgyggggygttygttggggtttygggyggtayggggygygggtgggtyggttggtgagygttatygtgtttgttttyggtttgttttgggttttttattaygtagttaattttttgtaggyggtygtagygttggttttatyggaaggggttttggygaagttgg

SEQ ID NO: 12572 - DNA, 1020 bp, synthetic construct
  misc_feature 1..1020: note = Description of Artificial Sequence: Synthetic polynucleotide
  source 1..1020: mol_type = other DNA
ttggggtagttttttttttgtttatttattgtttagtttttttttttatattttttttyggaaaygtttgtttttgataaggtttattttttgtttttaggaggtttttattgtggaggaagggaggygtygttygtttttggtttttttgatagtygtgttttattttygttttgtgttttttttttyggatagtgttttttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttttgtagaaggattttgygttyggggaaggggaggaatttttttttttttgggygttygtttttttygttatggttyggtttttatattygtttatatttggtygtagyggggygttyggggggaggggttgaggtygygtttttygtygttttttgggygygggttaggyggggaggaggggggygtttyggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagygygggygyggygttttagttagygygtagggttygggtttygtygggggygttttttygtygttgtttttygygygattygttgtttattagttattat

SEQ ID NO: 12573 - DNA, 608 bp, synthetic construct
  misc_feature 1..608: note = Description of Artificial Sequence: Synthetic polynucleotide
  source 1..608: mol_type = other DNA
gygggttttatttttttttttgttaggggtagattttgggattatttagttygttttygtaggttttgagygtttgaygtttgygtattgagygygggygggygggtatttttagaaattttyggggygttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatttgttgggttggygaattygaaattgggtttggaattygggagttagattttggattttgaattgtatttttgttaaggtaggagtgttygggatgtyggagyggataygygyggagaaagygtygttggggttattygtgtggtygtgttttyggttttgtgtgtaggttatagtttgtttggtattggygattgtttgtgtatataygattggaygtgtgtg

SEQ ID NO: 12574 - DNA, 1539 bp, synthetic construct
  misc_feature 1..1539: note = Description of Artificial Sequence: Synthetic polynucleotide
  source 1..1539: mol_type = other DNA
tttggttttatgtttagtttygyggttatygttgaagygaggygtagtygtygttgtygttygggaaattttgyggtyggtyggagygygtygagttaagygygggggggaagagyggagaagagttggggaggyggggagygagggygtagygggtyggggtygtyggttaagtttttgtttggggaygyggyggygygtyggagagtttygaggttgtttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggggttygggyggttyggtgygygggttaatagttgtayggttttygyggtttagyggygtagggyggggygygtttgatagttttttygtttttygygttagttgattggyggttygagyggtttyggagyggyggaggtttggyggagygttggagyggagtgggayggttagtttgggtttattttygtattttgtaggtttyggtttaygtaygttygtttggagtgygygttttatttttaggttaaattatygttttttttttttygygtattttttttttttagttttttttgtattttatttttatttygtgttatttttaaggaggtttagaatgagygtygggataaygttttttgggttttttgtttttaagyggttttygtttagtgggygaygttttgtgtgttttygyggtttttggtygtgtgtgtygtgygtttttgtttttggagatttgygygtatttgtatgttggggagggygggttygaggtttygagagttgtgtttagatttaatttttaattttaggggattttttttaggttaagygagggttttttttggygggtgtagtygtagagttttgaggttygattttattggtttygtygtttttygygtttattttatygtataatgtttatagtgaaggygaygggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgygattttaagtggttattgtgygtaaaggygtygygatygttyggtttayggtyggaaggtttggayggygtttygtatttagttaggttttttttatttggtttaatttaagttagtttagaaygtatattatgtgtgtattagagtttaggataggtttttttygagygatgtataggtt

SEQ ID NO: 12575 - DNA, 782 bp, synthetic construct
  misc_feature 1..782: note = Description of Artificial Sequence: Synthetic polynucleotide
  source 1..782: mol_type = other DNA
gcgttttcgagttacgtagaggcgttttttttcgtcggagacgggaaagtttcggcgtttttagattgggtttcgtttttagttttcggaggggttggggttttttcgcgtgcgtttcgtatttgtcgggggttcgtattcgttttcgtcggggttttagggggtacgacggtcgtggttcggcgtttttgggaggggagcgggatattttcgaaggcggcgcgttggaggcggggagcggtcggggcgtacggagagggcggggagttcgcgggagggggaggagggggaggagggggaggaggcgcgaggtgggggggagcgcggcgggcggtagggagggagcgggagggaggtaagaaagtagtagaaagtgaggttggtaggcggcggtaaaggagtcggcgcgcggcggcggtaggaagtttgtgttcgagaatagtagaaataagagttagggagggatcgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaagattttcgagtttaaagagattttcggaacgtaagtggggatcggggaggcgagggtggaggtggtcgcggtaggggttgtacggg

SEQ ID NO: 12576 - DNA, 615 bp, synthetic construct
  misc_feature 1..615: note = Description of Artificial Sequence: Synthetic polynucleotide
  source 1..615: mol_type = other DNA
tcgtgattttttttattttttcgattttttaggttttttatagtgattttttatcgtgttttattttatgaatcgttagagttattcgtttttaaattttaaattttgcgtaatgtttttttatagatttttttaggtattacgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgattcgcggttcgttcggttggtattttttagtcgtcgttagtttcgtcgaggggagttagcgtcgtttttgaggggcgttcggcgtcggagttatgatttttcgtcgatttaggaagttgtagtagaaggaggaggcggcggttatttcggatttcgtcgttcggattttcgattcggaagtcgcgttcgtcgtttcggtttcgatttcgggattttttgtcgtagtcgt

SEQ ID NO: 12577 - DNA, 763 bp, synthetic construct
  misc_feature 1..763: note = Description of Artificial Sequence: Synthetic polynucleotide
  source 1..763: mol_type = other DNA
gggaacgagatattgttgagttggaagatttcgcgggttataggtatagtttttttgttgttggcggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatcgttttcgtgttttttttcgggttgatgttcggttgttatagcgtgacgttggtacggttgcggggcgttcgttggggtttcgggcggtacggggcgcgggtgggtcggttggtgagcgttatcgtgtttgttttcggtttgttttgggttttttattacgtagttaattttttgtaggcggtcgtagcgttggttttatcggaaggggttttggcgaagttgg

SEQ ID NO: 12578 - DNA, 1020 bp, synthetic construct
  misc_feature 1..1020: note = Description of Artificial Sequence: Synthetic polynucleotide
  source 1..1020: mol_type = other DNA
ttggggtagttttttttttgtttatttattgtttagtttttttttttatattttttttcggaaacgtttgtttttgataaggtttattttttgtttttaggaggtttttattgtggaggaagggaggcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattat

SEQ ID NO: 12579 - DNA, 608 bp, synthetic construct
  misc_feature 1..608: note = Description of Artificial Sequence: Synthetic polynucleotide
  source 1..608: mol_type = other DNA
gcgggttttatttttttttttgttaggggtagattttgggattatttagttcgttttcgtaggttttgagcgtttgacgtttgcgtattgagcgcgggcgggcgggtatttttagaaattttcggggcgttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatttgttgggttggcgaattcgaaattgggtttggaattcgggagttagattttggattttgaattgtatttttgttaaggtaggagtgttcgggatgtcggagcggatacgcgcggagaaagcgtcgttggggttattcgtgtggtcgtgttttcggttttgtgtgtaggttatagtttgtttggtattggcgattgtttgtgtatatacgattggacgtgtgtg

SEQ ID NO: 12580 - DNA, 1539 bp, synthetic construct
  misc_feature 1..1539: note = Description of Artificial Sequence: Synthetic polynucleotide
  source 1..1539: mol_type = other DNA
tttggttttatgtttagtttcgcggttatcgttgaagcgaggcgtagtcgtcgttgtcgttcgggaaattttgcggtcggtcggagcgcgtcgagttaagcgcgggggggaagagcggagaagagttggggaggcggggagcgagggcgtagcgggtcggggtcgtcggttaagtttttgtttggggacgcggcggcgcgtcggagagtttcgaggttgtttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggggttcgggcggttcggtgcgcgggttaatagttgtacggttttcgcggtttagcggcgtagggcggggcgcgtttgatagttttttcgtttttcgcgttagttgattggcggttcgagcggtttcggagcggcggaggtttggcggagcgttggagcggagtgggacggttagtttgggtttattttcgtattttgtaggtttcggtttacgtacgttcgtttggagtgcgcgttttatttttaggttaaattatcgttttttttttttcgcgtattttttttttttagttttttttgtattttatttttatttcgtgttatttttaaggaggtttagaatgagcgtcgggataacgttttttgggttttttgtttttaagcggttttcgtttagtgggcgacgttttgtgtgttttcgcggtttttggtcgtgtgtgtcgtgcgtttttgtttttggagatttgcgcgtatttgtatgttggggagggcgggttcgaggtttcgagagttgtgtttagatttaatttttaattttaggggattttttttaggttaagcgagggttttttttggcgggtgtagtcgtagagttttgaggttcgattttattggtttcgtcgtttttcgcgtttattttatcgtataatgtttatagtgaaggcgacgggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgcgattttaagtggttattgtgcgtaaaggcgtcgcgatcgttcggtttacggtcggaaggtttggacggcgtttcgtatttagttaggttttttttatttggtttaatttaagttagtttagaacgtatattatgtgtgtattagagtttaggataggtttttttcgagcgatgtataggtt

SEQ ID NO: 12581 - DNA, 782 bp, Homo sapiens
  source 1..782: mol_type = unassigned DNA
cccgtgcagcccctgccgcggccacctccaccctcgcctccccggtccccacttacgttccgagggtctctttgaactcgaagatcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgttctcgggcacagacttcctgccgccgccgcgcgccggctcctttgccgccgcctgccagcctcactttctgctactttcttgcctccctcccgctccctccctgccgcccgccgcgctcccccccacctcgcgcctcctccccctcctccccctcctccccctcccgcgggctccccgccctctccgtgcgccccggccgctccccgcctccagcgcgccgccttcggggatgtcccgctcccctcccaagagcgccgggccacggccgtcgtgccccctggagccccggcgagggcgggtacgggcccccggcaggtgcggggcgcacgcgggagagccccagcccctccgggagctggaaacggagcccagtctgggggcgccggggctttcccgtctccggcgggagggggcgcctctgcgtggctcggaagcgc

SEQ ID NO: 12582 - DNA, 615 bp, Homo sapiens
  source 1..615: mol_type = unassigned DNA
gcggctgcggcagggggtcccggggtcgggaccggagcggcgggcgcgacttccgagtcgggagtccgggcggcggggtccggggtggccgccgcctcctccttctgctgcagcttcctgagtcggcggagggtcatggctccggcgccggacgcccctcagagacggcgctggctcccctcggcggggctggcggcggctgggggatgccagccgggcgggccgcgggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgtgatacctggaggggtctgtgaagggacattgcgcaaggtttgaaatttagggacgaatagctctggcgattcatggagtggggcacggtaagaggtcactgtaagaagcctggggagtcggggaggtagggagagtcacgg

SEQ ID NO: 12583 - DNA, 763 bp, Homo sapiens
  source 1..763: mol_type = unassigned DNA
ccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccc

SEQ ID NO: 12584 - DNA, 1020 bp, Homo sapiens
  source 1..1020: mol_type = unassigned DNA
atgatggctggtgggcagcgggtcgcgcggagggcagcggcgaggaagcgcccccggcggggcccgggccctgcgcgctggctggggcgccgcgcccgcgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggagaaggcactgtccgggagaaggggcacagggcggggatggaacacggctgtcagagaagccagggacgggcgacgcctcccttcctccacaataagggcctcctgagagcaggaagtagaccttgtcaggagcagacgtttccgaaggaaggtgtgaaggaaggagctaggcagtgagtgagcagaaagggagctgccccaa

SEQ ID NO: 12585 - DNA, 608 bp, Homo sapiens
  source 1..608: mol_type = unassigned DNA
cacacacgtccagtcgtgtatgcacaggcagtcgccaataccaggcaggctgtagcctgcacacaaaaccggagacacggccacacgagtaaccccagcgacgctttctccgcgcgtgtccgctccggcatcccggacactcctaccttgacagaggtgcagttcagggtccaagatctggctcccgggttccaagcccaatttcgggttcgccagcccagcaggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagcgccccggaggtttctgggagtgcccgcccgcccgcgctcagtgcgcaggcgtcagacgctcagggcctgcgagagcgagctgagtggtcccagggtctacccctggcaggagagagggtgggacccgc

SEQ ID NO: 12586 - DNA, 1539 bp, Homo sapiens
  source 1..1539: mol_type = unassigned DNA
gacctgtacatcgctcgaggggaacctgtcctgggctctggtgcacacatagtatgcgttctgggctggcttgggttgggccaggtaggggagacctggctgggtacgaggcgccgtccaagccttccggccgtgggccgggcggtcgcggcgcctttgcgcacagtggccacttggggtcgcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttcccgtcgccttcactgtgaacattgtgcggtggggtgaacgcggggagcggcggggccagtggagtcgaacctcagggctctgcgactgcacccgccaggaggggccctcgcttggcctgagaaaggtcccctgaggttaagagttgggtctgaacacaactctcggagcctcgagcccgccctccccaacatacaaatacgcgcagatctccagaaacaggaacgcacgacacacacggccagaagccgcgaggacacacagagcgtcgcccactgggcgggggccgcttgggaacaaagggcccaggaggcgttgtcccggcgctcattctgagcctccttgggggtgacacgggatgggggtggggtgcaaagggaactgagggaggagagtgcgcgaggaggggaaagcggtgatttggcctagaggtggggcgcgcactccaggcgagcgtgcgtgggccgggacctgcagggtacgggggtgggcccaggctggccgtcccactccgctccagcgctccgccaggcctccgccgctccggggccgctcgggccgccagtcagctgacgcggggggcgggggagctgtcaggcgcgccccgccctgcgccgctgggccgcggaggccgtgcagctattggcccgcgcaccgggccgcccgggcccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccaga

SEQ ID NO: 12587 - DNA, 782 bp, synthetic construct
  misc_feature 1..782: note = Description of Artificial Sequence: Synthetic polynucleotide
  source 1..782: mol_type = other DNA
ttygtgtagtttttgtygyggttatttttattttygttttttyggtttttatttaygtttygagggtttttttgaattygaagatttttttgatgtttttagtttgttttttttaggaggagttgttttygtygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgttttygggtatagattttttgtygtygtygygygtyggtttttttgtygtygtttgttagttttattttttgttatttttttgtttttttttygttttttttttgtygttygtygygtttttttttatttygygttttttttttttttttttttttttttttttttygygggtttttygtttttttygtgygtttyggtygtttttygtttttagygygtygttttyggggatgtttygttttttttttaagagygtygggttayggtygtygtgttttttggagtttyggygagggygggtaygggttttyggtaggtgyggggygtaygygggagagttttagttttttygggagttggaaayggagtttagtttgggggygtyggggttttttygttttyggygggagggggygtttttgygtggttyggaagygt

SEQ ID NO: 12588 - DNA, 615 bp, synthetic construct
  misc_feature 1..615: note = Description of Artificial Sequence: Synthetic polynucleotide
  source 1..615: mol_type = other DNA
gyggttgyggtagggggtttyggggtygggatyggagyggygggygygattttygagtygggagttygggyggyggggttyggggtggtygtygttttttttttttgttgtagttttttgagtyggyggagggttatggtttyggygtyggaygttttttagagayggygttggtttttttyggyggggttggyggyggttgggggatgttagtygggygggtygygggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygtgatatttggaggggtttgtgaagggatattgygtaaggtttgaaatttagggaygaatagttttggygatttatggagtggggtayggtaagaggttattgtaagaagtttggggagtyggggaggtagggagagttaygg

SEQ ID NO: 12589 - DNA, 763 bp, synthetic construct
  misc_feature 1..763: note = Description of Artificial Sequence: Synthetic polynucleotide
  source 1..763: mol_type = other DNA
ttagtttygttaaggtttttttyggtggagttagygttgygatygtttgtagaaggttgattgygtggtagggggtttagagtaagtygaaggtaagtaygatggygtttattagtyggtttattygygtttygtgtygttyggagttttagygggygtttygtagtygtgttagygttaygttgtagtagtygagtattagttygaaaggaagtaygaaagyggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygtygttagtagtaggaaggttgtgtttgtggttygygaagttttttagtttagtagtgtttygttttt

SEQ ID NO: 12590 - DNA, 1020 bp, synthetic construct
  misc_feature 1..1020: note = Description of Artificial Sequence: Synthetic polynucleotide
  source 1..1020: mol_type = other DNA
atgatggttggtgggtagygggtygygyggagggtagyggygaggaagygttttyggyggggttygggttttgygygttggttggggygtygygttygygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatyggagygtttttttttttttygtttggttygygtttaggggayggygagagaygyggttttagttttttttttygggygtttygttgyggttagatgtgggyggatgtggaggtygggttatggygaggagggygggygtttagaggggaagagattttttttttttttygggygtagggtttttttgtaggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggagaaggtattgttygggagaaggggtatagggyggggatggaatayggttgttagagaagttagggaygggygaygtttttttttttttataataagggttttttgagagtaggaagtagattttgttaggagtagaygttttygaaggaaggtgtgaaggaaggagttaggtagtgagtgagtagaaagggagttgttttaa

SEQ ID NO: 12591 - DNA, 608 bp, synthetic construct
  misc_feature 1..608: note = Description of Artificial Sequence: Synthetic polynucleotide
  source 1..608: mol_type = other DNA
tatataygtttagtygtgtatgtataggtagtygttaatattaggtaggttgtagtttgtatataaaatyggagatayggttataygagtaattttagygaygtttttttygygygtgttygtttyggtatttyggatatttttattttgatagaggtgtagtttagggtttaagatttggttttygggttttaagtttaatttygggttygttagtttagtaggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagygtttyggaggtttttgggagtgttygttygttygygtttagtgygtaggygttagaygtttagggtttgygagagygagttgagtggttttagggtttatttttggtaggagagagggtgggattygt

SEQ ID NO: 12592 - DNA, 1539 bp, synthetic construct
  misc_feature 1..1539: note = Description of Artificial Sequence: Synthetic polynucleotide
  source 1..1539: mol_type = other DNA
gatttgtatatygttygaggggaatttgttttgggttttggtgtatatatagtatgygttttgggttggtttgggttgggttaggtaggggagatttggttgggtaygaggygtygtttaagtttttyggtygtgggtygggyggtygyggygtttttgygtatagtggttatttggggtygtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttygtygtttttattgtgaatattgtgyggtggggtgaaygyggggagyggyggggttagtggagtygaattttagggttttgygattgtattygttaggaggggttttygtttggtttgagaaaggttttttgaggttaagagttgggtttgaatataattttyggagtttygagttygttttttttaatatataaataygygtagatttttagaaataggaaygtaygatatatayggttagaagtygygaggatatatagagygtygtttattgggygggggtygtttgggaataaagggtttaggaggygttgtttyggygtttattttgagtttttttgggggtgataygggatgggggtggggtgtaaagggaattgagggaggagagtgygygaggaggggaaagyggtgatttggtttagaggtggggygygtattttaggygagygtgygtgggtygggatttgtagggtaygggggtgggtttaggttggtygttttatttygttttagygtttygttaggttttygtygtttyggggtygttygggtygttagttagttgaygyggggggygggggagttgttaggygygtttygttttgygtygttgggtygyggaggtygtgtagttattggttygygtatygggtygttygggttttygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtaggtagtttygggatttttyggygygtygtygygtttttagataaaggtttggtyggyggtttyggttygttgygttttygtttttygtttttttagttttttttygtttttttttttygygtttggttyggygygtttyggtyggtygtaaagtttttygggyggtagyggyggttgygtttygttttagygatggtygyggagttgagtatggggttaga

SEQ ID NO: 12593 - DNA, 782 bp, synthetic construct
  misc_feature 1..782: note = Description of Artificial Sequence: Synthetic polynucleotide
  source 1..782: mol_type = other DNA
ttcgtgtagtttttgtcgcggttatttttattttcgttttttcggtttttatttacgtttcgagggtttttttgaattcgaagatttttttgatgtttttagtttgttttttttaggaggagttgttttcgtcgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgttttcgggtatagattttttgtcgtcgtcgcgcgtcggtttttttgtcgtcgtttgttagttttattttttgttatttttttgtttttttttcgttttttttttgtcgttcgtcgcgtttttttttatttcgcgttttttttttttttttttttttttttttttttcgcgggtttttcgtttttttcgtgcgtttcggtcgtttttcgtttttagcgcgtcgttttcggggatgtttcgttttttttttaagagcgtcgggttacggtcgtcgtgttttttggagtttcggcgagggcgggtacgggttttcggtaggtgcggggcgtacgcgggagagttttagttttttcgggagttggaaacggagtttagtttgggggcgtcggggttttttcgttttcggcgggagggggcgtttttgcgtggttcggaagcgt

SEQ ID NO: 12594 - DNA, 615 bp, synthetic construct
  misc_feature 1..615: note = Description of Artificial Sequence: Synthetic polynucleotide
  source 1..615: mol_type = other DNA
gcggttgcggtagggggtttcggggtcgggatcggagcggcgggcgcgattttcgagtcgggagttcgggcggcggggttcggggtggtcgtcgttttttttttttgttgtagttttttgagtcggcggagggttatggtttcggcgtcggacgttttttagagacggcgttggtttttttcggcggggttggcggcggttgggggatgttagtcgggcgggtcgcgggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgtgatatttggaggggtttgtgaagggatattgcgtaaggtttgaaatttagggacgaatagttttggcgatttatggagtggggtacggtaagaggttattgtaagaagtttggggagtcggggaggtagggagagttacgg

SEQ ID NO: 12595 - DNA, 763 bp, synthetic construct
  misc_feature 1..763: note = Description of Artificial Sequence: Synthetic polynucleotide
  source 1..763: mol_type = other DNA
ttagtttcgttaaggtttttttcggtggagttagcgttgcgatcgtttgtagaaggttgattgcgtggtagggggtttagagtaagtcgaaggtaagtacgatggcgtttattagtcggtttattcgcgtttcgtgtcgttcggagttttagcgggcgtttcgtagtcgtgttagcgttacgttgtagtagtcgagtattagttcgaaaggaagtacgaaagcggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgtcgttagtagtaggaaggttgtgtttgtggttcgcgaagttttttagtttagtagtgtttcgttttt

SEQ ID NO: 12596 - DNA, 1020 bp, synthetic construct
  misc_feature 1..1020: note = Description of Artificial Sequence: Synthetic polynucleotide
  source 1..1020: mol_type = other DNA
atgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgtttttttttttttataataagggttttttgagagtaggaagtagattttgttaggagtagacgttttcgaaggaaggtgtgaaggaaggagttaggtagtgagtgagtagaaagggagttgttttaa

SEQ ID NO: 12597 - DNA, 608 bp, synthetic construct
  misc_feature 1..608: note = Description of Artificial Sequence: Synthetic polynucleotide
  source 1..608: mol_type = other DNA
tatatacgtttagtcgtgtatgtataggtagtcgttaatattaggtaggttgtagtttgtatataaaatcggagatacggttatacgagtaattttagcgacgtttttttcgcgcgtgttcgtttcggtatttcggatatttttattttgatagaggtgtagtttagggtttaagatttggttttcgggttttaagtttaatttcgggttcgttagtttagtaggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagcgtttcggaggtttttgggagtgttcgttcgttcgcgtttagtgcgtaggcgttagacgtttagggtttgcgagagcgagttgagtggttttagggtttatttttggtaggagagagggtgggattcgt

SEQ ID NO: 12598 - DNA, 1539 bp, synthetic construct
  misc_feature 1..1539: note = Description of Artificial Sequence: Synthetic polynucleotide
  source 1..1539: mol_type = other DNA
gatttgtatatcgttcgaggggaatttgttttgggttttggtgtatatatagtatgcgttttgggttggtttgggttgggttaggtaggggagatttggttgggtacgaggcgtcgtttaagtttttcggtcgtgggtcgggcggtcgcggcgtttttgcgtatagtggttatttggggtcgtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttcgtcgtttttattgtgaatattgtgcggtggggtgaacgcggggagcggcggggttagtggagtcgaattttagggttttgcgattgtattcgttaggaggggttttcgtttggtttgagaaaggttttttgaggttaagagttgggtttgaatataattttcggagtttcgagttcgttttttttaatatataaatacgcgtagatttttagaaataggaacgtacgatatatacggttagaagtcgcgaggatatatagagcgtcgtttattgggcgggggtcgtttgggaataaagggtttaggaggcgttgtttcggcgtttattttgagtttttttgggggtgatacgggatgggggtggggtgtaaagggaattgagggaggagagtgcgcgaggaggggaaagcggtgatttggtttagaggtggggcgcgtattttaggcgagcgtgcgtgggtcgggatttgtagggtacgggggtgggtttaggttggtcgttttatttcgttttagcgtttcgttaggttttcgtcgtttcggggtcgttcgggtcgttagttagttgacgcggggggcgggggagttgttaggcgcgtttcgttttgcgtcgttgggtcgcggaggtcgtgtagttattggttcgcgtatcgggtcgttcgggttttcgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtaggtagtttcgggatttttcggcgcgtcgtcgcgtttttagataaaggtttggtcggcggtttcggttcgttgcgttttcgtttttcgtttttttagttttttttcgtttttttttttcgcgtttggttcggcgcgtttcggtcggtcgtaaagtttttcgggcggtagcggcggttgcgtttcgttttagcgatggtcgcggagttgagtatggggttaga

SEQ ID NO: 12599 - DNA, 262 bp, Homo sapiens
  source 1..262: mol_type = unassigned DNA
gaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaaga

SEQ ID NO: 12600 - DNA, 288 bp, Homo sapiens
  source 1..288: mol_type = unassigned DNA
aaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacc

SEQ ID NO: 12601 - DNA, 235 bp, Homo sapiens
  source 1..235: mol_type = unassigned DNA
gctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgacc

SEQ ID NO: 12602 - DNA, 273 bp, Homo sapiens
  source 1..273: mol_type = unassigned DNA
ctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcc

SEQ ID NO: 12603 - DNA, 257 bp, Homo sapiens
  source 1..257: mol_type = unassigned DNA
gctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacc

SEQ ID NO: 12604 - DNA, 254 bp, Homo sapiens
  source 1..254: mol_type = unassigned DNA
cctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggg

SEQ ID NO: 12605 - DNA, 262 bp, synthetic construct
  misc_feature 1..262: note = Description of Artificial Sequence: Synthetic polynucleotide
  source 1..262: mol_type = other DNA
gaacagcagaaataagagccagggagggacygyggtygyggyggyggyggygagagygaaagaggaaattgtagaggaggaagttgygtygtagttygagtygttyggtattttygtygtttttgygttygygtygygttttyggygttttttttttagygygttttyggtygttttttygygtygygttygtyggttatggttygggagaayggygagagtagttttttttggaaaaagtaagttgaagatattaagaaga

SEQ ID NO: 12606 - DNA, 288 bp, synthetic construct
  misc_feature 1..288: note = Description of Artificial Sequence: Synthetic polynucleotide
  source 1..288: mol_type = other DNA
aaattttgygtaatgtttttttatagatttttttaggtattaygtagtttygagtttygagtttygtttygggggttttatttygttttttygygttygyggttygtttttttttattgagygtttagttttygtagttttttyggtygtygagygtygtgggyggggttttagggyggyggygtttygyggggagggtttttygtgttgggggygaggttattygaggtagtttttygttygtttttaatttygtttygttttyggagtttataaagggaggygatt

SEQ ID NO: 12607 - DNA, 235 bp, synthetic construct
  misc_feature 1..235: note = Description of Artificial Sequence: Synthetic polynucleotide
  source 1..235: mol_type = other DNA
gtttatyggtttgtttagtttgtagygttgtttygtagttattygtttttttttggygtttyggttgygtagttyggttttggttygtygtttgttgttggyggtttggttggtygttttgttgttygtygtttyggtygtygtttatygttatttgtggagggatygygtatgttagttgtgttattygtygtyggtttaygtygtygtttatttgagtttggagattttgatt

SEQ ID NO: 12608 - DNA, 273 bp, synthetic construct
  misc_feature 1..273: note = Description of Artificial Sequence: Synthetic polynucleotide
  source 1..273: mol_type = other DNA
ttttagggtttatttaggagggtgtagyggtggttttyggggyggtggtygtggtgggggtgttagttgtaggggtgttttyggtgggtgggagttggtggtttttygttggtgttatgggattygtatgttygttttgygtttttyggtttttgagtttataggtygggattttgtttgttagtygygtgygttgtygtttaatttttgtaggygtagagygygyggyggyggtgatagagaattttgtttggttgtttaaatatagttttt

SEQ ID NO: 12609 - DNA, 257 bp, synthetic construct
  misc_feature 1..257: note = Description of Artificial Sequence: Synthetic polynucleotide
  source 1..257: mol_type = other DNA
gttgtaggygggataagtaggttttataggtygagtttaygagtttttygaggggtgagyggttygggttttttggygttttggtyggttagttaagygttggattatattttttagaggtayggygttyggagygttggattatattttttagaggtatygttttyggagygtagttttattttygttagtttgygagatttggaggtttygygtggggagagggtygygtttgtggaggagtttggtttygtatt

SEQ ID NO: 12610 - DNA, 254 bp, synthetic construct
  misc_feature 1..254: note = Description of Artificial Sequence: Synthetic polynucleotide
  source 1..254: mol_type = other DNA
tttgtatygttttagagttttgggttgtgttygygtagggatygggtygggtagagtygggyggggtggagaggtaagyggagygygyggtggggttgaggggaggygtggggygagtgttygttgttygttttttagtttttttgtttttaygttttttygttygtagtygttygtagttyggyggtgtagttgtgttggattyggyggygtygtagttttttatygttttttgatgttattggggtgygggg

SEQ ID NO: 12611 - DNA, 262 bp, synthetic construct
  misc_feature 1..262: note = Description of Artificial Sequence: Synthetic polynucleotide
  source 1..262: mol_type = other DNA
gaacagcagaaataagagccagggagggaccgcggtcgcggcggcggcggcgagagcgaaagaggaaattgtagaggaggaagttgcgtcgtagttcgagtcgttcggtattttcgtcgtttttgcgttcgcgtcgcgttttcggcgttttttttttagcgcgttttcggtcgttttttcgcgtcgcgttcgtcggttatggttcgggagaacggcgagagtagttttttttggaaaaagtaagttgaagatattaagaaga

SEQ ID NO: 12612 - DNA, 288 bp, synthetic construct
  misc_feature 1..288: note = Description of Artificial Sequence: Synthetic polynucleotide
  source 1..288: mol_type = other DNA
aaattttgcgtaatgtttttttatagatttttttaggtattacgtagtttcgagtttcgagtttcgtttcgggggttttatttcgttttttcgcgttcgcggttcgtttttttttattgagcgtttagttttcgtagttttttcggtcgtcgagcgtcgtgggcggggttttagggcggcggcgtttcgcggggagggtttttcgtgttgggggcgaggttattcgaggtagtttttcgttcgtttttaatttcgtttcgttttcggagtttataaagggaggcgatt

SEQ ID NO: 12613 - DNA, 235 bp, synthetic construct
  misc_feature 1..235: note = Description of Artificial Sequence: Synthetic polynucleotide
  source 1..235: mol_type = other DNA
gtttatcggtttgtttagtttgtagcgttgtttcgtagttattcgtttttttttggcgtttcggttgcgtagttcggttttggttcgtcgtttgttgttggcggtttggttggtcgttttgttgttcgtcgtttcggtcgtcgtttatcgttatttgtggagggatcgcgtatgttagttgtgttattcgtcgtcggtttacgtcgtcgtttatttgagtttggagattttgatt

SEQ ID NO: 12614 - DNA, 273 bp, synthetic construct
  misc_feature 1..273: note = Description of Artificial Sequence: Synthetic polynucleotide
  source 1..273: mol_type = other DNA
ttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttt

SEQ ID NO: 12615 - DNA, 257 bp, synthetic construct
  misc_feature 1..257: note = Description of Artificial Sequence: Synthetic polynucleotide
  source 1..257: mol_type = other DNA
gttgtaggcgggataagtaggttttataggtcgagtttacgagtttttcgaggggtgagcggttcgggttttttggcgttttggtcggttagttaagcgttggattatattttttagaggtacggcgttcggagcgttggattatattttttagaggtatcgttttcggagcgtagttttattttcgttagtttgcgagatttggaggtttcgcgtggggagagggtcgcgtttgtggaggagtttggtttcgtatt

SEQ ID NO: 12616 - DNA, 254 bp, synthetic construct
  misc_feature 1..254: note = Description of Artificial Sequence: Synthetic polynucleotide
  source 1..254: mol_type = other DNA
tttgtatcgttttagagttttgggttgtgttcgcgtagggatcgggtcgggtagagtcgggcggggtggagaggtaagcggagcgcgcggtggggttgaggggaggcgtggggcgagtgttcgttgttcgttttttagtttttttgtttttacgttttttcgttcgtagtcgttcgtagttcggcggtgtagttgtgttggattcggcggcgtcgtagttttttatcgttttttgatgttattggggtgcgggg

SEQ ID NO: 12617 - DNA, 261 bp, Homo sapiens
  source 1..261: mol_type = unassigned DNA
tcttcttgatgtcttcagcttgctttttccaggaggagctgctctcgccgttctcccgggccatggccgacgagcgcggcgcggaggagcggccgggggcgcgctggggagggggcgccgggggcgcggcgcgggcgcagaggcggcggggatgccgggcggctcgggctgcggcgcagcttcctcctctgcagtttcctctttcgctctcgccgccgccgccgcggccgcggtccctccctggctcttatttctgctgtt

SEQ ID NO: 12618 - DNA, 287 bp, Homo sapiens
  source 1..287: mol_type = unassigned DNA
ggtcgcctccctttataggctccgagagcggggcggggttgggggcgggcggggagctgcctcgggtggcctcgcccccagcacggaggaccctccccgcgaggcgccgccgccctggagccccgcccacggcgctcgacggccggggaaactgcgggagctgggcgctcagtgggggaaaacgagccgcggacgcgaaggggcgggatgaggcccccggggcggggctcggggctcggggctgcgtgatacctggaggggtctgtgaagggacattgcgcaaggtt

SEQ ID NO: 12619 - DNA, 235 bp, Homo sapiens
  source 1..235: mol_type = unassigned DNA
ggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagc

SEQ ID NO: 12620 - DNA, 273 bp, Homo sapiens
  source 1..273: mol_type = unassigned DNA
ggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccaccgccccgggggccaccgctgcaccctcctgggtgagccctggag

SEQ ID NO: 12621 - DNA, 257 bp, Homo sapiens
  source 1..257: mol_type = unassigned DNA
ggtgcggagccaagctcctccacagacgcggccctctccccacgcgaggcctccaaatctcgcaaactaacggaaatgaagctacgctccgggagcggtgcctctgggaaatgtagtccagcgctccggacgccgtgcctctgggaaatgtagtccagcgcttggctagccggccagaacgccaggaggcccgggccgctcacccctcgaggggctcgtgggctcggcctgtggaacctgcttgtcccgcctgcagc

SEQ ID NO: 12622 - DNA, 254 bp, Homo sapiens
  source 1..254: mol_type = unassigned DNA
ccccgcaccccagtgacatcaggaggcgataaaaggctgcggcgccgccggatccagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcagg

SEQ ID NO: 12623 - DNA, 261 bp, synthetic construct
  misc_feature 1..261: note = Description of Artificial Sequence: Synthetic polynucleotide
  source 1..261: mol_type = other DNA
tcttcttgatgtcttcagcttgctttttccaggaggagctgctctygcygttttttygggttatggtygaygagygyggygyggaggagyggtygggggygygttggggagggggygtygggggygyggygygggygtagaggyggyggggatgtygggyggttygggttgyggygtagtttttttttttgtagttttttttttygttttygtygtygtygtygyggtygyggtttttttttggtttttatttttgttgtt

SEQ ID NO: 12624 - DNA, 287 bp, synthetic construct
  misc_feature 1..287: note = Description of Artificial Sequence: Synthetic polynucleotide
  source 1..287: mol_type = other DNA
ggtygtttttttttataggtttygagagyggggyggggttgggggygggyggggagttgtttygggtggtttygtttttagtayggaggatttttttygygaggygtygtygttttggagtttygtttayggygttygayggtyggggaaattgygggagttgggygtttagtgggggaaaaygagtygyggaygygaaggggygggatgaggttttyggggyggggttyggggttyggggttgygtgatatttggaggggtttgtgaagggatattgygtaaggtt

SEQ ID NO: 12625 - DNA, 235 bp, synthetic construct
  misc_feature 1..235: note = Description of Artificial Sequence: Synthetic polynucleotide
  source 1..235: mol_type = other DNA
ggttagagtttttaggtttaggtgggyggyggygtggatyggygaygggtggtatagttggtataygyggtttttttataggtggyggtagayggyggtygggayggygagtaatagggyggttagttagatygttagtagtaggyggygggttagggtygggttgygtagtygaggygttaggaaggggygggtgattgygaggtagygttgtaggttgagtaggtyggtgagt

SEQ ID NO: 12626 - DNA, 273 bp, synthetic construct
  misc_feature 1..273: note = Description of Artificial Sequence: Synthetic polynucleotide
  source 1..273: mol_type = other DNA
ggaggttgtatttgggtagttaaataaagttttttgttatygtygtygygygttttgygtttgtaagggttaaayggtagygtaygyggttggtaggtaggatttyggtttgtgggtttaagagtygaggggygtagggygaatatgygagttttatggtattagygagaggttattaatttttatttatygagggtatttttgtagttaatatttttattaygattatygtttygggggttatygttgtatttttttgggtgagttttggag

SEQ ID NO: 12627 - DNA, 257 bp, synthetic construct
  misc_feature 1..257: note = Description of Artificial Sequence: Synthetic polynucleotide
  source 1..257: mol_type = other DNA
ggtgyggagttaagtttttttatagaygyggttttttttttaygygaggtttttaaatttygtaaattaayggaaatgaagttaygtttygggagyggtgtttttgggaaatgtagtttagygtttyggaygtygtgtttttgggaaatgtagtttagygtttggttagtyggttagaaygttaggaggttygggtygtttatttttygaggggttygtgggttyggtttgtggaatttgtttgtttygtttgtagt

SEQ ID NO: 12628 - DNA, 254 bp, synthetic construct
  misc_feature 1..254: note = Description of Artificial Sequence: Synthetic polynucleotide
  source 1..254: mol_type = other DNA
cccygtattttagtgatattaggaggygataaaaggttgyggygtygtyggatttagtatagttgtatygtygagttgygagyggttgygagygagagagygtaagagtaagagagttagagagygagtaaygggtattygttttaygtttttttttagttttatygygygtttygtttgtttttttatttygttygattttattyggttyggtttttgygygggtatagtttagagttttggggyggtgtagg

SEQ ID NO: 12629 - DNA, 261 bp, synthetic construct
  misc_feature 1..261: note = Description of Artificial Sequence: Synthetic polynucleotide
  source 1..261: mol_type = other DNA
tcttcttgatgtcttcagcttgctttttccaggaggagctgctctcgccgttttttcgggttatggtcgacgagcgcggcgcggaggagcggtcgggggcgcgttggggagggggcgtcgggggcgcggcgcgggcgtagaggcggcggggatgtcgggcggttcgggttgcggcgtagtttttttttttgtagttttttttttcgttttcgtcgtcgtcgtcgcggtcgcggtttttttttggtttttatttttgttgtt

SEQ ID NO: 12630 - DNA, 287 bp, synthetic construct
  misc_feature 1..287: note = Description of Artificial Sequence: Synthetic polynucleotide
  source 1..287: mol_type = other DNA
ggtcgtttttttttataggtttcgagagcggggcggggttgggggcgggcggggagttgtttcgggtggtttcgtttttagtacggaggatttttttcgcgaggcgtcgtcgttttggagtttcgtttacggcgttcgacggtcggggaaattgcgggagttgggcgtttagtgggggaaaacgagtcgcggacgcgaaggggcgggatgaggttttcggggcggggttcggggttcggggttgcgtgatatttggaggggtttgtgaagggatattgcgtaaggtt

SEQ ID NO: 12631 - DNA, 235 bp, synthetic construct
  misc_feature 1..235: note = Description of Artificial Sequence: Synthetic polynucleotide
  source 1..235: mol_type = other DNA
ggttagagtttttaggtttaggtgggcggcggcgtggatcggcgacgggtggtatagttggtatacgcggtttttttataggtggcggtagacggcggtcgggacggcgagtaatagggcggttagttagatcgttagtagtaggcggcgggttagggtcgggttgcgtagtcgaggcgttaggaaggggcgggtgattgcgaggtagcgttgtaggttgagtaggtcggtgagt

SEQ ID NO: 12632 - DNA, 273 bp, synthetic construct
  misc_feature 1..273: note = Description of Artificial Sequence: Synthetic polynucleotide
  source 1..273: mol_type = other DNA
ggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggag

SEQ ID NO: 12633 - DNA, 257 bp, synthetic construct
  misc_feature 1..257: note = Description of Artificial Sequence: Synthetic polynucleotide
  source 1..257: mol_type = other DNA
ggtgcggagttaagtttttttatagacgcggttttttttttacgcgaggtttttaaatttcgtaaattaacggaaatgaagttacgtttcgggagcggtgtttttgggaaatgtagtttagcgtttcggacgtcgtgtttttgggaaatgtagtttagcgtttggttagtcggttagaacgttaggaggttcgggtcgtttatttttcgaggggttcgtgggttcggtttgtggaatttgtttgtttcgtttgtagt

SEQ ID NO: 12634 - DNA, 254 bp, synthetic construct
  misc_feature 1..254: note = Description of Artificial Sequence: Synthetic polynucleotide
  source 1..254: mol_type = other DNA
ccccgtattttagtgatattaggaggcgataaaaggttgcggcgtcgtcggatttagtatagttgtatcgtcgagttgcgagcggttgcgagcgagagagcgtaagagtaagagagttagagagcgagtaacgggtattcgttttacgtttttttttagttttatcgcgcgtttcgtttgtttttttatttcgttcgattttattcggttcggtttttgcgcgggtatagtttagagttttggggcggtgtagg

SEQ ID NO: 12635 - DNA, 30 bp, synthetic construct
  misc_feature 1..30: note = Description of Artificial Sequence: Synthetic primer
  source 1..30: mol_type = other DNA
gaatagtagaaataagagttagggagggat

SEQ ID NO: 12636 - DNA, 37 bp, synthetic construct
  misc_feature 1..37: note = Description of Artificial Sequence: Synthetic primer
  source 1..37: mol_type = other DNA
aaattttgygtaatgtttttttatagatttttttagg

SEQ ID NO: 12637 - DNA, 25 bp, synthetic construct
  misc_feature 1..25: note = Description of Artificial Sequence: Synthetic primer
  source 1..25: mol_type = other DNA
gtttatyggtttgtttagtttgtag

SEQ ID NO: 12638 - DNA, 25 bp, synthetic construct
  misc_feature 1..25: note = Description of Artificial Sequence: Synthetic primer
  source 1..25: mol_type = other DNA
ttttagggtttatttaggagggtgt

SEQ ID NO: 12639 - DNA, 29 bp, synthetic construct
  misc_feature 1..29: note = Description of Artificial Sequence: Synthetic primer
  source 1..29: mol_type = other DNA
gttgtaggygggataagtaggttttatag

SEQ ID NO: 12640 - DNA, 30 bp, synthetic construct
  misc_feature 1..30: note = Description of Artificial Sequence: Synthetic primer
  source 1..30: mol_type = other DNA
tttgtatygttttagagttttgggttgtgt

SEQ ID NO: 12641 - DNA, 35 bp, synthetic construct
  misc_feature 1..35: note = Description of Artificial Sequence: Synthetic primer
  source 1..35: mol_type = other DNA
tcttcttaatatcttcaacttactttttccaaaaa

SEQ ID NO: 12642 - DNA, 23 bp, synthetic construct
  misc_feature 1..23: note = Description of Artificial Sequence: Synthetic primer
  source 1..23: mol_type = other DNA
aatcrcctccctttataaactcc

SEQ ID NO: 12643 - DNA, 26 bp, synthetic construct
  misc_feature 1..26: note = Description of Artificial Sequence: Synthetic primer
  source 1..26: mol_type = other DNA
aatcaaaatctccaaactcaaataaa

SEQ ID NO: 12644 - DNA, 33 bp, synthetic construct
  misc_feature 1..33: note = Description of Artificial Sequence: Synthetic primer
  source 1..33: mol_type = other DNA
aaaaactatatttaaacaaccaaacaaaattct

SEQ ID NO: 12645 - DNA, 26 bp, synthetic construct
  misc_feature 1..26: note = Description of Artificial Sequence: Synthetic primer
  source 1..26: mol_type = other DNA
aatacraaaccaaactcctccacaaa

SEQ ID NO: 12646 - DNA, 24 bp, synthetic construct
  misc_feature 1..24: note = Description of Artificial Sequence: Synthetic primer
  source 1..24: mol_type = other DNA
cccrcaccccaataacatcaaaaa

SEQ ID NO: 12647 - DNA, 273 bp, Homo sapiens
  source 1..273: mol_type = unassigned DNA
ggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcct

SEQ ID NO: 12648 - DNA, 259 bp, Homo sapiens
  source 1..259: mol_type = unassigned DNA
ggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcg

SEQ ID NO: 12649 - DNA, 220 bp, Homo sapiens
  source 1..220: mol_type = unassigned DNA
gggaaaagcagcagcccaaaggctctgaattcctcttccccgccacacgcacggaatcctgagcccccggagcctcggggccgaggccggcccgggacggtgctccgagtagctctccactgctggggagccggccctgtttttgtttgaacgttttgtaacgattaagcagatcccggcgtcagcccgccgcggagaggctcaaacaggcataaagtgc

SEQ ID NO: 12650 - DNA, 273 bp, synthetic construct
  misc_feature 1..273: note = Description of Artificial Sequence: Synthetic polynucleotide
  source 1..273: mol_type = other DNA
ggygttgttggggttgtttggtaayggtttygtggtgtggagtttggygggttggyggtttgtaygggggygatygttggyggttaygtttgtgttgtatttggygttggtygayggygyggtgttgttgtttaygtygttttttgtggtttttttgattyggtaggtttggtygttgggttaggygggttgtaaggyggtgtattaygtgtgygygtttagtatgtaygttagygtgttgtttatyggtttgtttagtttgtagygttgttt

SEQ ID NO: 12651 - DNA, 259 bp, synthetic construct
  misc_feature 1..259: note = Description of Artificial Sequence: Synthetic polynucleotide
  source 1..259: mol_type = other DNA
ggtygtgtgtttaggattgttttttagyggttattygggttttagttttttaggtttggttttgataggygggyggagtagttagtgygagatagggaggtyggtgygggtgygggaatttgattygttygggaggygggggyggggygggggygtagygygyggggaggggtyggygttygttttttttttttatttatttagttgagttagggggtttaggggttttttyggyggttagttttgtattgtaggagyg

SEQ ID NO: 12652 - DNA, 220 bp, synthetic construct
  misc_feature 1..220: note = Description of Artificial Sequence: Synthetic polynucleotide
  source 1..220: mol_type = other DNA
gggaaaagtagtagtttaaaggttttgaatttttttttttygttataygtayggaattttgagttttyggagtttyggggtygaggtyggttygggayggtgtttygagtagttttttattgttggggagtyggttttgtttttgtttgaaygttttgtaaygattaagtagatttyggygttagttygtygyggagaggtttaaataggtataaagtgy

SEQ ID NO: 12653 - DNA, 273 bp, synthetic construct
  misc_feature 1..273: note = Description of Artificial Sequence: Synthetic polynucleotide
  source 1..273: mol_type = other DNA
ggcgttgttggggttgtttggtaacggtttcgtggtgtggagtttggcgggttggcggtttgtacgggggcgatcgttggcggttacgtttgtgttgtatttggcgttggtcgacggcgcggtgttgttgtttacgtcgttttttgtggtttttttgattcggtaggtttggtcgttgggttaggcgggttgtaaggcggtgtattacgtgtgcgcgtttagtatgtacgttagcgtgttgtttatcggtttgtttagtttgtagcgttgttt

SEQ ID NO: 12654 - DNA, 259 bp, synthetic construct
  misc_feature 1..259: note = Description of Artificial Sequence: Synthetic polynucleotide
  source 1..259: mol_type = other DNA
ggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcg

SEQ ID NO: 12655 - DNA, 220 bp, synthetic construct
  misc_feature 1..220: note = Description of Artificial Sequence: Synthetic polynucleotide
  source 1..220: mol_type = other DNA
gggaaaagtagtagtttaaaggttttgaatttttttttttcgttatacgtacggaattttgagttttcggagtttcggggtcgaggtcggttcgggacggtgtttcgagtagttttttattgttggggagtcggttttgtttttgtttgaacgttttgtaacgattaagtagatttcggcgttagttcgtcgcggagaggtttaaataggtataaagtgy

SEQ ID NO: 12656 - DNA, 272 bp, Homo sapiens
  source 1..272: mol_type = unassigned DNA
aggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgc

SEQ ID NO: 12657 - DNA, 259 bp, Homo sapiens
  source 1..259: mol_type = unassigned DNA
cgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgacc

SEQ ID NO: 12658 - DNA, 220 bp, Homo sapiens
  source 1..220: mol_type = unassigned DNA
gcactttatgcctgtttgagcctctccgcggcgggctgacgccgggatctgcttaatcgttacaaaacgttcaaacaaaaacagggccggctccccagcagtggagagctactcggagcaccgtcccgggccggcctcggccccgaggctccgggggctcaggattccgtgcgtgtggcggggaagaggaattcagagcctttgggctgctgcttttccc

SEQ ID NO: 12659 - DNA, 272 bp, synthetic construct
  misc_feature 1..272: note = Description of Artificial Sequence: Synthetic polynucleotide
  source 1..272: mol_type = other DNA
aggtagygttgtaggttgagtaggtyggtgagtagtaygttggygtatatgttgagygygtataygtagtatatygttttgtagttygtttggtttagyggttaggtttgtygggttaggaaggttataaagagyggygtgagtagtagtatygygtygtyggttagygttaggtgtagtataagygtggtygttagyggtygttttygtgtaggtygttagttygttaagttttatattaygaagtygttgttaggtagttttagtagygt

SEQ ID NO: 12660 - DNA, 259 bp, synthetic construct
  misc_feature 1..259: note = Description of Artificial Sequence: Synthetic polynucleotide
  source 1..259: mol_type = other DNA
ygtttttgtagtgtagagttagtygtyggaggagtttttaggttttttggtttagttgaatgaatgggggaggaaggygggygtyggttttttttygygygttgygttttygtttygttttygtttttygggyggattaggttttygtattygtatyggtttttttgtttygtattggttgtttygttygtttgttaaggttaggtttggggggttggggttygagtggtygttgggggatagttttgggtataygatt

SEQ ID NO: 12661 - DNA, 220 bp, synthetic construct
  misc_feature 1..220: note = Description of Artificial Sequence: Synthetic polynucleotide
  source 1..220: mol_type = other DNA
gtattttatgtttgtttgagttttttygyggygggttgaygtygggatttgtttaatygttataaaaygtttaaataaaaatagggtyggttttttagtagtggagagttattyggagtatygtttygggtyggtttyggtttygaggtttygggggtttaggatttygtgygtgtggyggggaagaggaatttagagtttttgggttgttgtttttttt

SEQ ID NO: 12662 - DNA, 272 bp, synthetic construct
  misc_feature 1..272: note = Description of Artificial Sequence: Synthetic polynucleotide
  source 1..272: mol_type = other DNA
aggtagcgttgtaggttgagtaggtcggtgagtagtacgttggcgtatatgttgagcgcgtatacgtagtatatcgttttgtagttcgtttggtttagcggttaggtttgtcgggttaggaaggttataaagagcggcgtgagtagtagtatcgcgtcgtcggttagcgttaggtgtagtataagcgtggtcgttagcggtcgttttcgtgtaggtcgttagttcgttaagttttatattacgaagtcgttgttaggtagttttagtagcgt

SEQ ID NO: 12663 - DNA, 259 bp, synthetic construct
  misc_feature 1..259: note = Description of Artificial Sequence: Synthetic polynucleotide
  source 1..259: mol_type = other DNA
cgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatt

SEQ ID NO: 12664 - DNA, 220 bp, synthetic construct
  misc_feature 1..220: note = Description of Artificial Sequence: Synthetic polynucleotide
  source 1..220: mol_type = other DNA
gtattttatgtttgtttgagttttttcgcggcgggttgacgtcgggatttgtttaatcgttataaaacgtttaaataaaaatagggtcggttttttagtagtggagagttattcggagtatcgtttcgggtcggtttcggtttcgaggtttcgggggtttaggatttcgtgcgtgtggcggggaagaggaatttagagtttttgggttgttgtttttttt

SEQ ID NO: 12665 - DNA, 24 bp, synthetic construct
  misc_feature 1..24: note = Description of Artificial Sequence: Synthetic primer
  source 1..24: mol_type = other DNA
ggygttgttggggttgtttggtaa

SEQ ID NO: 12666 - DNA, 24 bp, synthetic construct
  misc_feature 1..24: note = Description of Artificial Sequence: Synthetic primer
  source 1..24: mol_type = other DNA
ggtygtgtgtttaggattgttttt

SEQ ID NO: 12667 - DNA, 26 bp, synthetic construct
  misc_feature 1..26: note = Description of Artificial Sequence: Synthetic primer
  source 1..26: mol_type = other DNA
gggaaaagtagtagtttaaaggtttt

SEQ ID NO: 12668 - DNA, 25 bp, synthetic construct
  misc_feature 1..25: note = Description of Artificial Sequence: Synthetic primer
  source 1..25: mol_type = other DNA
aaacaacrctacaaactaaacaaac

SEQ ID NO: 12669 - DNA, 24 bp, synthetic construct
  misc_feature 1..24: note = Description of Artificial Sequence: Synthetic primer
  source 1..24: mol_type = other DNA
crctcctacaatacaaaactaacc

SEQ ID NO: 12670 - DNA, 26 bp, synthetic construct
  misc_feature 1..26: note = Description of Artificial Sequence: Synthetic primer
  source 1..26: mol_type = other DNA
acactttatacctatttaaacctctc

SEQ ID NO: 12671-12682 - skipped (12 entries)

SEQ ID NO: 12683 - DNA, 36 bp, Homo sapiens
  source 1..36: mol_type = unassigned DNA
cggctcacgcagggtgcgcgcacccactgacctgcg

SEQ ID NO: 12684-12704 - skipped (21 entries)

SEQ ID NO: 12705 - DNA, 181 bp, Homo sapiens
  source 1..181: mol_type = unassigned DNA
cggagattgcagtgagccgagatcgtgccattgcactccaatggcactccagcctgatgacagagcgagactccgtctcaaaaataataataaataaataaacaaacaaacaaaaattagctgggcgtggtggcgtgtgcctgtagtcccagctactcgggagactgaggcaggagaatcg

SEQ ID NO: 12706-12715 - skipped (10 entries)

SEQ ID NO: 12716 - DNA, 369 bp, Homo sapiens
  source 1..369: mol_type = unassigned DNA
cgcgtttgaggagcccttcagcccgtcgctgcactgtgggagcccctttctgggctggacaaggctggagccggctccctcagcttgcgggtaggtgtggagagagaggcgtgggcgggaaccgtggctgcaggctgcgcttgcgggccagctcgagttccgggtgggcgtgggcttggcaagccccgcactcggagcggccagccggcccgggcagtgaggagcttagcacctgggccagcagctgctgtgctcgacttctcgctgggccttagctgcctccccgccgggcagggctcgggacctgcagccctccatgcctgagcctccacccccgccgtgcgctcctgtgcagcccaagcctccccg

SEQ ID NO: 12717-12737 - skipped (21 entries)

SEQ ID NO: 12738 - DNA, 35 bp, Homo sapiens
  source 1..35: mol_type = unassigned DNA
cgcttgcaccactacctcgacttcatttactaccg

SEQ ID NO: 12739-12748 - skipped (10 entries)

SEQ ID NO: 12749 - DNA, 487 bp, Homo sapiens
  source 1..487: mol_type = unassigned DNA
cgcccagggcgggaatccagcgcacgggtgaggactttaaaaagcaaggggcaggatgagtcaacaaggttttgagcaggaaaactatgcgataggaagtgtatacattgccctatagcagaaagaccggggacgggaccagcctccaagcgacttcaaacccaaaaggaagcaacttccagactcttatgggcgtctcaatttgctctgggtgaaggaagacaggcaagaatttccaggtctgtgaggaccccacgtcccagggacagaagtgccagggacctgggaagtgcagacttaatacaaggcagagcaaaactcacgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcg

SEQ ID NO: 12750-12759 - skipped (10 entries)

SEQ ID NO: 12760 - DNA, 28 bp, Homo sapiens
  source 1..28: mol_type = unassigned DNA
cgtcttgatctcctgacctcgtgatccg

SEQ ID NO: 12761-12781 - skipped (21 entries)

SEQ ID NO: 12782 - DNA, 18 bp, Homo sapiens
  source 1..18: mol_type = unassigned DNA
cgcgccttcctgaccgcg

SEQ ID NO: 12783 - DNA, 18 bp, Homo sapiens
  source 1..18: mol_type = unassigned DNA
cgcaggtcagtgagtgcg

SEQ ID NO: 12784-12793 - skipped (10 entries)

SEQ ID NO: 12794 - DNA, 87 bp, Homo sapiens
  source 1..87: mol_type = unassigned DNA
cgagccgaagcagggcgaggcattgcctcacctgggaagcgcaaggggtcagagagttccctttccgagtcaaataaatgggtgacg

SEQ ID NO: 12795-12804 - skipped (10 entries)

SEQ ID NO: 12805 - DNA, 11 bp, Homo sapiens
  source 1..11: mol_type = unassigned DNA
cggagcttgcg

SEQ ID NO: 12806-12824 - skipped (19 entries)

SEQ ID NO: 12825 - DNA, 167 bp, Homo sapiens
  source 1..167: mol_type = unassigned DNA
cgcaccgtgggcgagccgaagcagggcgaggcattgcctcacctgggaagcgccaggggtcagggagttccctttccgagtcaaggaaaggggtgaccgacgcacctagaaaatcgggtcactcccacccgaatattgcgcttttcagaccggcttaaaaaatggcg

SEQ ID NO: 12826-12828 - skipped (3 entries)

SEQ ID NO: 12829 - DNA, 185 bp, Homo sapiens
  source 1..185: mol_type = unassigned DNA
cgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccg

SEQ ID NO: 12830 - DNA, 17 bp, Homo sapiens
  source 1..17: mol_type = unassigned DNA
cgagccgaagcagggcg

SEQ ID NO: 12831 - DNA, 135 bp, Homo sapiens
  source 1..135: mol_type = unassigned DNA
cgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcg

SEQ ID NO: 12832 - skipped

SEQ ID NO: 12833 - DNA, 71 bp, Homo sapiens
  source 1..71: mol_type = unassigned DNA
cgctcgctcttggcgcctcctcggccttggcacccactctggccgcgcttgaggagcccttcagcccgccg

SEQ ID NO: 12834 - DNA, 54 bp, Homo sapiens
  source 1..54: mol_type = unassigned DNA
cgcgcaccgtgcgcgagccgaagcagggcgaggcattgcctcacttgggaagcg

SEQ ID NO: 12835 - skipped

SEQ ID NO: 12836 - DNA, 29 bp, Homo sapiens
  source 1..29: mol_type = unassigned DNA
cgccggtttttaagcccgtaggaaaagcg

SEQ ID NO: 12837 - DNA, 18 bp, Homo sapiens
  source 1..18: mol_type = unassigned DNA
cgctttctagtgtctgcg

SEQ ID NO: 12838-12839 - skipped (2 entries)

SEQ ID NO: 12840 - DNA, 24 bp, Homo sapiens
  source 1..24: mol_type = unassigned DNA
cgaagcgcctcctgcgcagactcg

SEQ ID NO: 12841-12852 - skipped (12 entries)

SEQ ID NO: 12853 - DNA, 12 bp, Homo sapiens
  source 1..12: mol_type = unassigned DNA
cggggcaggtcg

SEQ ID NO: 12854-12874 - skipped (21 entries)

SEQ ID NO: 12875 - DNA, 80 bp, Homo sapiens
  source 1..80: mol_type = unassigned DNA
cgtactcgcgccaggagtatggactcacccagggagtgcttgggcggagaagcagcctctgctccaggccttccgctgcg

SEQ ID NO: 12876-12896 - skipped (21 entries)

SEQ ID NO: 12897 - DNA, 3039 bp, Homo sapiens
  source 1..3039: mol_type = unassigned DNA
cgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgccaggcccgagggggttgttgtgtcccaggcttgcacccagggttccacggggggcaccccaaagcggcaagtaggttcccaggggaaggggacagcacgtcaggcttggagggggacgttgaggcagccccgggaataaagaggggatgctggggtcctgccacggataacactgtcttcccgacagcatctgtggtgggcctgggagcgtcatggagtccttggcttgcacccaaggtgcgtgtctcgccctcggggggcaccacaaagcggcaagaaggccaccgggggaagggtatgggacgccagggttgaaagggatagttgaggcagtccggggaaaaacgtggcaggctggggtcgtcccatggacgacagtgccttcccagcagcccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtggagtccctatcttgcacccagggtgcgtgtttcgcccatgggaggcaccccaaagcggcaagtaggcccctgggggaaggggacagcacctcagacttgaagggggactttgaggtagcccgtggaaaaaaacggcgacgctgagtttctcccacaaacgacagtgccttcctggcagccccttcgctgggccagggtggtcctggagtccgtggcttgcacccagggtgcgtgtctcgctcaagggggcaccccaaagcggcaagtagattcccgggggaagggagagcacgtcaggcttgaaggggaggttgaggcggccccggggtaaaagtggtgaagctggggtcctcccacggatgacaccgccttcctggcagcctctgcagtgggcccagaggtgtcgtggagtctctggcttgctcccaggttgtgtgtctcgcccacgagtggcaccacaaagcagcaagaaggcccccaggggaagggtacaggactccagggttgaaaggtagagttgaggcagaccggtgtcatcccaaggacaacagtgtcttgtccggtagcccctgcatcgggcctggggtggttgtggagtccctggcttgcacccggggtgcgtgtcgtgcccacgatgggcaccgcaatgcggtaagaagtccccgagtggaagggaacaggacgccgagcttgaaaggggacgttgaggcagtccggggaaaaaatttccactgagaacagtgccttcccggcagcctctgagtgggacccaggtggacggtggagcccctggcttggacccagggtgcctgtcttgctcacggggtgcacgtgaaagtggcaacagggcccccgggggaaggggacaacatgtcaggcttgaagagggacgttgggccagccagaggaaaacagcggctaggctgtggtcgtcccacagaccacagtgccttcccggcagcccctgagcctggcccaggcgggggggtttggagtccctgtcttgcaacagagtgcgtgtctcgcctaagtgtgcacgcgaaagctgcaagaagggctccgggggaagggaacaggatgccaggcttgaaaggggactttgaggcagtccagggaaaaactttccacggaggacagtgacttcccgacatcccctgcgcctggccctgggggtcttggagtccctggtttacacccagggtgcgtgcctcgcccacgggtggcaccccaaagcagcaagaaagccccggggggggaagaacaggatgccagacttgaaaggggacgttgaggcagcccaggaaaaaaaggggcgaggctggggtcctttcacggatgacagtgccttccctacagcccctatgccagtcccgggagggtcgcggagtccctgtcttgcacacaatgtgcgtgtctcgcccacggggggcaccccaaagtggcaagaagtcccccgcgggaaggcaacaggacgccaggcttgaatggggacgtttaggtagcctggagaaaaaagcagcgaggctggggtgatcccacgaatgacagtgccttaccggcagcccctttgccgggcatgcgggggttgttgattccctggcttgcacccagggtgagtgtcttgcccacggcgggcaccacaaagcagcaagaaggttcccgggggaaagggacagcacgtcagtcttgaagggggaagttgaggcagccccggggaaaaaaagcggggatgctggggtcctctcacggacgacactgccttcccagcagcctctgcagtgggcccgggagcgtcctggagtccctgtcttgcaccccgggtgcgtgtctcacccacggggagcaccacaaagcggcaagaaggccactgggggaagggtacaggacgccagggttgaaggggatagtggagacagtccaaggaaaaaagtggcgggatggtgtcgtcccaaggatggccacccctgcgccgggccagggatggtcgcggagtccctggcttgcacccaggttgtgtgtctcgcccacagggggcaccccaaagcagcacgaaggcctccaggggaagggaagaggacgccaggcttggaaggtgacgttgaggcagcagggggtaaaaagtggcgggccgggccctcccacggatgacagtgccttcccggaagccgctgcgcagggcccggcgtgtttgtggagtctctggcttgcacccagaatcgtgcg

SEQ ID NO: 12898-12919 - skipped (22 entries)

SEQ ID NO: 12920 - DNA, 36 bp, Homo sapiens
  source 1..36: mol_type = unassigned DNA
cgcaggtcagtgggtgcgcgcaccctgcgtgagccg

SEQ ID NO: 12921-12941 - skipped (21 entries)

SEQ ID NO: 12942 - DNA, 181 bp, Homo sapiens
  source 1..181: mol_type = unassigned DNA
cgattctcctgcctcagtctcccgagtagctgggactacaggcacacgccaccacgcccagctaatttttgtttgtttgtttatttatttattattatttttgagacggagtctcgctctgtcatcaggctggagtgccattggagtgcaatggcacgatctcggctcactgcaatctccg

SEQ ID NO: 12943-12952 - skipped (10 entries)

SEQ ID NO: 12953 - DNA, 369 bp, Homo sapiens
  source 1..369: mol_type = unassigned DNA
cggggaggcttgggctgcacaggagcgcacggcgggggtggaggctcaggcatggagggctgcaggtcccgagccctgcccggcggggaggcagctaaggcccagcgagaagtcgagcacagcagctgctggcccaggtgctaagctcctcactgcccgggccggctggccgctccgagtgcggggcttgccaagcccacgcccacccggaactcgagctggcccgcaagcgcagcctgcagccacggttcccgcccacgcctctctctccacacctacccgcaagctgagggagccggctccagccttgtccagcccagaaaggggctcccacagtgcagcgacgggctgaagggctcctcaaacgcg

SEQ ID NO: 12954-12974 - skipped (21 entries)

SEQ ID NO: 12975 - DNA, 35 bp, Homo sapiens
  source 1..35: mol_type = unassigned DNA
cggtagtaaatgaagtcgaggtagtggtgcaagcg

SEQ ID NO: 12976-12985 - skipped (10 entries)

SEQ ID NO: 12986 - DNA, 487 bp, Homo sapiens
  source 1..487: mol_type = unassigned DNA
cgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgtgagttttgctctgccttgtattaagtctgcacttcccaggtccctggcacttctgtccctgggacgtggggtcctcacagacctggaaattcttgcctgtcttccttcacccagagcaaattgagacgcccataagagtctggaagttgcttccttttgggtttgaagtcgcttggaggctggtcccgtccccggtctttctgctatagggcaatgtatacacttcctatcgcatagttttcctgctcaaaaccttgttgactcatcctgccccttgctttttaaagtcctcacccgtgcgctggattcccgccctgggcg

SEQ ID NO: 12987-12996 - skipped (10 entries)

SEQ ID NO: 12997 - DNA, 28 bp, Homo sapiens
  source 1..28: mol_type = unassigned DNA
cggatcacgaggtcaggagatcaagacg

SEQ ID NO: 12998-13018 - skipped (21 entries)

SEQ ID NO: 13019 - DNA, 18 bp, Homo sapiens
  source 1..18: mol_type = unassigned DNA
cgcggtcaggaaggcgcg

SEQ ID NO: 13020 - DNA, 18 bp, Homo sapiens
  source 1..18: mol_type = unassigned DNA
cgcactcactgacctgcg

SEQ ID NO: 13021-13030 - skipped (10 entries)

SEQ ID NO: 13031 - DNA, 87 bp, Homo sapiens
  source 1..87: mol_type = unassigned DNA
cgtcacccatttatttgactcggaaagggaactctctgaccccttgcgcttcccaggtgaggcaatgcctcgccctgcttcggctcg

SEQ ID NO: 13032-13041 - skipped (10 entries)

SEQ ID NO: 13042 - DNA, 11 bp, Homo sapiens
  source 1..11: mol_type = unassigned DNA
cgcaagctccg

SEQ ID NO: 13043-13061 - skipped (19 entries)

SEQ ID NO: 13062 - DNA, 167 bp, Homo sapiens
  source 1..167: mol_type = unassigned DNA
cgccattttttaagccggtctgaaaagcgcaatattcgggtgggagtgacccgattttctaggtgcgtcggtcacccctttccttgactcggaaagggaactccctgacccctggcgcttcccaggtgaggcaatgcctcgccctgcttcggctcgcccacggtgcg

SEQ ID NO: 13063-13065 - skipped (3 entries)

SEQ ID NO: 13066 - DNA, 185 bp, Homo sapiens
  source 1..185: mol_type = unassigned DNA
cggtgcttacatacgctgcttttaaaaaaatttgctttgttcaggtttgtgtgaatacaacgccggatgaactctgtcccttcagaagaaagccgggttggtgtgctcgatgacgcagcgcttgcagtggcgtttgacaaagcgcagggcctccacggagacctcgcagtcctggacattcagcg

SEQ ID NO: 13067 - DNA, 17 bp, Homo sapiens
  source 1..17: mol_type = unassigned DNA
cgccctgcttcggctcg

SEQ ID NO: 13068 - DNA, 135 bp, Homo sapiens
  source 1..135: mol_type = unassigned DNA
cgcaatattcgggtgggagtgacccgattttccaggtgcgtccgtcacccctttctttgactaggaaagggaactccctgacccctggcgcttcccgagtgaggcattgccttaccctgcttcggctcgcgcacg

SEQ ID NO: 13069 - skipped

SEQ ID NO: 13070 - DNA, 71 bp, Homo sapiens
  source 1..71: mol_type = unassigned DNA
cggcgggctgaagggctcctcaagcgcggccagagtgggtgccaaggccgaggaggcgccaagagcgagcg

SEQ ID NO: 13071 - DNA, 54 bp, Homo sapiens
  source 1..54: mol_type = unassigned DNA
cgcttcccaagtgaggcaatgcctcgccctgcttcggctcgcgcacggtgcgcg

SEQ ID NO: 13072 - skipped

SEQ ID NO: 13073 - DNA, 29 bp, Homo sapiens
  source 1..29: mol_type = unassigned DNA
cgcttttcctacgggcttaaaaaccggcg

SEQ ID NO: 13074 - DNA, 18 bp, Homo sapiens
  source 1..18: mol_type = unassigned DNA
cgcagacactagaaagcg

SEQ ID NO: 13075-13076 - skipped (2 entries)

SEQ ID NO: 13077 - DNA, 24 bp, Homo sapiens
  source 1..24: mol_type = unassigned DNA
cgagtctgcgcaggaggcgcttcg

SEQ ID NO: 13078-13089 - skipped (12 entries)

SEQ ID NO: 13090 - DNA, 12 bp, Homo sapiens
  source 1..12: mol_type = unassigned DNA
cgacctgccccg

SEQ ID NO: 13091-13111 - skipped (21 entries)

SEQ ID NO: 13112 - DNA, 80 bp, Homo sapiens
  source 1..80: mol_type = unassigned DNA
cgcagcggaaggcctggagcagaggctgcttctccgcccaagcactccctgggtgagtccatactcctggcgcgagtacg

SEQ ID NO: 13113-13133 - skipped (21 entries)

SEQ ID NO: 13134 - DNA, 3039 bp, Homo sapiens
  source 1..3039: mol_type = unassigned DNA
cgcacgattctgggtgcaagccagagactccacaaacacgccgggccctgcgcagcggcttccgggaaggcactgtcatccgtgggagggcccggcccgccactttttaccccctgctgcctcaacgtcaccttccaagcctggcgtcctcttcccttcccctggaggccttcgtgctgctttggggtgccccctgtgggcgagacacacaacctgggtgcaagccagggactccgcgaccatccctggcccggcgcaggggtggccatccttgggacgacaccatcccgccacttttttccttggactgtctccactatccccttcaaccctggcgtcctgtacccttcccccagtggccttcttgccgctttgtggtgctccccgtgggtgagacacgcacccggggtgcaagacagggactccaggacgctcccgggcccactgcagaggctgctgggaaggcagtgtcgtccgtgagaggaccccagcatccccgctttttttccccggggctgcctcaacttcccccttcaagactgacgtgctgtccctttcccccgggaaccttcttgctgctttgtggtgcccgccgtgggcaagacactcaccctgggtgcaagccagggaatcaacaacccccgcatgcccggcaaaggggctgccggtaaggcactgtcattcgtgggatcaccccagcctcgctgcttttttctccaggctacctaaacgtccccattcaagcctggcgtcctgttgccttcccgcgggggacttcttgccactttggggtgccccccgtgggcgagacacgcacattgtgtgcaagacagggactccgcgaccctcccgggactggcataggggctgtagggaaggcactgtcatccgtgaaaggaccccagcctcgcccctttttttcctgggctgcctcaacgtcccctttcaagtctggcatcctgttcttccccccccggggctttcttgctgctttggggtgccacccgtgggcgaggcacgcaccctgggtgtaaaccagggactccaagacccccagggccaggcgcaggggatgtcgggaagtcactgtcctccgtggaaagtttttccctggactgcctcaaagtcccctttcaagcctggcatcctgttcccttcccccggagcccttcttgcagctttcgcgtgcacacttaggcgagacacgcactctgttgcaagacagggactccaaacccccccgcctgggccaggctcaggggctgccgggaaggcactgtggtctgtgggacgaccacagcctagccgctgttttcctctggctggcccaacgtccctcttcaagcctgacatgttgtccccttcccccgggggccctgttgccactttcacgtgcaccccgtgagcaagacaggcaccctgggtccaagccaggggctccaccgtccacctgggtcccactcagaggctgccgggaaggcactgttctcagtggaaattttttccccggactgcctcaacgtcccctttcaagctcggcgtcctgttcccttccactcggggacttcttaccgcattgcggtgcccatcgtgggcacgacacgcaccccgggtgcaagccagggactccacaaccaccccaggcccgatgcaggggctaccggacaagacactgttgtccttgggatgacaccggtctgcctcaactctacctttcaaccctggagtcctgtacccttcccctgggggccttcttgctgctttgtggtgccactcgtgggcgagacacacaacctgggagcaagccagagactccacgacacctctgggcccactgcagaggctgccaggaaggcggtgtcatccgtgggaggaccccagcttcaccacttttaccccggggccgcctcaacctccccttcaagcctgacgtgctctcccttcccccgggaatctacttgccgctttggggtgcccccttgagcgagacacgcaccctgggtgcaagccacggactccaggaccaccctggcccagcgaaggggctgccaggaaggcactgtcgtttgtgggagaaactcagcgtcgccgtttttttccacgggctacctcaaagtcccccttcaagtctgaggtgctgtccccttcccccaggggcctacttgccgctttggggtgcctcccatgggcgaaacacgcaccctgggtgcaagatagggactccacgatccccccgggcccagcgcagggactgccaggaaggcactgtcatccgtaggaggaacccgactagccgcttttctctctgtgctgcctcagcatccccattaaagcctggccttctgtggcgttcgcccggcggccttcttgccactttggggtgcccccatgggtgcgacccgcaccctcggtgcaagccagggactccacgaccaccccgggcctgacgcaggggctgctgggaaggcactgtcgtccatgggacgaccccagcctgccacgtttttccccggactgcctcaactatccctttcaaccctggcgtcccatacccttcccccggtggccttcttgccgctttgtggtgccccccgagggcgagacacgcaccttgggtgcaagccaaggactccatgacgctcccaggcccaccacagatgctgtcgggaagacagtgttatccgtggcaggaccccagcatcccctctttattcccggggctgcctcaacgtccccctccaagcctgacgtgctgtccccttcccctgggaacctacttgccgctttggggtgccccccgtggaaccctgggtgcaagcctgggacacaacaaccccctcgggcctggcaaaggggctgccgggaaggcaccgtggtccgtgggaagttttttcctggactgcttcaaagtcccctttcaagcctggcgtcctgttcccttcccagggggcattcttgccgctttggggtgtccccccgtgggcgcgacacgcaccctgggttcaagtcaggaactccacgacaaccccgagtctggcg

SEQ ID NO: 13135-13156 - skipped (22 entries)

SEQ ID NO: 13157 - DNA, 36 bp, synthetic construct
  misc_feature 1..36: note = Description of Artificial Sequence: Synthetic oligonucleotide
  source 1..36: mol_type = other DNA
yggtttaygtagggtgygygtatttattgatttgyg

SEQ ID NO: 13158-13178 - skipped (21 entries)

SEQ ID NO: 13179 - DNA, 181 bp, synthetic construct
  misc_feature 1..181: note = Description of Artificial Sequence: Synthetic polynucleotide
  source 1..181: mol_type = other DNA
yggagattgtagtgagtygagatygtgttattgtattttaatggtattttagtttgatgatagagygagatttygttttaaaaataataataaataaataaataaataaataaaaattagttgggygtggtggygtgtgtttgtagttttagttattygggagattgaggtaggagaatyg

SEQ ID NO: 13180-13189 - skipped (10 entries)

SEQ ID NO: 13190 - DNA, 369 bp, synthetic construct
  misc_feature 1..369: note = Description of Artificial Sequence: Synthetic polynucleotide
  source 1..369: mol_type = other DNA
ygygtttgaggagttttttagttygtygttgtattgtgggagtttttttttgggttggataaggttggagtyggtttttttagtttgygggtaggtgtggagagagaggygtgggygggaatygtggttgtaggttgygtttgygggttagttygagtttygggtgggygtgggtttggtaagtttygtattyggagyggttagtyggttygggtagtgaggagtttagtatttgggttagtagttgttgtgttygatttttygttgggttttagttgttttttygtygggtagggttygggatttgtagttttttatgtttgagtttttattttygtygtgygtttttgtgtagtttaagttttttyg

SEQ ID NO: 13191-13211 - skipped (21 entries)

SEQ ID NO: 13212 - DNA, 35 bp, synthetic construct
  misc_feature 1..35: note = Description of Artificial Sequence: Synthetic oligonucleotide
  source 1..35: mol_type = other DNA
ygtttgtattattatttygattttatttattatyg

SEQ ID NO: 13213-13222 - skipped (10 entries)

SEQ ID NO: 13223 - DNA, 487 bp, synthetic construct
  misc_feature 1..487: note = Description of Artificial Sequence: Synthetic polynucleotide
  source 1..487: mol_type = other DNA
ygtttagggygggaatttagygtaygggtgaggattttaaaaagtaaggggtaggatgagttaataaggttttgagtaggaaaattatgygataggaagtgtatatattgttttatagtagaaagatyggggaygggattagtttttaagygattttaaatttaaaaggaagtaatttttagatttttatgggygttttaatttgttttgggtgaaggaagataggtaagaatttttaggtttgtgaggattttaygttttagggatagaagtgttagggatttgggaagtgtagatttaatataaggtagagtaaaatttaygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyg

SEQ ID NO: 13224-13233 - skipped (10 entries)

SEQ ID NO: 13234 - DNA, 28 bp, synthetic construct
  misc_feature 1..28: note = Description of Artificial Sequence: Synthetic oligonucleotide
  source 1..28: mol_type = other DNA
ygttttgattttttgatttygtgattyg

SEQ ID NO: 13235-13255 - skipped (21 entries)

SEQ ID NO: 13256 - DNA, 18 bp, synthetic construct
  misc_feature 1..18: note = Description of Artificial Sequence: Synthetic oligonucleotide
  source 1..18: mol_type = other DNA
ygygtttttttgatygyg

SEQ ID NO: 13257 - DNA, 18 bp, synthetic construct
  misc_feature 1..18: note = Description of Artificial Sequence: Synthetic oligonucleotide
  source 1..18: mol_type = other DNA
ygtaggttagtgagtgyg

SEQ ID NO: 13258-13267 - skipped (10 entries)

SEQ ID NO: 13268 - DNA, 87 bp, synthetic construct
  misc_feature 1..87: note = Description of Artificial Sequence: Synthetic oligonucleotide
  source 1..87: mol_type = other DNA
ygagtygaagtagggygaggtattgttttatttgggaagygtaaggggttagagagtttttttttygagttaaataaatgggtgayg

SEQ ID NO: 13269-13278 - skipped (10 entries)

SEQ ID NO: 13279 - DNA, 11 bp, synthetic construct
  misc_feature 1..11: note = Description of Artificial Sequence: Synthetic oligonucleotide
  source 1..11: mol_type = other DNA
yggagtttgyg

SEQ ID NO: 13280-13298 - skipped (19 entries)

SEQ ID NO: 13299 - DNA, 167 bp, synthetic construct
  misc_feature 1..167: note = Description of Artificial Sequence: Synthetic polynucleotide
  source 1..167: mol_type = other DNA
ygtatygtgggygagtygaagtagggygaggtattgttttatttgggaagygttaggggttagggagtttttttttygagttaaggaaaggggtgatygaygtatttagaaaatygggttatttttattygaatattgygttttttagatyggtttaaaaaatggyg

SEQ ID NO: 13300-13302 - skipped (3 entries)

SEQ ID NO: 13303 - DNA, 185 bp, synthetic construct
  misc_feature 1..185: note = Description of Artificial Sequence: Synthetic polynucleotide
  source 1..185: mol_type = other DNA
ygttgaatgtttaggattgygaggttttygtggaggttttgygttttgttaaaygttattgtaagygttgygttatygagtatattaattyggtttttttttgaagggatagagtttattyggygttgtatttatataaatttgaataaagtaaatttttttaaaagtagygtatgtaagtatyg

SEQ ID NO: 13304 - DNA, 17 bp, synthetic construct
  misc_feature 1..17: note = Description of Artificial Sequence: Synthetic oligonucleotide
  source 1..17: mol_type = other DNA
ygagtygaagtagggyg

SEQ ID NO: 13305 - DNA, 135 bp, synthetic construct
  misc_feature 1..135: note = Description of Artificial Sequence: Synthetic polynucleotide
  source 1..135: mol_type = other DNA
ygtgygygagtygaagtagggtaaggtaatgttttattygggaagygttaggggttagggagtttttttttttagttaaagaaaggggtgayggaygtatttggaaaatygggttatttttattygaatattgyg

SEQ ID NO: 13306 - skipped

SEQ ID NO: 13307 - DNA, 71 bp, synthetic construct
  misc_feature 1..71: note = Description of Artificial Sequence: Synthetic oligonucleotide
  source 1..71: mol_type = other DNA
ygttygtttttggygttttttyggttttggtatttattttggtygygtttgaggagttttttagttygtyg

SEQ ID NO: 13308 - DNA, 54 bp, synthetic construct
  misc_feature 1..54: note = Description of Artificial Sequence: Synthetic oligonucleotide
  source 1..54: mol_type = other DNA
ygygtatygtgygygagtygaagtagggygaggtattgttttatttgggaagyg

SEQ ID NO: 13309 - skipped

SEQ ID NO: 13310 - DNA, 29 bp, synthetic construct
  misc_feature 1..29: note = Description of Artificial Sequence: Synthetic oligonucleotide
  source 1..29: mol_type = other DNA
ygtyggtttttaagttygtaggaaaagyg

SEQ ID NO: 13311 - DNA, 18 bp, synthetic construct
  misc_feature 1..18: note = Description of Artificial Sequence: Synthetic oligonucleotide
  source 1..18: mol_type = other DNA
ygttttttagtgtttgyg

SEQ ID NO: 13312-13313 - skipped (2 entries)

SEQ ID NO: 13314 - DNA, 24 bp, synthetic construct
  misc_feature 1..24: note = Description of Artificial Sequence: Synthetic oligonucleotide
  source 1..24: mol_type = other DNA
ygaagygttttttgygtagattyg

SEQ ID NO: 13315-13326 - skipped (12 entries)

SEQ ID NO: 13327 - DNA, 12 bp, synthetic construct
  misc_feature 1..12: note = Description of Artificial Sequence: Synthetic oligonucleotide
  source 1..12: mol_type = other DNA
yggggtaggtyg

SEQ ID NO: 13328-13348 - skipped (21 entries)

SEQ ID NO: 13349 - DNA, 80 bp, synthetic construct
  misc_feature 1..80: note = Description of Artificial Sequence: Synthetic oligonucleotide
  source 1..80: mol_type = other DNA
ygtattygygttaggagtatggatttatttagggagtgtttgggyggagaagtagtttttgttttaggtttttygttgyg

SEQ ID NO: 13350-13370 - skipped (21 entries)

SEQ ID NO: 13371 - DNA, 3039 bp, synthetic construct
  misc_feature 1..3039: note = Description of Artificial Sequence: Synthetic polynucleotide
  source 1..3039: mol_type = other DNA
ygttagattyggggttgtygtggagtttttgatttgaatttagggtgygtgtygygtttayggggggatattttaaagyggtaagaatgttttttgggaagggaataggaygttaggtttgaaaggggattttgaagtagtttaggaaaaaattttttayggattayggtgttttttyggtagtttttttgttaggttygagggggttgttgtgttttaggtttgtatttagggttttayggggggtattttaaagyggtaagtaggtttttaggggaaggggatagtaygttaggtttggagggggaygttgaggtagtttygggaataaagaggggatgttggggttttgttayggataatattgttttttygatagtatttgtggtgggtttgggagygttatggagtttttggtttgtatttaaggtgygtgtttygttttyggggggtattataaagyggtaagaaggttatygggggaagggtatgggaygttagggttgaaagggatagttgaggtagttyggggaaaaaygtggtaggttggggtygttttatggaygatagtgtttttttagtagtttttgygttaggttyggggtggtygtggagtttttggtttgtatygagggtgygggtygtatttatgggggtattttaaagtggtaagaaggtygtygggygaaygttatagaaggttaggttttaatggggatgttgaggtagtatagagagaaaagyggttagtygggttttttttayggatgatagtgtttttttggtagtttttgygttgggttyggggggatygtggagtttttattttgtatttagggtgygtgtttygtttatgggaggtattttaaagyggtaagtaggtttttgggggaaggggatagtattttagatttgaagggggattttgaggtagttygtggaaaaaaayggygaygttgagttttttttataaaygatagtgtttttttggtagttttttygttgggttagggtggttttggagttygtggtttgtatttagggtgygtgtttygtttaagggggtattttaaagyggtaagtagattttygggggaagggagagtaygttaggtttgaaggggaggttgaggyggtttyggggtaaaagtggtgaagttggggtttttttayggatgatatygtttttttggtagtttttgtagtgggtttagaggtgtygtggagtttttggtttgtttttaggttgtgtgtttygtttaygagtggtattataaagtagtaagaaggtttttaggggaagggtataggattttagggttgaaaggtagagttgaggtagatyggtgttattttaaggataatagtgttttgttyggtagtttttgtatygggtttggggtggttgtggagtttttggtttgtattyggggtgygtgtygtgtttaygatgggtatygtaatgyggtaagaagttttygagtggaagggaataggaygtygagtttgaaaggggaygttgaggtagttyggggaaaaaatttttattgagaatagtgttttttyggtagtttttgagtgggatttaggtggayggtggagtttttggtttggatttagggtgtttgttttgtttayggggtgtaygtgaaagtggtaatagggttttygggggaaggggataatatgttaggtttgaagagggaygttgggttagttagaggaaaatagyggttaggttgtggtygttttatagattatagtgttttttyggtagtttttgagtttggtttaggygggggggtttggagtttttgttttgtaatagagtgygtgtttygtttaagtgtgtaygygaaagttgtaagaagggtttygggggaagggaataggatgttaggtttgaaaggggattttgaggtagtttagggaaaaattttttayggaggatagtgatttttygatattttttgygtttggttttgggggttttggagtttttggtttatatttagggtgygtgtttygtttaygggtggtattttaaagtagtaagaaagtttyggggggggaagaataggatgttagatttgaaaggggaygttgaggtagtttaggaaaaaaaggggygaggttggggtttttttayggatgatagtgttttttttatagtttttatgttagtttygggagggtygyggagtttttgttttgtatataatgtgygtgtttygtttayggggggtattttaaagtggtaagaagtttttygygggaaggtaataggaygttaggtttgaatggggaygtttaggtagtttggagaaaaaagtagygaggttggggtgattttaygaatgatagtgttttatyggtagtttttttgtygggtatgygggggttgttgattttttggtttgtatttagggtgagtgttttgtttayggygggtattataaagtagtaagaaggttttygggggaaagggatagtaygttagttttgaagggggaagttgaggtagtttyggggaaaaaaagyggggatgttggggtttttttayggaygatattgtttttttagtagtttttgtagtgggttygggagygttttggagtttttgttttgtatttygggtgygtgttttatttayggggagtattataaagyggtaagaaggttattgggggaagggtataggaygttagggttgaaggggatagtggagatagtttaaggaaaaaagtggygggatggtgtygttttaaggatggttatttttgygtygggttagggatggtygyggagtttttggtttgtatttaggttgtgtgtttygtttatagggggtattttaaagtagtaygaaggtttttaggggaagggaagaggaygttaggtttggaaggtgaygttgaggtagtagggggtaaaaagtggygggtygggtttttttayggatgatagtgttttttyggaagtygttgygtagggttyggygtgtttgtggagtttttggtttgtatttagaatygtgyg

SEQ ID NO: 13372-13393 - skipped (22 entries)

SEQ ID NO: 13394 - DNA, 36 bp, synthetic construct
  misc_feature 1..36: note = Description of Artificial Sequence: Synthetic oligonucleotide
  source 1..36: mol_type = other DNA
tggtttatgtagggtgtgtgtatttattgatttgtg

SEQ ID NO: 13395-13415 - skipped (21 entries)

SEQ ID NO: 13416 - DNA, 181 bp, synthetic construct
  misc_feature 1..181: note = Description of Artificial Sequence: Synthetic polynucleotide
  source 1..181: mol_type = other DNA
tggagattgtagtgagttgagattgtgttattgtattttaatggtattttagtttgatgatagagtgagattttgttttaaaaataataataaataaataaataaataaataaaaattagttgggtgtggtggtgtgtgtttgtagttttagttatttgggagattgaggtaggagaattg

SEQ ID NO: 13417-13426 - skipped (10 entries)

SEQ ID NO: 13427 - DNA, 369 bp, synthetic construct
  misc_feature 1..369: note = Description of Artificial Sequence: Synthetic polynucleotide
  source 1..369: mol_type = other DNA
tgtgtttgaggagttttttagtttgttgttgtattgtgggagtttttttttgggttggataaggttggagttggtttttttagtttgtgggtaggtgtggagagagaggtgtgggtgggaattgtggttgtaggttgtgtttgtgggttagtttgagttttgggtgggtgtgggtttggtaagttttgtatttggagtggttagttggtttgggtagtgaggagtttagtatttgggttagtagttgttgtgtttgattttttgttgggttttagttgtttttttgttgggtagggtttgggatttgtagttttttatgtttgagtttttatttttgttgtgtgtttttgtgtagtttaagtttttttg

SEQ ID NO: 13428-13448 - skipped (21 entries)

SEQ ID NO: 13449 - DNA, 35 bp, synthetic construct
  misc_feature 1..35: note = Description of Artificial Sequence: Synthetic oligonucleotide
  source 1..35: mol_type = other DNA
tgtttgtattattattttgattttatttattattg

SEQ ID NO: 13450-13459 - skipped (10 entries)

SEQ ID NO: 13460 - DNA, 487 bp, synthetic construct
  misc_feature 1..487: note = Description of Artificial Sequence: Synthetic polynucleotide
  source 1..487: mol_type = other DNA
tgtttagggtgggaatttagtgtatgggtgaggattttaaaaagtaaggggtaggatgagttaataaggttttgagtaggaaaattatgtgataggaagtgtatatattgttttatagtagaaagattggggatgggattagtttttaagtgattttaaatttaaaaggaagtaatttttagatttttatgggtgttttaatttgttttgggtgaaggaagataggtaagaatttttaggtttgtgaggattttatgttttagggatagaagtgttagggatttgggaagtgtagatttaatataaggtagagtaaaatttatgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtg

SEQ ID NO: 13461-13470 - skipped (10 entries)

SEQ ID NO: 13471 - DNA, 28 bp, synthetic construct
  misc_feature 1..28: note = Description of Artificial Sequence: Synthetic oligonucleotide
  source 1..28: mol_type = other DNA
tgttttgattttttgattttgtgatttg

SEQ ID NO: 13472-13492 - skipped (21 entries)

SEQ ID NO: 13493 - DNA, 18 bp, synthetic construct
  misc_feature 1..18: note = Description of Artificial Sequence: Synthetic oligonucleotide
  source 1..18: mol_type = other DNA
tgtgtttttttgattgtg

SEQ ID NO: 13494 - DNA, 18 bp, synthetic construct
  misc_feature 1..18: note = Description of Artificial Sequence: Synthetic oligonucleotide
  source 1..18: mol_type = other DNA
tgtaggttagtgagtgtg

SEQ ID NO: 13495-13504 - skipped (10 entries)

SEQ ID NO: 13505 - DNA, 87 bp, synthetic construct
  misc_feature 1..87: note = Description of Artificial Sequence: Synthetic oligonucleotide
  source 1..87: mol_type = other DNA
tgagttgaagtagggtgaggtattgttttatttgggaagtgtaaggggttagagagttttttttttgagttaaataaatgggtgatg

SEQ ID NO: 13506-13515 - skipped (10 entries)

SEQ ID NO: 13516 - DNA, 11 bp, synthetic construct
  misc_feature 1..11: note = Description of Artificial Sequence: Synthetic oligonucleotide
  source 1..11: mol_type = other DNA
tggagtttgtg

SEQ ID NO: 13517-13535 - skipped (19 entries)

SEQ ID NO: 13536 - DNA, 167 bp, synthetic construct
  misc_feature 1..167: note = Description of Artificial Sequence: Synthetic polynucleotide
  source 1..167: mol_type = other DNA
tgtattgtgggtgagttgaagtagggtgaggtattgttttatttgggaagtgttaggggttagggagttttttttttgagttaaggaaaggggtgattgatgtatttagaaaattgggttatttttatttgaatattgtgttttttagattggtttaaaaaatggtg

SEQ ID NO: 13537-13539 - skipped (3 entries)

SEQ ID NO: 13540 - DNA, 185 bp, synthetic construct
  misc_feature 1..185: note = Description of Artificial Sequence: Synthetic polynucleotide
  source 1..185: mol_type = other DNA
tgttgaatgtttaggattgtgaggtttttgtggaggttttgtgttttgttaaatgttattgtaagtgttgtgttattgagtatattaatttggtttttttttgaagggatagagtttatttggtgttgtatttatataaatttgaataaagtaaatttttttaaaagtagtgtatgtaagtattg

SEQ ID NO: 13541 - DNA, 17 bp, synthetic construct
  misc_feature 1..17: note = Description of Artificial Sequence: Synthetic oligonucleotide
  source 1..17: mol_type = other DNA
tgagttgaagtagggtg

SEQ ID NO: 13542 - DNA, 135 bp, synthetic construct
  misc_feature 1..135: note = Description of Artificial Sequence: Synthetic polynucleotide
  source 1..135: mol_type = other DNA
tgtgtgtgagttgaagtagggtaaggtaatgttttatttgggaagtgttaggggttagggagtttttttttttagttaaagaaaggggtgatggatgtatttggaaaattgggttatttttatttgaatattgtg

SEQ ID NO: 13543 - skipped

SEQ ID NO: 13544 - DNA, 71 bp, synthetic construct
  misc_feature 1..71: note = Description of Artificial Sequence: Synthetic oligonucleotide
  source 1..71: mol_type = other DNA
tgtttgtttttggtgtttttttggttttggtatttattttggttgtgtttgaggagttttttagtttgttg

SEQ ID NO: 13545 - DNA, 54 bp, synthetic construct
  misc_feature 1..54: note = Description of Artificial Sequence: Synthetic oligonucleotide
  source 1..54: mol_type = other DNA
tgtgtattgtgtgtgagttgaagtagggtgaggtattgttttatttgggaagtg

SEQ ID NO: 13546 - skipped

SEQ ID NO: 13547 - DNA, 29 bp, synthetic construct
  misc_feature 1..29: note = Description of Artificial Sequence: Synthetic oligonucleotide
  source 1..29: mol_type = other DNA
tgttggtttttaagtttgtaggaaaagtg

SEQ ID NO: 13548 - DNA, 18 bp, synthetic construct
  misc_feature 1..18: note = Description of Artificial Sequence: Synthetic oligonucleotide
  source 1..18: mol_type = other DNA
tgttttttagtgtttgtg

SEQ ID NO: 13549-13550 - skipped (2 entries)

SEQ ID NO: 13551 - DNA, 24 bp, synthetic construct
  misc_feature 1..24: note = Description of Artificial Sequence: Synthetic oligonucleotide
  source 1..24: mol_type = other DNA
tgaagtgttttttgtgtagatttg

SEQ ID NO: 13552-13563 - skipped (12 entries)

SEQ ID NO: 13564 - DNA, 12 bp, synthetic construct
  misc_feature 1..12: note = Description of Artificial Sequence: Synthetic oligonucleotide
  source 1..12: mol_type = other DNA
tggggtaggttg

SEQ ID NO: 13565-13585 - skipped (21 entries)

SEQ ID NO: 13586 - DNA, 80 bp, synthetic construct
  misc_feature 1..80: note = Description of Artificial Sequence: Synthetic oligonucleotide
  source 1..80: mol_type = other DNA
tgtatttgtgttaggagtatggatttatttagggagtgtttgggtggagaagtagtttttgttttaggttttttgttgtg

SEQ ID NO: 13587-13607 - skipped (21 entries)

SEQ ID NO: 13608 - DNA, 3039 bp, synthetic construct
  misc_feature 1..3039: note = Description of Artificial Sequence: Synthetic polynucleotide
  source 1..3039: mol_type = other DNA
tgttagatttggggttgttgtggagtttttgatttgaatttagggtgtgtgttgtgtttatggggggatattttaaagtggtaagaatgttttttgggaagggaataggatgttaggtttgaaaggggattttgaagtagtttaggaaaaaattttttatggattatggtgtttttttggtagtttttttgttaggtttgagggggttgttgtgttttaggtttgtatttagggttttatggggggtattttaaagtggtaagtaggtttttaggggaaggggatagtatgttaggtttggagggggatgttgaggtagttttgggaataaagaggggatgttggggttttgttatggataatattgtttttttgatagtatttgtggtgggtttgggagtgttatggagtttttggtttgtatttaaggtgtgtgttttgtttttggggggtattataaagtggtaagaaggttattgggggaagggtatgggatgttagggttgaaagggatagttgaggtagtttggggaaaaatgtggtaggttggggttgttttatggatgatagtgtttttttagtagtttttgtgttaggtttggggtggttgtggagtttttggtttgtattgagggtgtgggttgtatttatgggggtattttaaagtggtaagaaggttgttgggtgaatgttatagaaggttaggttttaatggggatgttgaggtagtatagagagaaaagtggttagttgggttttttttatggatgatagtgtttttttggtagtttttgtgttgggtttggggggattgtggagtttttattttgtatttagggtgtgtgttttgtttatgggaggtattttaaagtggtaagtaggtttttgggggaaggggatagtattttagatttgaagggggattttgaggtagtttgtggaaaaaaatggtgatgttgagttttttttataaatgatagtgtttttttggtagtttttttgttgggttagggtggttttggagtttgtggtttgtatttagggtgtgtgttttgtttaagggggtattttaaagtggtaagtagatttttgggggaagggagagtatgttaggtttgaaggggaggttgaggtggttttggggtaaaagtggtgaagttggggtttttttatggatgatattgtttttttggtagtttttgtagtgggtttagaggtgttgtggagtttttggtttgtttttaggttgtgtgttttgtttatgagtggtattataaagtagtaagaaggtttttaggggaagggtataggattttagggttgaaaggtagagttgaggtagattggtgttattttaaggataatagtgttttgtttggtagtttttgtattgggtttggggtggttgtggagtttttggtttgtatttggggtgtgtgttgtgtttatgatgggtattgtaatgtggtaagaagtttttgagtggaagggaataggatgttgagtttgaaaggggatgttgaggtagtttggggaaaaaatttttattgagaatagtgtttttttggtagtttttgagtgggatttaggtggatggtggagtttttggtttggatttagggtgtttgttttgtttatggggtgtatgtgaaagtggtaatagggtttttgggggaaggggataatatgttaggtttgaagagggatgttgggttagttagaggaaaatagtggttaggttgtggttgttttatagattatagtgtttttttggtagtttttgagtttggtttaggtgggggggtttggagtttttgttttgtaatagagtgtgtgttttgtttaagtgtgtatgtgaaagttgtaagaagggttttgggggaagggaataggatgttaggtttgaaaggggattttgaggtagtttagggaaaaattttttatggaggatagtgattttttgatattttttgtgtttggttttgggggttttggagtttttggtttatatttagggtgtgtgttttgtttatgggtggtattttaaagtagtaagaaagttttggggggggaagaataggatgttagatttgaaaggggatgttgaggtagtttaggaaaaaaaggggtgaggttggggtttttttatggatgatagtgttttttttatagtttttatgttagttttgggagggttgtggagtttttgttttgtatataatgtgtgtgttttgtttatggggggtattttaaagtggtaagaagttttttgtgggaaggtaataggatgttaggtttgaatggggatgtttaggtagtttggagaaaaaagtagtgaggttggggtgattttatgaatgatagtgttttattggtagtttttttgttgggtatgtgggggttgttgattttttggtttgtatttagggtgagtgttttgtttatggtgggtattataaagtagtaagaaggtttttgggggaaagggatagtatgttagttttgaagggggaagttgaggtagttttggggaaaaaaagtggggatgttggggtttttttatggatgatattgtttttttagtagtttttgtagtgggtttgggagtgttttggagtttttgttttgtattttgggtgtgtgttttatttatggggagtattataaagtggtaagaaggttattgggggaagggtataggatgttagggttgaaggggatagtggagatagtttaaggaaaaaagtggtgggatggtgttgttttaaggatggttatttttgtgttgggttagggatggttgtggagtttttggtttgtatttaggttgtgtgttttgtttatagggggtattttaaagtagtatgaaggtttttaggggaagggaagaggatgttaggtttggaaggtgatgttgaggtagtagggggtaaaaagtggtgggttgggtttttttatggatgatagtgtttttttggaagttgttgtgtagggtttggtgtgtttgtggagtttttggtttgtatttagaattgtgtg

SEQ ID NO: 13609-13630 - skipped (22 entries)

SEQ ID NO: 13631 - DNA, 36 bp, synthetic construct
  misc_feature 1..36: note = Description of Artificial Sequence: Synthetic oligonucleotide
  source 1..36: mol_type = other DNA
ygtaggttagtgggtgygygtattttgygtgagtyg

SEQ ID NO: 13632-13652 - skipped (21 entries)

SEQ ID NO: 13653 - DNA, 181 bp, synthetic construct
  misc_feature 1..181: note = Description of Artificial Sequence: Synthetic polynucleotide
  source 1..181: mol_type = other DNA
ygatttttttgttttagtttttygagtagttgggattataggtataygttattaygtttagttaatttttgtttgtttgtttatttatttattattatttttgagayggagtttygttttgttattaggttggagtgttattggagtgtaatggtaygatttyggtttattgtaattttyg

SEQ ID NO: 13654-13663 - skipped (10 entries)

SEQ ID NO: 13664 - DNA, 369 bp, synthetic construct
  misc_feature 1..369: note = Description of Artificial Sequence: Synthetic polynucleotide
  source 1..369: mol_type = other DNA
yggggaggtttgggttgtataggagygtayggygggggtggaggtttaggtatggagggttgtaggtttygagttttgttyggyggggaggtagttaaggtttagygagaagtygagtatagtagttgttggtttaggtgttaagttttttattgttygggtyggttggtygtttygagtgyggggtttgttaagtttaygtttattyggaattygagttggttygtaagygtagtttgtagttayggttttygtttaygtttttttttttatatttattygtaagttgagggagtyggttttagttttgtttagtttagaaaggggtttttatagtgtagygaygggttgaagggttttttaaaygyg

SEQ ID NO: 13665-13685 - skipped (21 entries)

SEQ ID NO: 13686 - DNA, 35 bp, synthetic construct
  misc_feature 1..35: note = Description of Artificial Sequence: Synthetic oligonucleotide
  source 1..35: mol_type = other DNA
yggtagtaaatgaagtygaggtagtggtgtaagyg

SEQ ID NO: 13687-13696 - skipped (10 entries)

SEQ ID NO: 13697 - DNA, 487 bp, synthetic construct
  misc_feature 1..487: note = Description of Artificial Sequence: Synthetic polynucleotide
  source 1..487: mol_type = other DNA
ygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygtgagttttgttttgttttgtattaagtttgtattttttaggtttttggtatttttgtttttgggaygtggggtttttatagatttggaaatttttgtttgtttttttttatttagagtaaattgagaygtttataagagtttggaagttgtttttttttgggtttgaagtygtttggaggttggtttygttttyggtttttttgttatagggtaatgtatatattttttatygtatagtttttttgtttaaaattttgttgatttattttgttttttgttttttaaagtttttattygtgygttggattttygttttgggyg

SEQ ID NO: 13698-13707 - skipped (10 entries)

SEQ ID NO: 13708 - DNA, 28 bp, synthetic construct
  misc_feature 1..28: note = Description of Artificial Sequence: Synthetic oligonucleotide
  source 1..28: mol_type = other DNA
yggattaygaggttaggagattaagayg

SEQ ID NO: 13709-13729 - skipped (21 entries)

SEQ ID NO: 13730 - DNA, 18 bp, synthetic construct
  misc_feature 1..18: note = Description of Artificial Sequence: Synthetic oligonucleotide
  source 1..18: mol_type = other DNA
ygyggttaggaaggygyg

SEQ ID NO: 13731 - DNA, 18 bp, synthetic construct
  misc_feature 1..18: note = Description of Artificial Sequence: Synthetic oligonucleotide
  source 1..18: mol_type = other DNA
ygtatttattgatttgyg

SEQ ID NO: 13732-13741 - skipped (10 entries)

SEQ ID NO: 13742 - DNA, 87 bp, synthetic construct
  misc_feature 1..87: note = Description of Artificial Sequence: Synthetic oligonucleotide
  source 1..87: mol_type = other DNA
ygttatttatttatttgattyggaaagggaattttttgattttttgygttttttaggtgaggtaatgtttygttttgtttyggttyg

SEQ ID NO: 13743-13752 - skipped (10 entries)

SEQ ID NO: 13753 - DNA, 11 bp, synthetic construct
  misc_feature 1..11: note = Description of Artificial Sequence: Synthetic oligonucleotide
  source 1..11: mol_type = other DNA
ygtaagtttyg

SEQ ID NO: 13754-13772 - skipped (19 entries)

SEQ ID NO: 13773 - DNA, 167 bp, synthetic construct
  misc_feature 1..167: note = Description of Artificial Sequence: Synthetic polynucleotide
  source 1..167: mol_type = other DNA
ygttattttttaagtyggtttgaaaagygtaatattygggtgggagtgattygattttttaggtgygtyggttatttttttttttgattyggaaagggaattttttgatttttggygttttttaggtgaggtaatgtttygttttgtttyggttygtttayggtgyg

SEQ ID NO: 13774-13776 - skipped (3 entries)

SEQ ID NO: 13777 - DNA, 185 bp, synthetic construct
  misc_feature 1..185: note = Description of Artificial Sequence: Synthetic polynucleotide
  source 1..185: mol_type = other DNA
yggtgtttatataygttgtttttaaaaaaatttgttttgtttaggtttgtgtgaatataaygtyggatgaattttgtttttttagaagaaagtygggttggtgtgttygatgaygtagygtttgtagtggygtttgataaagygtagggtttttayggagatttygtagttttggatatttagyg

SEQ ID NO: 13778 - DNA, 17 bp, synthetic construct
  misc_feature 1..17: note = Description of Artificial Sequence: Synthetic oligonucleotide
  source 1..17: mol_type = other DNA
ygttttgtttyggttyg

SEQ ID NO: 13779 - DNA, 135 bp, synthetic construct
  misc_feature 1..135: note = Description of Artificial Sequence: Synthetic polynucleotide
  source 1..135: mol_type = other DNA
ygtaatattygggtgggagtgattygattttttaggtgygttygttatttttttttttgattaggaaagggaattttttgatttttggygtttttygagtgaggtattgttttattttgtttyggttygygtayg

SEQ ID NO: 13780 - skipped

SEQ ID NO: 13781 - DNA, 71 bp, synthetic construct
  misc_feature 1..71: note = Description of Artificial Sequence: Synthetic oligonucleotide
  source 1..71: mol_type = other DNA
yggygggttgaagggttttttaagygyggttagagtgggtgttaaggtygaggaggygttaagagygagyg

SEQ ID NO: 13782 - DNA, 54 bp, synthetic construct
  misc_feature 1..54: note = Description of Artificial Sequence: Synthetic oligonucleotide
  source 1..54: mol_type = other DNA
ygttttttaagtgaggtaatgtttygttttgtttyggttygygtayggtgygyg

SEQ ID NO: 13783 - skipped

SEQ ID NO: 13784 - DNA, 29 bp, synthetic construct
  misc_feature 1..29: note = Description of Artificial Sequence: Synthetic oligonucleotide
  source 1..29: mol_type = other DNA
ygttttttttaygggtttaaaaatyggyg

SEQ ID NO: 13785 - DNA, 18 bp, synthetic construct
  misc_feature 1..18: note = Description of Artificial Sequence: Synthetic oligonucleotide
  source 1..18: mol_type = other DNA
ygtagatattagaaagyg

SEQ ID NO: 13786-13787 - skipped (2 entries)

SEQ ID NO: 13788 - DNA, 24 bp, synthetic construct
  misc_feature 1..24: note = Description of Artificial Sequence: Synthetic oligonucleotide
  source 1..24: mol_type = other DNA
ygagtttgygtaggaggygtttyg

SEQ ID NO: 13789-13800 - skipped (12 entries)

SEQ ID NO: 13801 - DNA, 12 bp, synthetic construct
  misc_feature 1..12: note = Description of Artificial Sequence: Synthetic oligonucleotide
  source 1..12: mol_type = other DNA
ygatttgtttyg

SEQ ID NO: 13802-13822 - skipped (21 entries)

SEQ ID NO: 13823 - DNA, 80 bp, synthetic construct
  misc_feature 1..80: note = Description of Artificial Sequence: Synthetic oligonucleotide
  source 1..80: mol_type = other DNA
ygtagyggaaggtttggagtagaggttgttttttygtttaagtattttttgggtgagtttatatttttggygygagtayg

SEQ ID NO: 13824-13844 - skipped (21 entries)

SEQ ID NO: 13845 - DNA, 3039 bp, synthetic construct
  misc_feature 1..3039: note = Description of Artificial Sequence: Synthetic polynucleotide
  source 1..3039: mol_type = other DNA
ygtaygattttgggtgtaagttagagattttataaataygtygggttttgygtagyggttttygggaaggtattgttattygtgggagggttyggttygttattttttattttttgttgttttaaygttattttttaagtttggygtttttttttttttttttggaggttttygtgttgttttggggtgttttttgtgggygagatatataatttgggtgtaagttagggatttygygattatttttggttyggygtaggggtggttatttttgggaygatattatttygttatttttttttttggattgtttttattattttttttaattttggygttttgtattttttttttagtggtttttttgtygttttgtggtgtttttygtgggtgagataygtattyggggtgtaagatagggattttaggaygttttygggtttattgtagaggttgttgggaaggtagtgtygttygtgagaggattttagtattttygtttttttttttyggggttgttttaatttttttttttaagattgaygtgttgtttttttttttygggaatttttttgttgttttgtggtgttygtygtgggtaagatatttattttgggtgtaagttagggaattaataattttygtatgttyggtaaaggggttgtyggtaaggtattgttattygtgggattattttagtttygttgtttttttttttaggttatttaaaygtttttatttaagtttggygttttgttgttttttygygggggattttttgttattttggggtgtttttygtgggygagataygtatattgtgtgtaagatagggatttygygattttttygggattggtataggggttgtagggaaggtattgttattygtgaaaggattttagtttygttttttttttttttgggttgttttaaygtttttttttaagtttggtattttgttttttttttttyggggtttttttgttgttttggggtgttattygtgggygaggtaygtattttgggtgtaaattagggattttaagatttttagggttaggygtaggggatgtygggaagttattgtttttygtggaaagtttttttttggattgttttaaagtttttttttaagtttggtattttgtttttttttttyggagttttttttgtagttttygygtgtatatttaggygagataygtattttgttgtaagatagggattttaaattttttygtttgggttaggtttaggggttgtygggaaggtattgtggtttgtgggaygattatagtttagtygttgtttttttttggttggtttaaygtttttttttaagtttgatatgttgtttttttttttygggggttttgttgttatttttaygtgtatttygtgagtaagataggtattttgggtttaagttaggggttttatygtttatttgggttttatttagaggttgtygggaaggtattgtttttagtggaaatttttttttyggattgttttaaygtttttttttaagttyggygttttgtttttttttattyggggattttttatygtattgyggtgtttatygtgggtaygataygtatttygggtgtaagttagggattttataattattttaggttygatgtaggggttatyggataagatattgttgtttttgggatgatatyggtttgttttaattttattttttaattttggagttttgtattttttttttgggggtttttttgttgttttgtggtgttattygtgggygagatatataatttgggagtaagttagagattttaygatatttttgggtttattgtagaggttgttaggaaggyggtgttattygtgggaggattttagttttattatttttatttyggggtygttttaattttttttttaagtttgaygtgtttttttttttttygggaatttatttgtygttttggggtgtttttttgagygagataygtattttgggtgtaagttayggattttaggattattttggtttagygaaggggttgttaggaaggtattgtygtttgtgggagaaatttagygtygtygtttttttttaygggttattttaaagtttttttttaagtttgaggtgttgttttttttttttaggggtttatttgtygttttggggtgttttttatgggygaaataygtattttgggtgtaagatagggattttaygattttttygggtttagygtagggattgttaggaaggtattgttattygtaggaggaattygattagtygtttttttttttgtgttgttttagtatttttattaaagtttggttttttgtggygttygttyggyggtttttttgttattttggggtgtttttatgggtgygattygtattttyggtgtaagttagggattttaygattatttygggtttgaygtaggggttgttgggaaggtattgtygtttatgggaygattttagtttgttaygttttttttyggattgttttaattattttttttaattttggygttttatatttttttttyggtggtttttttgtygttttgtggtgtttttygagggygagataygtattttgggtgtaagttaaggattttatgaygtttttaggtttattatagatgttgtygggaagatagtgttattygtggtaggattttagtattttttttttattttyggggttgttttaaygtttttttttaagtttgaygtgttgttttttttttttgggaatttatttgtygttttggggtgtttttygtggaattttgggtgtaagtttgggatataataattttttygggtttggtaaaggggttgtygggaaggtatygtggttygtgggaagtttttttttggattgttttaaagtttttttttaagtttggygttttgttttttttttagggggtatttttgtygttttggggtgttttttygtgggygygataygtattttgggtttaagttaggaattttaygataatttygagtttggyg

SEQ ID NO: 13846-13867 - skipped (22 entries)

SEQ ID NO: 13868 - DNA, 36 bp, synthetic construct
  misc_feature 1..36: note = Description of Artificial Sequence: Synthetic oligonucleotide
  source 1..36: mol_type = other DNA
tgtaggttagtgggtgtgtgtattttgtgtgagttg

SEQ ID NO: 13869-13889 - skipped (21 entries)

SEQ ID NO: 13890 - DNA, 181 bp, synthetic construct
  misc_feature 1..181: note = Description of Artificial Sequence: Synthetic polynucleotide
  source 1..181: mol_type = other DNA
tgatttttttgttttagttttttgagtagttgggattataggtatatgttattatgtttagttaatttttgtttgtttgtttatttatttattattatttttgagatggagttttgttttgttattaggttggagtgttattggagtgtaatggtatgattttggtttattgtaatttttg

SEQ ID NO: 13891-13900 - skipped (10 entries)

SEQ ID NO: 13901 - DNA, 369 bp, synthetic construct
  misc_feature 1..369: note = Description of Artificial Sequence: Synthetic polynucleotide
  source 1..369: mol_type = other DNA
tggggaggtttgggttgtataggagtgtatggtgggggtggaggtttaggtatggagggttgtaggttttgagttttgtttggtggggaggtagttaaggtttagtgagaagttgagtatagtagttgttggtttaggtgttaagttttttattgtttgggttggttggttgttttgagtgtggggtttgttaagtttatgtttatttggaatttgagttggtttgtaagtgtagtttgtagttatggtttttgtttatgtttttttttttatatttatttgtaagttgagggagttggttttagttttgtttagtttagaaaggggtttttatagtgtagtgatgggttgaagggttttttaaatgtg

SEQ ID NO: 13902-13922 - skipped (21 entries)

SEQ ID NO: 13923 - DNA, 35 bp, synthetic construct
  misc_feature 1..35: note = Description of Artificial Sequence: Synthetic oligonucleotide
  source 1..35: mol_type = other DNA
tggtagtaaatgaagttgaggtagtggtgtaagtg

SEQ ID NO: 13924-13933 - skipped (10 entries)

SEQ ID NO: 13934 - DNA, 487 bp, synthetic construct
  misc_feature 1..487: note = Description of Artificial Sequence: Synthetic polynucleotide
  source 1..487: mol_type = other DNA
tgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgtgagttttgttttgttttgtattaagtttgtattttttaggtttttggtatttttgtttttgggatgtggggtttttatagatttggaaatttttgtttgtttttttttatttagagtaaattgagatgtttataagagtttggaagttgtttttttttgggtttgaagttgtttggaggttggttttgtttttggtttttttgttatagggtaatgtatatattttttattgtatagtttttttgtttaaaattttgttgatttattttgttttttgttttttaaagtttttatttgtgtgttggatttttgttttgggtg

SEQ ID NO: 13935-13944 - skipped (10 entries)

SEQ ID NO: 13945 - DNA, 28 bp, synthetic construct
  misc_feature 1..28: note = Description of Artificial Sequence: Synthetic oligonucleotide
  source 1..28: mol_type = other DNA
tggattatgaggttaggagattaagatg

SEQ ID NO: 13946-13966 - skipped (21 entries)

SEQ ID NO: 13967 - DNA, 18 bp, synthetic construct
  misc_feature 1..18: note = Description of Artificial Sequence: Synthetic oligonucleotide
  source 1..18: mol_type = other DNA
tgtggttaggaaggtgtg

SEQ ID NO: 13968 - DNA, 18 bp, synthetic construct
  misc_feature 1..18: note = Description of Artificial Sequence: Synthetic oligonucleotide
  source 1..18: mol_type = other DNA
tgtatttattgatttgtg

SEQ ID NO: 13969-13978 - skipped (10 entries)

SEQ ID NO: 13979 - DNA, 87 bp, synthetic construct
  misc_feature 1..87: note = Description of Artificial Sequence: Synthetic oligonucleotide
  source 1..87: mol_type = other DNA
tgttatttatttatttgatttggaaagggaattttttgattttttgtgttttttaggtgaggtaatgttttgttttgttttggtttg

SEQ ID NO: 13980-13989 - skipped (10 entries)

SEQ ID NO: 13990 - DNA, 11 bp, synthetic construct
  misc_feature 1..11: note = Description of Artificial Sequence: Synthetic oligonucleotide
  source 1..11: mol_type = other DNA
tgtaagttttg

SEQ ID NO: 13991-14009 - skipped (19 entries)

SEQ ID NO: 14010 - DNA, 167 bp, synthetic construct
  misc_feature 1..167: note = Description of Artificial Sequence: Synthetic polynucleotide
  source 1..167: mol_type = other DNA
tgttattttttaagttggtttgaaaagtgtaatatttgggtgggagtgatttgattttttaggtgtgttggttatttttttttttgatttggaaagggaattttttgatttttggtgttttttaggtgaggtaatgttttgttttgttttggtttgtttatggtgtg

SEQ ID NO: 14011-14013 - skipped (3 entries)

SEQ ID NO: 14014 - DNA, 185 bp, synthetic construct
  misc_feature 1..185: note = Description of Artificial Sequence: Synthetic polynucleotide
  source 1..185: mol_type = other DNA
tggtgtttatatatgttgtttttaaaaaaatttgttttgtttaggtttgtgtgaatataatgttggatgaattttgtttttttagaagaaagttgggttggtgtgtttgatgatgtagtgtttgtagtggtgtttgataaagtgtagggtttttatggagattttgtagttttggatatttagtg

SEQ ID NO: 14015 - DNA, 17 bp, synthetic construct
  misc_feature 1..17: note = Description of Artificial Sequence: Synthetic oligonucleotide
  source 1..17: mol_type = other DNA
tgttttgttttggtttg

SEQ ID NO: 14016 - DNA, 135 bp, synthetic construct
  misc_feature 1..135: note = Description of Artificial Sequence: Synthetic polynucleotide
  source 1..135: mol_type = other DNA
tgtaatatttgggtgggagtgatttgattttttaggtgtgtttgttatttttttttttgattaggaaagggaattttttgatttttggtgttttttgagtgaggtattgttttattttgttttggtttgtgtatg

SEQ ID NO: 14017 - skipped

SEQ ID NO: 14018 - DNA, 71 bp, synthetic construct
  misc_feature 1..71: note = Description of Artificial Sequence: Synthetic oligonucleotide
  source 1..71: mol_type = other DNA
tggtgggttgaagggttttttaagtgtggttagagtgggtgttaaggttgaggaggtgttaagagtgagtg

SEQ ID NO: 14019 - DNA, 54 bp, synthetic construct
  misc_feature 1..54: note = Description of Artificial Sequence: Synthetic oligonucleotide
  source 1..54: mol_type = other DNA
tgttttttaagtgaggtaatgttttgttttgttttggtttgtgtatggtgtgtg

SEQ ID NO: 14020 - skipped

SEQ ID NO: 14021 - DNA, 29 bp, synthetic construct
  misc_feature 1..29: note = Description of Artificial Sequence: Synthetic oligonucleotide
  source 1..29: mol_type = other DNA
tgttttttttatgggtttaaaaattggtg

SEQ ID NO: 14022 - DNA, 18 bp, synthetic construct
  misc_feature 1..18: note = Description of Artificial Sequence: Synthetic oligonucleotide
  source 1..18: mol_type = other DNA
tgtagatattagaaagtg

SEQ ID NO: 14023-14024 - skipped (2 entries)

SEQ ID NO: 14025 - DNA, 24 bp, synthetic construct
  misc_feature 1..24: note = Description of Artificial Sequence: Synthetic oligonucleotide
  source 1..24: mol_type = other DNA
tgagtttgtgtaggaggtgttttg

SEQ ID NO: 14026-14037 - skipped (12 entries)

SEQ ID NO: 14038 - DNA, 12 bp, synthetic construct
  misc_feature 1..12: note = Description of Artificial Sequence: Synthetic oligonucleotide
  source 1..12: mol_type = other DNA
tgatttgttttg

SEQ ID NO: 14039-14059 - skipped (21 entries)

SEQ ID NO: 14060 - DNA, 80 bp, synthetic construct
  misc_feature 1..80: note = Description of Artificial Sequence: Synthetic oligonucleotide
  source 1..80: mol_type = other DNA
tgtagtggaaggtttggagtagaggttgtttttttgtttaagtattttttgggtgagtttatatttttggtgtgagtatg

SEQ ID NO: 14061-14081 - skipped (21 entries)

SEQ ID NO: 14082 - DNA, 3039 bp, synthetic construct
  misc_feature 1..3039: note = Description of Artificial Sequence: Synthetic polynucleotide
  source 1..3039: mol_type = other DNA
tgtatgattttgggtgtaagttagagattttataaatatgttgggttttgtgtagtggtttttgggaaggtattgttatttgtgggagggtttggtttgttattttttattttttgttgttttaatgttattttttaagtttggtgtttttttttttttttttggaggtttttgtgttgttttggggtgttttttgtgggtgagatatataatttgggtgtaagttagggattttgtgattatttttggtttggtgtaggggtggttatttttgggatgatattattttgttatttttttttttggattgtttttattattttttttaattttggtgttttgtattttttttttagtggtttttttgttgttttgtggtgttttttgtgggtgagatatgtatttggggtgtaagatagggattttaggatgtttttgggtttattgtagaggttgttgggaaggtagtgttgtttgtgagaggattttagtatttttgttttttttttttggggttgttttaatttttttttttaagattgatgtgttgttttttttttttgggaatttttttgttgttttgtggtgtttgttgtgggtaagatatttattttgggtgtaagttagggaattaataatttttgtatgtttggtaaaggggttgttggtaaggtattgttatttgtgggattattttagttttgttgtttttttttttaggttatttaaatgtttttatttaagtttggtgttttgttgtttttttgtgggggattttttgttattttggggtgttttttgtgggtgagatatgtatattgtgtgtaagatagggattttgtgatttttttgggattggtataggggttgtagggaaggtattgttatttgtgaaaggattttagttttgttttttttttttttgggttgttttaatgtttttttttaagtttggtattttgtttttttttttttggggtttttttgttgttttggggtgttatttgtgggtgaggtatgtattttgggtgtaaattagggattttaagatttttagggttaggtgtaggggatgttgggaagttattgttttttgtggaaagtttttttttggattgttttaaagtttttttttaagtttggtattttgttttttttttttggagttttttttgtagtttttgtgtgtatatttaggtgagatatgtattttgttgtaagatagggattttaaatttttttgtttgggttaggtttaggggttgttgggaaggtattgtggtttgtgggatgattatagtttagttgttgtttttttttggttggtttaatgtttttttttaagtttgatatgttgttttttttttttgggggttttgttgttatttttatgtgtattttgtgagtaagataggtattttgggtttaagttaggggttttattgtttatttgggttttatttagaggttgttgggaaggtattgtttttagtggaaattttttttttggattgttttaatgtttttttttaagtttggtgttttgtttttttttatttggggattttttattgtattgtggtgtttattgtgggtatgatatgtattttgggtgtaagttagggattttataattattttaggtttgatgtaggggttattggataagatattgttgtttttgggatgatattggtttgttttaattttattttttaattttggagttttgtattttttttttgggggtttttttgttgttttgtggtgttatttgtgggtgagatatataatttgggagtaagttagagattttatgatatttttgggtttattgtagaggttgttaggaaggtggtgttatttgtgggaggattttagttttattatttttattttggggttgttttaattttttttttaagtttgatgtgttttttttttttttgggaatttatttgttgttttggggtgtttttttgagtgagatatgtattttgggtgtaagttatggattttaggattattttggtttagtgaaggggttgttaggaaggtattgttgtttgtgggagaaatttagtgttgttgtttttttttatgggttattttaaagtttttttttaagtttgaggtgttgttttttttttttaggggtttatttgttgttttggggtgttttttatgggtgaaatatgtattttgggtgtaagatagggattttatgatttttttgggtttagtgtagggattgttaggaaggtattgttatttgtaggaggaatttgattagttgtttttttttttgtgttgttttagtatttttattaaagtttggttttttgtggtgtttgtttggtggtttttttgttattttggggtgtttttatgggtgtgatttgtatttttggtgtaagttagggattttatgattattttgggtttgatgtaggggttgttgggaaggtattgttgtttatgggatgattttagtttgttatgtttttttttggattgttttaattattttttttaattttggtgttttatattttttttttggtggtttttttgttgttttgtggtgttttttgagggtgagatatgtattttgggtgtaagttaaggattttatgatgtttttaggtttattatagatgttgttgggaagatagtgttatttgtggtaggattttagtattttttttttatttttggggttgttttaatgtttttttttaagtttgatgtgttgttttttttttttgggaatttatttgttgttttggggtgttttttgtggaattttgggtgtaagtttgggatataataatttttttgggtttggtaaaggggttgttgggaaggtattgtggtttgtgggaagtttttttttggattgttttaaagtttttttttaagtttggtgttttgttttttttttagggggtatttttgttgttttggggtgtttttttgtgggtgtgatatgtattttgggtttaagttaggaattttatgataattttgagtttggtg

SEQ ID NO: 14083-14092 - skipped (10 entries)

SEQ ID NO: 14093 - DNA, 201 bp, Homo sapiens
  source 1..201: mol_type = unassigned DNA
gagtgcagtggcgtgatctcggctcactgcaagctccgcctcccgggatcacgccattctcctgcctcagcctcccgagtggctgggacttacaggtgcccgccaacatgcccggctaattttctgtatttttagtagagacggggtttcaccgtgttagccaggatggtctcgatatcctgacctcgtgacccgcccacc

SEQ ID NO: 14094 - DNA, 208 bp, Homo sapiens
  source 1..208: mol_type = unassigned DNA
ctggctaacatgatgaaaccctgtctctactaaaaatataaaaaattagccgggcgtggtggcgggcgcctgtagtcccagctactcgggagactgaggccgaatggcgtgaacccgggaggcggagcttgcagtgagccgagatcacaccactgcactccagcctgggcgacagagcgagactctgtctcaaaaataaataaataaa

SEQ ID NO: 14095 - DNA, 201 bp, Homo sapiens
  source 1..201: mol_type = unassigned DNA
acacggtgaaaccccgtctctactaaagtacaaaaaattagccgggcatagtggcacaggcctttagccccagctacttgggaggctgaggtaggagaatcgcttgaacccgggaggcggagggtgcagtgagccactgcacgccagcctgggcaacagagccagactccgtctcaaaaaaaaaaaaaaaaaagaaagaaa

SEQ ID NO: 14096 - DNA, 201 bp, Homo sapiens
  source 1..201: mol_type = unassigned DNA
gccgaggtgggcgaatcacctgaggtcaggagttcaagaccagcctggtcaacatggtgaaaccccatctctactaaaaatacaaaaattaaccgggcatcgtggtgcgtgcctgtaatcccagctactcgggagactgaggcaggagaattgcttgaaccctgccggcagaggttgcaatgagctgagattgcaccacgg

SEQ ID NO: 14097 - DNA, 201 bp, Homo sapiens
  source 1..201: mol_type = unassigned DNA
ttctggaggtcatatttggacaggagccggttcttaacctcagccaagagtccacagaggggcctttgtttaactgcatggagctcatggctgacaggcgcggcggcaggacgggacgggaccggacgggctgtgtacctgtctttataccagtaccatactgttctgattactctagcttgtaagatgtttgaaacccac

SEQ ID NO: 14098 - DNA, 201 bp, Homo sapiens
  source 1..201: mol_type = unassigned DNA
aaaaccacaacaaagcctctgttcaaccacagattctgacccattggccaggcaggctgtttggcctctgatttgcacctagagggtccccggatcctggcgctgcgtgggtcagtgtctcgggagccggggaccggcactggccgtgctcggttgctgagtgtgcctcactaactatcattccgttcttccaggtcaatg

SEQ ID NO: 14099 - DNA, 201 bp, Homo sapiens
  source 1..201: mol_type = unassigned DNA
gaggccctctccatccaggtaaagaagaaagaaggatggctccaggagttcacataacatggccaaaggccgggcagcgtgcagcagaatgcaagatgagcggccaggttatagggcgagatcatgaaggattcttccccggccccaaatgttctttaagagtgtcctctcaccatccctcctctcatcccccaagaatag

SEQ ID NO: 14100 - DNA, 201 bp, Homo sapiens
  source 1..201: mol_type = unassigned DNA
ctcccaagtagctgggactacaggcgcccgccaccacgcccggctaatttttaatatttttagtagagacggggtttcactgtgttagccaggatggtctcgatctcctgacctcgtgatccgcccgcctcggcctcccaaagtgctgggattacaggcttgagccactgcgcccggccttcagttttcatatctgttaaa

SEQ ID NO: 14101 - DNA, 201 bp, Homo sapiens
  source 1..201: mol_type = unassigned DNA
ttaacacaaaaattagttgttttagccgggcgcggtggctcaagcctgtaatcccagcactttgggaggccgaggcgggcggatcacgaggtcaggagatcgagaccatcctggctaacacggtgaaaccccgtctctactaaaaacacacaaaaaatgagccgggcgcggtggcaggcgcctgtagtcccagctattcag

SEQ ID NO: 14102 - DNA, 201 bp, Homo sapiens
  source 1..201: mol_type = unassigned DNA
taaatcttgctgctgttcactctatgggtccacactgcctttatgagctgtaacactcaccgcaaaggtctgcaggttcactcctgagccggcaagaccacgaacccaccagaagaaactccgaacacatccgaacatcagaaggaacaaactccggacacgccacctttaagaactgtaacactcaccgcaagggtccgt

SEQ ID NO: 14103 - DNA, 201 bp, Homo sapiens
  source 1..201: mol_type = unassigned DNA
tcctgcctcagccttcccagtagctgggactacaggcgcccgccaccgcgcccggctaattttttgtatttttaatagaaacggggtttcaccgtggtctcgatctcctgacctcgtgatccgccgcccacctcggcctcccaaagtgctgggattacaggcgtgagccaccgcgcccggcctccttctttatttttaata

SEQ ID NO: 14104 - DNA, 201 bp, Homo sapiens
  source 1..201: mol_type = unassigned DNA
ggggtttcaccgtgttagccaggatggtctcgatctcctgaccttgtaatacgcccgcctcggccccccaaaatgctgggattacaggcgtgagccaccgcgcccagccggtttcacaggtatttatgtatatcaatagtttttttttgagacggagtctcgctctattcccaggctggagtgcaatggcgctgtcttgac

SEQ ID NO: 14105 - DNA, 235 bp, Homo sapiens
  source 1..235: mol_type = unassigned DNA
ccaattttccaggtgccgtctgtcacccctttctttgactaggaaagggaactccctgaccccttgtgcttccggagtgaggcaatgcctcgccctgcttcggctcacgcagggtgcgcgcacccactgacctgcgcccactgtctggcactccctagtgagatgaacccggtacctcagatggaaatgcagaaatcacccatcttctgcgtcgctctctctgggagctgtagac

SEQ ID NO: 14106 - DNA, 201 bp, Homo sapiens
  source 1..201: mol_type = unassigned DNA
ggtagataaagatacatgattagggccggccgcggtgactcatgcctgtaatcccagcactttgggaggccaaggcgaacggatcacgaagtcaggagatcgagaccatcctggctaacatggtgaaaccctgtctctactaaaaatacaaaaaattagccgagcgtggtggtgggcgcctgtagcgccagctactcgggg

SEQ ID NO: 14107 - DNA, 201 bp, Homo sapiens
  source 1..201: mol_type = unassigned DNA
caggtgatttctgcatttccatctgaggtaccgggttcatctcactagggagtgccagacagtgggcgcgggtcagtgggtgcgtgcaccatgcgcaagccgaagcagggcgaggcattgcctcacttgggaagcgcaaggggacagggagttccctttccgagtcaaaaaaaggggtgacagacgcacctggataatcag

SEQ ID NO: 14108 - DNA, 201 bp, Homo sapiens
  source 1..201: mol_type = unassigned DNA
agagacagaagctgctggagggcgagaggaacgcatcagtggaagaagacagaagcggctggtcacggagagcatgtcagcagaagaacacacctacagacgccggctcgcccgcgggctccccggcaggccatcgaccggtgggacgaggtggagtttgtcctgggcagtaggaggacagcccgggcacccagcggccca

SEQ ID NO: 14109 - DNA, 201 bp, Homo sapiens
  source 1..201: mol_type = unassigned DNA
cctacagaggcaggcaggcctccttgagctgtggtgggctccacccagttcgagcttcccggctgctttgtttacctaagcgagcctgggcaatggcgggcgcccctcccccagcctcgctgctgccttgcagtttgatctcagactgctgtgctagcaatcagcaagactcggtgggcataggaccctccgagccaggtg

SEQ ID NO: 14110 - DNA, 201 bp, Homo sapiens
  source 1..201: mol_type = unassigned DNA
gttccctttcctagtcaaagaaaggggtgacagaaggcacctggaaaatcgggtcactcccaccagaatactgcgcttttccgacgggcttaaaaaacggcgcacctggagattatatccggcacctggctcagagggtcctacgcccacagagtctcgctgattgctagcacagcagtctaagatcaaactgcaaggcgg

SEQ ID NO: 14111 - DNA, 201 bp, Homo sapiens
  source 1..201: mol_type = unassigned DNA
cgtccgtcacccctttctttgactcggaaagggaactccctgaccccttgtgcttcccaggtgaggcaatgcctcgccctgcttcggctcgcgcacggtgcgcgcacccactggcctgcgcccactgtctggcactcccttagtgagatgaacccggtacctcagatggaaatgcagaaatcacccgtcttctgcgtcgct

SEQ ID NO: 14112 - DNA, 201 bp, Homo sapiens
  source 1..201: mol_type = unassigned DNA
gcaagcaaggggcgtgtttcagctctgtttgtgttagagctctttcacctccaccatttggcaggttcagcgcccgggaacaatgacgtacgtggacaagcggagggtgagcaaggtgaagaggagctttactgagtaatagaacagctcagaggagactcgcggtgggtagctcctctctgcagccagggtgtcctgatg

SEQ ID NO: 14113 - DNA, 201 bp, Homo sapiens
  source 1..201: mol_type = unassigned DNA
ggcagatcacctgaggtcaggagttcgagaccagcctggccaacatggtgaaaccccgtctctactaaaaatacaaatatcagccgggcgtggtggtggtcgcctgtaatctcagctactcgggaggctgaggcaggagaattgctggatcccgggaggcagatgttgcagtgagccaagatcatgccattgcactccagc

SEQ ID NO: 14114 - DNA, 201 bp, Homo sapiens
  source 1..201: mol_type = unassigned DNA
ctgtagtatataccaccacccccctagtataccaccacccctcaacccggcccccaccgctaacaaagctgccggctgcaggaatgagagagtggtagaacgacacccccgtctcactccttgggactcctcagttgctggcggctccaagttttcaggagccacggtgttcccctcttccagatgctagtgccaacagtg

SEQ ID NO: 14115 - DNA, 201 bp, Homo sapiens
  source 1..201: mol_type = unassigned DNA
ggccagaagacggtgagtggaaagcccgggcgcgtggagagaccccaagaaggggctgttcagctgtgaatcctgcatttgccgttcgtgtttcatctggcggttttgaaaccaggttttcatctggacctctgtgagctgcatatccccggccagccacttccgctccagagggcccagatactggtagtgccggaagac

SEQ ID NO: 14116 - DNA, 207 bp, Homo sapiens
  source 1..207: mol_type = unassigned DNA
gctcctgtgacccctgcagccagcgaaccagcacatccttggggctgaagccacgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggt

SEQ ID NO: 14117 - DNA, 201 bp, Homo sapiens
  source 1..201: mol_type = unassigned DNA
cccatggggcagccagaagggagatggttttcccctggagttggggtgctcggcagccccggctctcccctgactgcccaggccaacctccgcctcctcccgctggtccacggcctactggcttccgggtgcctgtcagcgtgtccttctgctggggtgctcctatggatgaccagcgcttgtgtcttcttcccctgatgt

SEQ ID NO: 14118 - DNA, 201 bp, Homo sapiens
  source 1..201: mol_type = unassigned DNA
gaagacgggtgatttctgcatttccatctgaggtaccggtttcatctcactagggagtgccagacagtgggcgcaggtcagtgggtgcgtgcaccgtgcgcgaagcagggcgaggcactgcctcacttgggaagcgcaaggggtcagggagttccctttccgagtcaaagaaaggggtgacggacgcacctggaaaatcgg

SEQ ID NO: 14119 - DNA, 201 bp, Homo sapiens
  source 1..201: mol_type = unassigned DNA
ggggcgtggcctcctggagggaaccagtgtggagatgcccgtgtgcctggggcgtggcctcccggagggagtcagtgtggagatgcccgtgtgcctggggcgtggcctactagagggagtcagtgtggagatgcccgtgtgcctggggcgtggcctcctggagggaaccagtgcggagatgtcggtgtgcctggggcgtgg

SEQ ID NO: 14120 - DNA, 201 bp, Homo sapiens
  source 1..201: mol_type = unassigned DNA
gacgctcctcacctcccagatggggtggtggcggggcagagacactcctcagttcccagatggggtcgcggcctggcagaggtgctccccacatcccagacgatgggtggccgggcagagacgctcctcacttcctagacgggatgacggccaggaagaggcgctcctcacttcccagactgggcggccgggcagaggggc

SEQ ID NO: 14121 - DNA, 201 bp, Homo sapiens
  source 1..201: mol_type = unassigned DNA
gagcacagcgccggcgggctggcactgctgggggactcggcgcaccctccacagctgctgtcccgggtggtaagcccctcactgcccggggctggtggggcggccagctgctcggagtgtggggcccgccaaggccatgtccacccagaacttgctctggcctaccgcgagcagccccagttcccgccccgcgtctccctc

SEQ ID NO: 14122 - DNA, 201 bp, Homo sapiens
  source 1..201: mol_type = unassigned DNA
ctcctgagtagctggggctacaggtgcccaccaccacgcccggctaattttttgtattttcagtagagatggggtttcaccgtgttagccaggatggtctcgatctcctgacgttgtgatccaccgcctcggcctcccgaaatgctgggattacaggcctgagccaccgcacccggccatatttatttatttttaatcaga

SEQ ID NO: 14123 - DNA, 201 bp, Homo sapiens
  source 1..201: mol_type = unassigned DNA
ccccctcctcccccgactggccccgcccccactgccggccccgcccccactgccggcccgggccccacccacgccggagctgctccatttaaggagattgcgcagctggaaagctacacgtgtgagcctagaggcgggtcccggttgcagacttgccatggcctccgaagcttctgtgcgtctaggggtgccccctggccg

SEQ ID NO: 14124 - DNA, 201 bp, Homo sapiens
  source 1..201: mol_type = unassigned DNA
gttagttagttattttgagatggagtcttgctctgtcgttcaggctgtagtgcagaaccgctctcttggttcactgcaacctccaccttccgggttcaagcgataatcctgcctcagcctcccaagtagctggaattacagacgtgcactaccacgcccaactaatttttgtatttttagtagagatggggtttcgccata

SEQ ID NO: 14125 - DNA, 201 bp, Homo sapiens
  source 1..201: mol_type = unassigned DNA
gcggtctcctctgacccagatcgtcttcaaatatcgaacgctgaattgggccgggcgcggtggctcccacctgtcatcccagcactttgggaggccgaggcgggcggattatgaggtcaggagatcgagaccatcctggctaacacggtgaaaccccgtctctactaaaaatacaaaaaaaaaaaattagccgggcgtgat

SEQ ID NO: 14126 - DNA, 201 bp, Homo sapiens
  source 1..201: mol_type = unassigned DNA
ctacctttgtctctcaccctgggggtttcatgaccccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgct

SEQ ID NO: 14127 - DNA, 380 bp, Homo sapiens
  source 1..380: mol_type = unassigned DNA
ctctactaaaatacaaaaaattggctgggggtggtggcacgtgcctgtagtcccagttacacgggaggctgaagcaggggaattgcttgaacccgggaggcggagattgcagtgagccgagatcgtgccattgcactccaatggcactccagcctgatgacagagcgagactccgtctcaaaaataataataaataaataaacaaacaaacaaaaattagctgggcgtggtggcgtgtgcctgtagtcccagctactcgggagactgaggcaggagaatcgcgggaacccgggaggcggaggttgcagtgagccgagaccgcgccactgccctgcagcatggagacagagctagactccgtctaaaaaaaaaaaaaaaaa

SEQ ID NO: 14128 - DNA, 201 bp, Homo sapiens
  source 1..201: mol_type = unassigned DNA
aggcgggcggatcacgaggtcaggagatcgagaccatcctggctaatacggtgaaaccccgtctctactaaaaatacaaaaaattagctgggcgtggcggcgggcacctctagtcccagctacttgggaggctgaggcaggagaatggcgtgaacccgggaggcggagcttgcagtgagccgagatcgcgccattgcactc

SEQ ID NO: 14129 - DNA, 201 bp, Homo sapiens
  source 1..201: mol_type = unassigned DNA
aaaaactagcccggcgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtg

SEQ ID NO: 14130 - DNA, 201 bp, Homo sapiens
  source 1..201: mol_type = unassigned DNA
acggcgaactgcggcgactgtgacgtgctcccccaccctctccccggtggacccttcctatttgccttcctcccaacccccaacaagcccccaccaccgacgacgtgagacgacgacggcatgggaccttccaccccgccagggccaatgaaccccacaccatgagctgcatgaggcatgagggagcccccaagggaggaa

SEQ ID NO: 14131 - DNA, 201 bp, Homo sapiens
  source 1..201: mol_type = unassigned DNA
gacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctgga

SEQ ID NO: 14132 - DNA, 201 bp, Homo sapiens
  source 1..201: mol_type = unassigned DNA
caaataattagggataaagagtatcatactgccgaacccattttatctttaattttttttttaaattttttacaaaaaattagccgggtgtggtggcgggcgcctgtagtctcagctactcagagactgaggcaggagaatggcgtgaacccgggaggaggagcttgcagtaagcggagatcgcgccactgcactacagcc

SEQ ID NO: 14133 - DNA, 201 bp, Homo sapiens
  source 1..201: mol_type = unassigned DNA
atctctgtgacccacaccctattcgtacactccctccccttttgaaaatccctaataaaaacttgctggttttacggctcaggggcatcacagaacctaccgacatgtgatgtctcccccggatgcccggctttaaaatttccctcttttgtactctgtccctttatttctcaacctggccgacgcttagggaaaacagaa

SEQ ID NO: 14134 - DNA, 201 bp, Homo sapiens
  source 1..201: mol_type = unassigned DNA
ctttggcgaactcttattgttataatcttaaaaacccggcccagggaggagcttattctccattttctatacaggcgacatatgtagaaacataatccgccgctgtgcctgtgcggccaggactccctctctacacgcaatgattcagctgaccagcccaagacatgctcggttttcacgcctgtttgtaggggcactgct

SEQ ID NO: 14135 - DNA, 201 bp, Homo sapiens
  source 1..201: mol_type = unassigned DNA
ttgggagtagaggtctttcggaaggcaccatctccagagcgtgtttctgagtaactctgaggatgggttccgggttatcactgtgtgttggaaacagcagcgcccaggctgccggaggaggctggtctccctggcaggtcctggctgtgtctagagttttgtgggtcctggagataaggctccggtttgaggcccctgggg

SEQ ID NO: 14136 - DNA, 201 bp, Homo sapiens
  source 1..201: mol_type = unassigned DNA
gcctgagcaggacaaggaccctagagtccaagagaatcctgatgatcagagaagggtccccgaggtcaccggggatgcacggtctgcatttcggcccctgcgggacaatggaggcctctctctccctttgtgcccgggcccgggcctctgcagacagacctccatacccagaggtgagaaatcagatataaccagacatcc

SEQ ID NO: 14137 - DNA, 201 bp, Homo sapiens
  source 1..201: mol_type = unassigned DNA
tcacatgctaggtcacaaaacaagtcttcagaaatttaagaagattgaaatcatatcaaccatctcttaaaaaaaataggtggccgggcgcggtggctcacgcctgtaatcccagcactttgggaggccgagacgggcggatcacgaggtcaggagatcgagaccatcctggctaacacggtgaaaccccgtctctactaa

SEQ ID NO: 14138 - DNA, 568 bp, Homo sapiens
  source 1..568: mol_type = unassigned DNA
ttagtatacagacacaaaaatgagaggtgacagcgtgctggcagccctcacagccctcgctccctctcggcacctcctcggccttggcgcccactctggccgcgtttgaggagcccttcagcccgtcgctgcactgtgggagcccctttctgggctggacaaggctggagccggctccctcagcttgcgggtaggtgtggagagagaggcgtgggcgggaaccgtggctgcaggctgcgcttgcgggccagctcgagttccgggtgggcgtgggcttggcaagccccgcactcggagcggccagccggcccgggcagtgaggagcttagcacctgggccagcagctgctgtgctcgacttctcgctgggccttagctgcctccccgccgggcagggctcgggacctgcagccctccatgcctgagcctccacccccgccgtgcgctcctgtgcagcccaagcctccccgacgagcgccaacccctgttccacggcgcccagtcccatcgactgcccaagggctgaggagtgcgggcacacggcgccggactggcaggcagctccacct

SEQ ID NO: 14139 - DNA, 201 bp, Homo sapiens
  source 1..201: mol_type = unassigned DNA
tctactaaaaatacaaaaaattagctgggcatcatggtgggtgcctgtagtcccagctactcgggaggctgaggcaggagaatggcgtgaacccgggaggcggagcttgcagtgagcggagatcgcgccgctgcactccagcctgggcgacagagcacgagtccgtctcaaaaaaagaaaaaaaagaaagaaaagaaaaga

SEQ ID NO: 14140 - DNA, 201 bp, Homo sapiens
  source 1..201: mol_type = unassigned DNA
gggctggccaaggccggagttggctccctctgcttgcggggaggtgtggagggagaggcgcaggtgggaaccagggctgtgtggggcgcttgtgggcaagcgtgagttccgggtgggagcgggctcggcaaacccattccagggtgccctgcccttcacaaagaaaactctccctggggctcccatgggcttctctgggat

SEQ ID NO: 14141 - DNA, 201 bp, Homo sapiens
  source 1..201: mol_type = unassigned DNA
tcccaagtagctgggactacaggcacccgccaccatgcctggctaattttttgtattttttagtacagatggggtttcatcgtgttaaccaggatggtctcgatctcctgacctcgtgatctgcccgccttggcctctcaaagtgccgggattacaggcgtgagccaccgtgcccagccatataccacattttctttatcc

SEQ ID NO: 14142 - DNA, 201 bp, Homo sapiens
  source 1..201: mol_type = unassigned DNA
aaccatggggtgaactttgttatggggacatgcacctggggggaaggttgtgatgggaggggcacccgggtcaaacacgggcggttgttagtgaagagcccgcaagacagagtaggagtcagggggaacagggagggaggggcatttttttctttcttttttgagacggagtctcactctgtcccccaggctggagtgcag

SEQ ID NO: 14143 - DNA, 201 bp, Homo sapiens
  source 1..201: mol_type = unassigned DNA
cacaggagcacaaaagggctggcggccttgcccgggtacactgttcgtcttctcacctactcgtgcacctcagtttatcatccctgagctgggcgtagcacgtggttcagagaacgggaagggacctacgagtgcctgacacacataatcactgctgctggtgattacccttatccatgagtggcgcatggatggggctag

SEQ ID NO: 14144 - DNA, 201 bp, Homo sapiens
  source 1..201: mol_type = unassigned DNA
caaaggtctgcttctgcatttaagcatctgagccctcaagagttagctcccgggctcctctggagcaaggttccgcccggtcccacgtacctgcctcgtccgccgtgatggtgagctcgttgctgggctcgctcttgccaatccggttcttggcgtacatgcggatgctgtaggtggaggaagggtggatatcaatgatgg

SEQ ID NO: 14145 - DNA, 201 bp, Homo sapiens
  source 1..201: mol_type = unassigned DNA
cttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgc

SEQ ID NO: 14146 - DNA, 201 bp, Homo sapiens
  source 1..201: mol_type = unassigned DNA
ctcggcgtcggcatccaccagcgtggttagcttggccgaagcctcgcggaagggcgggatcaggcgccgcatcgtcgtgtccagggactggaattggcgccgcccgtaggtcatgaggcccaccatggagcccagcgccgcaccctgcgagaggggtggatgtgggggtcgcagggaccccagacggcccgggaccgaccc

SEQ ID NO: 14147 - DNA, 201 bp, Homo sapiens
  source 1..201: mol_type = unassigned DNA
tggtcaccttgggagcctgctgctgatgaactgcagcatggccatctgggccgtccatcctgcatggtcacgctgtccggccactgctgcaggtacgtcccgccccgctcaatttcctggctggtggggtcatccgggtgtctgtacacgatcttctctgagagggtcagaggccggttcaatcatttgcaaacaatgtta

SEQ ID NO: 14148 - DNA, 201 bp, Homo sapiens
  source 1..201: mol_type = unassigned DNA
ccagcacacaggacacccatgcgtgtttatcatccggcacacgggagacccacgcgtgtttactgtcgggcacaggggagacccacgcgtgtttactgttcggcacacgagagacccacgcgtgtttaccgtttggcacagggagacccacgcgtgtttactgtccggcacaggggagacccacgcgtgtttactgtccgg

SEQ ID NO: 14149 - DNA, 201 bp, Homo sapiens
  source 1..201: mol_type = unassigned DNA
aggggaacagcaatagaagctccacttatcaggtacctactgtgtgtcaagcattgtgccaagggcttcatagaataatagcataagaatctcggccgggcgcagtggctcactcctgtaatcccagcactttgggaggccgaggtgggtggatcacgaggtcaggagttagagagaccagcctagccaacatggtgaaac

SEQ ID NO: 14150 - DNA, 201 bp, Homo sapiens
  source 1..201: mol_type = unassigned DNA
tgcacgcaccgtgcgcgagccgaagcagggcgaggcattgcctcactcgggaagcacgaggggtcagggagttcccattcctagtcaaagaaaggggtgacggacgcacctggaaaatcgggtcactcccacccgaatactgcgcttttccggcgggcttaaaaaacggcgcaccacgagactatatcccacacctggctc

SEQ ID NO: 14151 - DNA, 201 bp, Homo sapiens
  source 1..201: mol_type = unassigned DNA
gcccgccaccacgcccggagaattttttgtatttttagtggagacaggttttcaccatgttagccaggatggtctcgatctcctgacctcgtgatctgcccgcctcggcctcgcaaagtgctgggattataggcgtgaggcacagcgcccggtcccgactgctctatttaaagtaatgaaagcacagttggctccaaagga

SEQ ID NO: 14152 - DNA, 201 bp, Homo sapiens
  source 1..201: mol_type = unassigned DNA
cctgcggtcagctggaccaggtggccggcagcgagacggaacaagtagaccaggctgagggtgaaggcgcaggcgatcagcagcatggacaagaggttgccgcctgccacctcctccatcgcctggcccagcacctacccacccgcctgtagcaagcccagcagcatcatcccggccgccgccgccatttcactctgtcgg

SEQ ID NO: 14153 - DNA, 201 bp, Homo sapiens
  source 1..201: mol_type = unassigned DNA
ccagactgctttttttttgagacagagtctcgctctgtcacccaggctagagtgcggaggcgcgatctcagctcactgcaagctccgcctcccgggttcacgccattctcctgcctcagctttgcgagtagctgggactacaggcgcctgccaccgcgccggctaatttttttggtatttttagtagagacagggtttcac

SEQ ID NO: 14154 - DNA, 201 bp, Homo sapiens
  source 1..201: mol_type = unassigned DNA
acagtctactaaaaatacaaaaaaaaaaaaaaaaaaatttgccgggtgtggtggtgtgtgcctgtaattccagccacttgggaggctgaggcaagagaatcgactgaacccgggaggcagagattgcagtgagcccagatcatgctactgcactccagcctggataagagtgagactccatctcaaaaacaaaaataaaaa

SEQ ID NO: 14155 - DNA, 201 bp, Homo sapiens
  source 1..201: mol_type = unassigned DNA
tgtttttttttgttttgagatggagtctcactctattgcccaggctggagtgcagtggtgccatcttggctcactgcaacctccacctcccgggttctagcgattctcctgcctcagcctcccaagtagctgggattgcaggtgctcacaaccacgcccggctaatttttgtgtttttagcagagtcggagtttcaccatg

SEQ ID NO: 14156 - DNA, 201 bp, Homo sapiens
  source 1..201: mol_type = unassigned DNA
tgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcaggt

SEQ ID NO: 14157 - DNA, 201 bp, Homo sapiens
  source 1..201: mol_type = unassigned DNA
gccaaggtgggcggatcacttgaggtcaggagttcgagaccagcctggccaacatggtgaaaccccatctctactaaaaatatggaaaaaattagccgggcggggctcgagcctgtaatcccagctacttgggagctgaggcgcgagaatcgcttgaagccgggagggggaggttgcaggagcagaggttgtgccactgca

SEQ ID NO: 14158 - DNA, 201 bp, Homo sapiens
  source 1..201: mol_type = unassigned DNA
ggtctgtatggtgcgtgattatcctcagtggaagtttcaacatgggtgtggctcagctttttagggtcccccaaggcagaggtggcccgggcccctgcagcgatctcacaacacacttcaactgcagacggtggagactgcgggctgtcctccggctcaagcggccctggggcccccgtcctgcgcggagccacccgtgtt

SEQ ID NO: 14159 - DNA, 201 bp, Homo sapiens
  source 1..201: mol_type = unassigned DNA
gcgttttgggttactgagagaagtgaaacactgcagatacggcagaggtgtttctcccctccctccgcccctagatgtggccttcacacgcaggctgatgcgctcccttcccatccacgcctgctcggttttgccacatatgccgctgtgctgccggccttgaatgtgtatgagcggctcgtgctggggtcagcggaggct

SEQ ID NO: 14160 - DNA, 234 bp, Homo sapiens
  source 1..234: mol_type = unassigned DNA
aggggctacactcatggatccccttctccttggcaggaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcaggg

SEQ ID NO: 14161 - DNA, 201 bp, Homo sapiens
  source 1..201: mol_type = unassigned DNA
ggggtcccttgtctccagcatcgccagcccaggtgtgttcctcatggcgtgatgcgtctgtagacttggaaacatcacaggacccaggtacttcacggagcgctcgctctgtgtcagccccagctcagcgcctcccagacaccgtctgacttcccggaggcagtcatcgacattgcgcccactgcacagatgagaaagctg

SEQ ID NO: 14162 - DNA, 201 bp, Homo sapiens
  source 1..201: mol_type = unassigned DNA
tccctagtgagatgaacccggtacctcagatggaaatgcagaaatcacccgtcttctgcgtcgctcacgctgggagctgtagaccggagctgttcctattcggccatcttggctcctccctcctgttttttttttgagacagtgtttcttttcacttctgtcacccaggctgcagtgcagtggcgcggtctgtgctcactg

SEQ ID NO: 14163 - DNA, 201 bp, Homo sapiens
  source 1..201: mol_type = unassigned DNA
taattttattttgtttttgagacagagtctcgctctgtcgcccaggctggagtgcagtggcgcaatctcggctcactgcaagctccgcctcccgggttcacgccattcgcctgcctcagcctcctgaataactgggactacaggcgtccgccaccacgcccggctaaatttttgtatttttagtagagacggggtttcatc

SEQ ID NO: 14164 - DNA, 201 bp, Homo sapiens
  source 1..201: mol_type = unassigned DNA
atccctagggctgcggatggcagaactaaaagagctaattagcaagtagaatcgccccttccggggcttcaaggtctgagcacccctcttggggtgccaccgcattcccttcggggtgacatgcctggtccagctgcaagccctgcctagaacctgcctgtgtaccggtgcttggaacagccagctggaccccacactcac

SEQ ID NO: 14165 - DNA, 201 bp, Homo sapiens
  source 1..201: mol_type = unassigned DNA
ggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcac

SEQ ID NO: 14166 - DNA, 201 bp, Homo sapiens
  source 1..201: mol_type = unassigned DNA
cacacacaggcgtggacactcacatggctcccggcagtgctgcaggaggtcagcacagagacgtgctgaggagcctgagatgctcgctcctctgggccatcgcgtgtaaaggctgccctcgctgtggactctcacatgtgtgacatacatgaacaggcgaaacggacacgcacggcccccacacacgtgagctgggtcccc

SEQ ID NO: 14167 - DNA, 201 bp, Homo sapiens
  source 1..201: mol_type = unassigned DNA
cccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatgga

SEQ ID NO: 14168 - DNA, 201 bp, Homo sapiens
  source 1..201: mol_type = unassigned DNA
gctgggcgtggtggcacgtgcctgcagtctcagctactcaggaggctgaggcaggagaatcccttgaacccgggacgcagaggttgcagtgagctgagatcgcgccactgcactccagcctggcaacagagtgagactccggctcaaaaaaaaaaaaaaagaaaaaaaaaaaaaaaagaaggagttgaggctttaagaact

SEQ ID NO: 14169 - DNA, 201 bp, Homo sapiens
  source 1..201: mol_type = unassigned DNA
ttgcactctgtgggtaggggacactcttctcagtggctggtgatgactgtgatcccacttgtcgagctctgtgggagtcccggcagtcctccgcaactgtcggctggttgttactgtctcagcgcctgccttctgattggttagcaaactacggtggtagacagaaaaaagatagccttcctttttagggctgtcctacaa

SEQ ID NO: 14170 - DNA, 201 bp, Homo sapiens
  source 1..201: mol_type = unassigned DNA
ccctgctggcgcaccctgctggcgcaccctgctggcgcaccctgctggcgcaccctgctggcgcaccctgctggcgcaccctgctggcgcaccctgctggcgcaagttgcgccttgggactgggcctgaaaagggaggagttattcatcttaagctttcaggcccggggagaatcttacagtaagccctctgggagtttga

SEQ ID NO: 14171 - DNA, 686 bp, Homo sapiens
  source 1..686: mol_type = unassigned DNA
gtggcacctgcaggctcccaggaccaggcagaggacccagcctccccaggactggggccccggcgctgcgctccaggggaggccgacgggggctgggaggcgcccagggcgggaatccagcgcacgggtgaggactttaaaaagcaaggggcaggatgagtcaacaaggttttgagcaggaaaactatgcgataggaagtgtatacattgccctatagcagaaagaccggggacgggaccagcctccaagcgacttcaaacccaaaaggaagcaacttccagactcttatgggcgtctcaatttgctctgggtgaaggaagacaggcaagaatttccaggtctgtgaggaccccacgtcccagggacagaagtgccagggacctgggaagtgcagacttaatacaaggcagagcaaaactcacgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcggggccgggaccagacctgtgcatctctccgcctcgcacccagcgcctctgtttttcgggtgtttggaggtgagagcggccaggaaggctgaggcatgat

SEQ ID NO: 14172 - DNA, 201 bp, Homo sapiens
  source 1..201: mol_type = unassigned DNA
gctagagtgcagtggtgcgatctcggctcactgcaagctccgcctcccgggttcacgccattctcctgcctcagcctccccagcagctgggacaggggcacgccgccacgcccggctagtttttgtatttttagtagagacggggtttcaccatattagccaggacggtctcgatctcctgacctcgtgatctgccagcct

SEQ ID NO: 14173 - DNA, 201 bp, Homo sapiens
  source 1..201: mol_type = unassigned DNA
gccagagaccctgtctctaaaagcaaaaaagaaaaaaaaagcccttttccaagttattacacactctgaataattaatattgaaaactgttggccgggcgcggtggctcacgcctgtaatcccagcactttgggaggccgaggcggggcggatcacgagatcagcagaacggcgtgaacccggaaggcggagcttgcagtg

SEQ ID NO: 14174 - DNA, 201 bp, Homo sapiens
  source 1..201: mol_type = unassigned DNA
ctgcatttccatctgaggtaccgggttcatctcactagggagtgccagacagtgggcgcaggtcagtgggtgcgtgcaccgtgtgcgagccgaagcagggcgaggcactgcctcacttgggaagcgcaaggggtcagggagttccctttctgagtcaaagaaaggggtgacggacgcaccttgaaaatcgggtcactccca

SEQ ID NO: 14175 - DNA, 201 bp, Homo sapiens
  source 1..201: mol_type = unassigned DNA
acgcacccactgacctgcgcccactgtctggcagtccctagtgagatgaacccggtacctcagttggaaatgcagaaatcaccatcttctgtgtcgctcacgctgggagctgtagaccggagctgttcctattcggccatgttggctcctcccccggatataaccattcttgtacttatttaattttcatttttatggaat

SEQ ID NO: 14176 - DNA, 201 bp, Homo sapiens
  source 1..201: mol_type = unassigned DNA
ttttcatgtgactactgcctgcctgtcagcgctagcctcttctgactctaaattacaagtggaagaaagcacgttagaaacccacagaactggcccggcgcggtggttcaggtctgtaatcccagcactttgggaggccgaggcaggcggaccacgaggtcaggagatcgagaccatcctggctaacagggtgaaaccccg

SEQ ID NO: 14177 - DNA, 201 bp, Homo sapiens
  source 1..201: mol_type = unassigned DNA
aagtcttttttttttttttttttttttttttttgagacggagtctcactctttcgcccaagctggactgcagtggcgctatcccggctcactgcaagctccgcctcttgggttcatgccattcttctgcctcagcctcccgagtagctgggattacaggcgcccaccaccacgcccggctaattttttgtatttttagtag

SEQ ID NO: 14178 - DNA, 201 bp, Homo sapiens
  source 1..201: mol_type = unassigned DNA
cgcctggtgcatgctgtggagggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccgccttccccctccccaccctcaccaccctcc

SEQ ID NO: 14179 - DNA, 201 bp, Homo sapiens
  source 1..201: mol_type = unassigned DNA
gactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtag

SEQ ID NO: 14180 - DNA, 201 bp, Homo sapiens
  source 1..201: mol_type = unassigned DNA
ggcactttatttatttagagacagagtctcgctgcgacgcccaggttggagtgcatggcgcaatcttggctcactgcaggctccgcctcccgggttccagcgattctcctgcctcagcctcccgagtagctggggttacagttatgtgccaccacgccgggctaatttttgtatttttagtagagacagggtttccccata

SEQ ID NO: 14181 - DNA, 201 bp, Homo sapiens
  source 1..201: mol_type = unassigned DNA
ccaccatgcccaactaattttttctatttgtagtagagacagggtttcactgtgttagccaggatggtctcgatctcctgaccttgtgatccgcgtgtctcggcctcccaaagtgctgggattacaggcgtgagctaccgcgcccggcttgtaaatattttctgcgcttcagtgggccatgtcttcactttgttgattgct

SEQ ID NO: 14182 - DNA, 227 bp, Homo sapiens
  source 1..227: mol_type = unassigned DNA
tcagcctcctgagtagctggaactacaggtgcccgccaccacgcccggcttattttctgtatttttagtagagacggggtttcaccatgttagccaggatcgtcttgatctcctgacctcgtgatccgccggcctcggcctcccaaagtgctgggattacaggcgtgagccaccacgcccagccctagaaattgaaatgcatattattaagtgaaagaagccaatct

SEQ ID NO: 14183 - DNA, 201 bp, Homo sapiens
  source 1..201: mol_type = unassigned DNA
ccctcccccagccttgctgccaccttgcagtttgatctcagactgctgtgctagcaatcagcgagactccgagccaggtgtgggatataatctcgtggtgcgccgttttttaagccggtcggaaaagcgcaatattcgggtgggagtgacccgattttccaggtgcgtccgtcacccctttctttgactcggaaagggaac

SEQ ID NO: 14184 - DNA, 201 bp, Homo sapiens
  source 1..201: mol_type = unassigned DNA
aggtgcgtctgtcacccctttctttgactcggaaagggaactccctgaccccttgcgcttcccaagtgaggcaatgcctctccctgcttcggctcgcgcacggtgcatgcccccactgacctgcgcccactgtctggctctcccaagtgagatgaacccggtacctcagatggaaatgcagaaatcacccgtcttctgcgt

SEQ ID NO: 14185 - DNA, 201 bp, Homo sapiens
  source 1..201: mol_type = unassigned DNA
tgcctttttgtttcagtgctcatactgtaaaaaagtgtcctttccaccgggcgcggtggctcacgcctgtaatcccagcactttgggaggcagaggcgggcggatcacgaggtcaggagatcgaaaccatcctggctaacacggtgaaaccccgtctgtactgtgaatacaaaaaattagccgggcgtggtggcgggtgcc

SEQ ID NO: 14186 - DNA, 201 bp, Homo sapiens
  source 1..201: mol_type = unassigned DNA
gccgggcgtggtggcgggcacctgtagtcccagctactcgggaggctgaggcaggagaatggggtgaacccgggaggcggagcttgcagtgagccgagatcgcgccactgcactccagcctgggtgacagagcgagactccatttcaaaaaaaaacaatactaggattgaagtttgcttcctaacttccagtgacacggtt

SEQ ID NO: 14187 - DNA, 201 bp, Homo sapiens
  source 1..201: mol_type = unassigned DNA
tgaacaagaaagggccattacattttattctgaaatggcccctggagaaagaatggaagcaaattgcacaagtgggcgtccatctccttccacccggccacggtcaccgtggtgctcggccaggctcctggtgacgtgaggcaaatctctccgctggcaaaccagcccacacactccctccattgcagacggtcacccaga

SEQ ID NO: 14188 - DNA, 201 bp, Homo sapiens
  source 1..201: mol_type = unassigned DNA
ctaagcaccttcctgtgacccgctcagaggaacccctggcagtggggatggcgtcacccccatttgagagatgaggagactgaggctcagaggggggacgcggcttgcccgagtcacactgattgagaggggcagacctggattcgtctgcagcccaagctcttagagaccccggtgtggcctgccgggcagccagcttgt

SEQ ID NO: 14189 - DNA, 201 bp, Homo sapiens
  source 1..201: mol_type = unassigned DNA
gtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctggg

SEQ ID NO: 14190 - DNA, 201 bp, Homo sapiens
  source 1..201: mol_type = unassigned DNA
cccggatacccaggtcatctccgaatctcaaggtccttaatcgtagtcacacgtacagaggcttctttgccatgtggggtaatacggtcacagggtaagacggtcacgggtctcagacatctttgggccattatcctgtctaccgcaggtggacacagccatggaatggaagcaacttttctgattacctacggtagcttt

SEQ ID NO: 14191 - DNA, 201 bp, Homo sapiens
  source 1..201: mol_type = unassigned DNA
gattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccgccac

SEQ ID NO: 14192 - DNA, 201 bp, Homo sapiens
  source 1..201: mol_type = unassigned DNA
ccttgaatagcagcaggtagtagagccccagggagagcaggtccccgtggtgcagcaccacggtcctgtgccccacctcggagaagttgacggagatgtgcgccccggggatgggctccaggaccagcctccccgcggcctggccgctgtccgggagcggttgccggcggatggtgcagtgtagaggcaggatgtcggggg

SEQ ID NO: 14193 - DNA, 201 bp, Homo sapiens
  source 1..201: mol_type = unassigned DNA
acagggtttcaccctgttagccaggatggtctcgatctcctgacctcgtgatccgccagcctcggcctcccaaagtgctgggattacaggcgtgagccaccgcattgggccggcagttatctttcttaagtagcagttctatttctcagtataaattaatgctgcagttcctaaaccatttgctgaagtgcctctgaaccc

SEQ ID NO: 14194 - DNA, 201 bp, Homo sapiens
  source 1..201: mol_type = unassigned DNA
ttttttttttttttttgagacagaattttgctctgttgcccaggctggagcacagtggtgcgatatcagctcactgcaaactccacctcccgggttcaagcgattttcctgcctcagcctcctgagtatctgggattacagggagtgcctccacacctggctaattttttgtatttttagtagagacagggtttcaccgtg

SEQ ID NO: 14195 - DNA, 201 bp, Homo sapiens
  source 1..201: mol_type = unassigned DNA
aacagctgggcgcggtggctcacacctgtaatcccagcactttgggaggctgaggcgggtagatcacgaggtcaggaaatcgagaccatcctggctagcacggtgaaaccccgtctccactaaaaatacaaaaaaaattagccgggcgttgtggcggacgcctgtagtcccagctactcctaaggctgaggcaggagaatg

SEQ ID NO: 14196 - DNA, 201 bp, Homo sapiens
  source 1..201: mol_type = unassigned DNA
ttgactcggaaagggaactccctgaccccttgcgcttcccaagtgaggcaatgccttgccctgctttggctggcgcacggtgcgcgcacccactgacctgcgcccactgtctggccctccctagtgagatgaacccggtacctcagatggaaatgcagaaatcacccgtcttctgcatcgctcacgctgggagctgtagac

SEQ ID NO: 14197 - DNA, 201 bp, Homo sapiens
  source 1..201: mol_type = unassigned DNA
tttttattttgttttttagacagaatctcgttgtgtcacccaggctggagtgcagtggcgtgatcttggctcactgcaacttctgcctcccgggttcacgcgattcttctgcttcagcctcccaagcagctgggattgcaggtgtgcaccaccatgcccatactaagtctttgtatttttagtagagatggggttttgcca

SEQ ID NO: 14198 - DNA, 201 bp, Homo sapiens
  source 1..201: mol_type = unassigned DNA
cagtgaaaccccgtctctactaaaaatacaaaaaattagcccggcgtggtgaagggcacctgtagtcgcagctactcaggaggctgaggcaggagaatggcgtgaacccgggaggtggagcttgcagtgaaccgagatcacgctactgcactccagcctgggcgacagagtgagactctgcctcaaagaaatagaagattt

SEQ ID NO: 14199 - DNA, 201 bp, Homo sapiens
  source 1..201: mol_type = unassigned DNA
ctctgtgaaaaataaaaaaaataagccgggcgcggtggctcacgcctgtaatcccagcactttgggaggccgaagcaggcagatcacgaggtcaggagatcgagaccatcctggctaacgcggtgaaaccccgtctctactaaaaatacaaaatattagccgggcgtagtggcgggcgcctgtagtcccagctactcggga

SEQ ID NO: 14200 - DNA, 201 bp, Homo sapiens
  source 1..201: mol_type = unassigned DNA
gagctaaagtgatacgtctgcctgggcctcccaaagtgctggaattacagatctgagccaccgggcccagcccaattactttcttcagtctgagtatgagcgccggaagaaaagctcctacctgcatctattttttttagacacagggtctccctctgtcacccaggctggagagcagtggcgcaatctccgctcggctca

SEQ ID NO: 14201 - DNA, 201 bp, Homo sapiens
  source 1..201: mol_type = unassigned DNA
ggagcatgaggcaggagagtcacttgaacccgggaggcagaggttgctgtgagccgagatcatacctctttactccagcctgagtggcagagcaagactccgtctcaaaaaaaaaaaaaaaaagttgggggaaggagagaaaaatagagagcccagtggggcaaccccccacccagcccttgccacctgccactgctccag

SEQ ID NO: 14202 - DNA, 201 bp, Homo sapiens
  source 1..201: mol_type = unassigned DNA
atatctggtttctgggatttgcacacctttgtccctcttgggtggaaagacggcttccctgaccagggctcccctgtgttccagagggcacgttccctttcgtaagtgtgagtcgcacaccagtgagcatgtgtctccacttccagggacaccggccactaggcttggggttagatggtaggactctcgtccctcccttca

SEQ ID NO: 14203 - DNA, 201 bp, Homo sapiens
  source 1..201: mol_type = unassigned DNA
ctacaggcgcccgccaccacgcccggctaattttttgtgttttgtttagtagagacggggtttcaccgtattagccaggatggtctcgatctgctgacctcgtgatccgcccgcctcggcctcccaaagtgctgggattacaggcgtgagccaccttgcgcccggcctctttatttttatatctcaaatcagagatgattt

SEQ ID NO: 14204 - DNA, 217 bp, Homo sapiens
  source 1..217: mol_type = unassigned DNA
tacaggcgccccccaccacgcccggctaattttttgtatttttagtagagacggggcttcaccgcgttagccaggatggtctcgatctcctgaccgagaccgcgccttcctgaccgcgcccggccgaccctcctcttttttctatttgttttttctctttttatcattatcaaaagcccattgtcccatactttctccttcctaatttcattcaaaa

SEQ ID NO: 14205 - DNA, 217 bp, Homo sapiens
  source 1..217: mol_type = unassigned DNA
ggtctacagctcccagcttgagcgacgcagaagacgggtgatttctgcatttccatctgaggtaccgggttcatctcactagggagtgccagacagtgggcgcaggtcagtgagtgcgtgcaccgtgcgcgagccgaagcagggcgaggcactgcctcacttgggaagggcaaggggtcagggagttccctttcccagtcaaagaaaggggtgacgg

SEQ ID NO: 14206 - DNA, 201 bp, Homo sapiens
  source 1..201: mol_type = unassigned DNA
gcccgccaccacgcccggctaaatttttgtatttttagtagagatggggtttcaccttgttaaccaggatggtgtcgatttcctgacctcgtgatccgcccgccttggcctcccaaagtgccgggattacaggcgtgagccactgcgcccggcctggaaattgttttttatgtagttgatccattttaactcccaccagca

SEQ ID NO: 14207 - DNA, 201 bp, Homo sapiens
  source 1..201: mol_type = unassigned DNA
tatatgaccctgaataagtcctgaattatccacatgtgactttccggtctcatatgaggcagaacagcacggtgtggaccgggaaccctgacgtgggagccgaaagatggggaggctgtgggcacggcccccggagccccgggactgagacatgcaggcacctcagacgggtttgctgccacaataagtgggaaatctcca

SEQ ID NO: 14208 - DNA, 201 bp, Homo sapiens
  source 1..201: mol_type = unassigned DNA
cccagagaagacccggcagcccctccagccctcggcctctgtccccgcctccttccctcctgtcctcaggcctcctctctgcagcctcccagtctcccaccgcgtcctgcgctcctggttttctcctcttctagtgtcttccccacctggcgtcgcccggccgcaaccctggccctcctggggaagaggttcggaccctac

SEQ ID NO: 14209 - DNA, 201 bp, Homo sapiens
  source 1..201: mol_type = unassigned DNA
tgtttccacattggaaaaattcaaacacctttaagagtctgactatcggccgggcgcggtggcttaacgcctgtaatcccagcactttgggaggccgaggcggccggatcacaaggtcaggagatcgtgaccatcctggctaacacggtgaaaccccgactctactaaaaaaatacaaaaaaattagccgggcgcggtggc

SEQ ID NO: 14210 - DNA, 201 bp, Homo sapiens
  source 1..201: mol_type = unassigned DNA
gatttggttgtttagaagcgtgtgccactccggatcgagccaagatggccgaataggaacagctccggtctacagctcccactgtgagcgacgcagaagacgggtgatttctgtatttccatctgaggtaccgggttcatctcactagggagtgccagacagtgggtgcaggtcagtgggtgcgcgcaccgtgcgtgagct

SEQ ID NO: 14211 - DNA, 201 bp, Homo sapiens
  source 1..201: mol_type = unassigned DNA
cttcggccgggcgccgtggctcacgcctgtaatcccagtgagaggtgatagcatgctggcagccctcgcagccctccctcaccagcgcgacttccgggtgcgcgtgggctgggctggcccgcacttggagcggccagcagccccgggcagtgaggggcttagcacctgggccagcagctgctgtgctcgacttctcgccag

SEQ ID NO: 14212 - DNA, 201 bp, Homo sapiens
  source 1..201: mol_type = unassigned DNA
tgcggccgggcgcggtggctcactcctgcaatcccagaactttgggaggccgaggcgggcggatcacgagatcagcagattgagaccatcctggctaacacggtgaaaccccgtctctattaaaaatacagaaaaagtagccgggcgtggtggcgggcacctgtagtcccagctacaggctgaggcagaagaatggcgtga

SEQ ID NO: 14213 - DNA, 201 bp, Homo sapiens
  source 1..201: mol_type = unassigned DNA
cctcggcctcccaaagtgctggggttacaggcgtgagccaccgcgcccggtcagccgtccctactaaaaatacaaaaaattagcctggcgtggtggcgggcgcctgtagtcccagctactccggaggctgaggcaggggaattgcttgaacccatgaggcggaggttctaagccgaggtcgtgccactgcactccagtctg

SEQ ID NO: 14214 - DNA, 201 bp, Homo sapiens
  source 1..201: mol_type = unassigned DNA
ggctggagtgcagtggcgtgatctcggctcgctacaaccttcacctcccagcagcctgccttggcctcccaaagtgccgagattgcagcctctgcccggccgccaccccgtctgagaagtgaggagcgtctctgcctggccgccatcccatctaggaagtgaggagcgcctcttcccggccgctatcccatctgggaagtg

SEQ ID NO: 14215 - DNA, 201 bp, Homo sapiens
  source 1..201: mol_type = unassigned DNA
gccttagctgccttcccgcggggcagggctcgggacctgcagcccgccatgcctgagcctcccaccccttccgtgggctcctgtgcggcccgagcctccccgacgagcgccaccccctgctccacggcacccagtcccattgaccacccaagggctgaggagtgcgggcgcacagtaccgggactggcaggcagctccatc

SEQ ID NO: 14216 - DNA, 286 bp, Homo sapiens
  source 1..286: mol_type = unassigned DNA
gaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaggggtcagagagttccctttccgagtcaaataaatgggtgacggacgcacctggaaaatcgggtcactcccacccgattattgcgcttttcagaccggcttaaaaaacggtgcaccacgagactatatcccacacctggctc

SEQ ID NO: 14217 - DNA, 201 bp, Homo sapiens
  source 1..201: mol_type = unassigned DNA
gcctcagctgcctccctgcggggcagggcttgggacctgcagcctgccatgtgtgagcctccccccactgccctaggctcctgtgcagcaggagcctccccgacgagcaccgccccctgctccatggcacccggtcccatcgactgtggaacggctgaggagcgtgggcacaaggcatgggactggcaggcagctttgcct

SEQ ID NO: 14218 - DNA, 201 bp, Homo sapiens
  source 1..201: mol_type = unassigned DNA
ggagtgcaatggcaccatctcggctcactgcaacctccgcctcccgggttcaggcgattctcttgcctcagcctcccgagtatctgggattacaggcgcgcgcctccacgcccaactaatttttgtatttttagtagagacggagtttcaccatgttggccaggctcgtctcgaacccctgacctcgtgatccacccgcct

SEQ ID NO: 14219 - DNA, 201 bp, Homo sapiens
  source 1..201: mol_type = unassigned DNA
cctccgtcaccccttcctttgactcggaaagggaactccctgaccccttgcgcttcccgagtgaggcaatgcctcgccctgcttcggctcgcgcacattgcgcacacccactgacctgcgcccactgtctggcactccctagtgagatgaacccggtacctcagatggaaatgcagaaatcacccgtcttctgcgtcgctc

SEQ ID NO: 14220 - DNA, 201 bp, Homo sapiens
  source 1..201: mol_type = unassigned DNA
gacgcagaagacgggtgatttctgcatttccatctgaggtaccgggttcatctcactagggagtgccagacagtgggcgcaggtccgtgggtgcatgcaccgtgtgcgagctgaagcagggcgaggcattgcctcactccggaagcgcagggggtcagggagttccctttcctagtcaaagaaaggggtgacagacggcac

SEQ ID NO: 14221 - DNA, 201 bp, Homo sapiens
  source 1..201: mol_type = unassigned DNA
cccagctaattttttttatatttttaatagagacagggtttcaccatgttggccaggatagtcttgatctcttgacctcgtgatccgcccgcctcggccccgcaaagtgctgggattacaggcgtgagccaccgcacccggccggaagtatacattttaacagctctacatagtagctgctgtcagaattcaaatgaagat

SEQ ID NO: 14222 - DNA, 201 bp, Homo sapiens
  source 1..201: mol_type = unassigned DNA
cagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttctgagtcagggaaaggggtgacggatggcacctgg

SEQ ID NO: 14223 - DNA, 201 bp, Homo sapiens
  source 1..201: mol_type = unassigned DNA
ctggcagggccggccggctgctcccagtgcggggcctgccaagcccacgcccacccggaactccagctggcccgcaagcaccatgcacagcctgggttcccgctcacgcctctccatccacacctccctgcaagctgagggagcgggctctggccttggccagcccagaaaggggctctcacagtgcagcggtgggctgaa

SEQ ID NO: 14224 - DNA, 201 bp, Homo sapiens
  source 1..201: mol_type = unassigned DNA
cttgagattctcgcagccccggggcctgagctgaggggtcaccggcagtgccgtgggagtcaggctgccctcccggaagccaggctgctcctgagcagagcggaggctccatcgccctccggggggcacggtggcagtctccaggctgcactggggttggatgagctgggggtggagcacaaggggtcagtccctctcccc

SEQ ID NO: 14225 - DNA, 201 bp, Homo sapiens
  source 1..201: mol_type = unassigned DNA
aaacccctcgtctgcagggggcgggtggggaggtggaggaggggctgggccaaacgctgggggtgtgacccggggctgcgggctctcgggtctcagtcttcgggtctgccgagtgggcgagtggggtgcctcactccctgcggtctcttcccggtccccacagaacatggagaaggcgactctgccgtcggtgacgctcat

SEQ ID NO: 14226 - DNA, 201 bp, Homo sapiens
  source 1..201: mol_type = unassigned DNA
gggcgcctgtagtcccagctactcgggaggctgaggcaggagaatggcatgaacccgggaggcggagcttgcagtgagccgagatcgcgccactgcacttcggcctgggcgacagagcgagactccgtcaaaaaaaaaaaaaaaaagcagtcttgcaagatcaggtgtctggtagacaggcacactcagtaaagttacaac

SEQ ID NO: 14227 - DNA, 210 bp, Homo sapiens
  source 1..210: mol_type = unassigned DNA
ctactaaaaatacaaaaaaattagcctggcgcggtggcgggcgcctctagtcccagctgctcgggaggctgaggcaggagaatggcgtgaatccgggaggcggagcttgcggtgagccgagatcctgccacagcactccagcccgggcgacagagtgagacttcgtctcagaaaaaaaaaaaaaaaaaaaaaagaagtgggaacccagaa

SEQ ID NO: 14228 - DNA, 201 bp, Homo sapiens
  source 1..201: mol_type = unassigned DNA
ccccgggttcacgccattctctcgcctcagcctcccgagtagctgggactacaggcacccggctaattttttgtattttttatagagacggggttctcaccgtgttagccaggatggtcttgatctcctgacctcgtgatccgcctgcctgggcctcccaaagtgctgggattacaggcgtgagccaccgcgcccagcttg

SEQ ID NO: 14229 - DNA, 201 bp, Homo sapiens
  source 1..201: mol_type = unassigned DNA
gaccgttttctcgccattgtacccacacaacttgctctaaatgggcaatttattaagtatattttgtccctgttcccgccgcaggcccctgccggaccgtcgcccacaagctcccatagcccgtgagtcctctcagcctggcccggctcaccctgtggcgcccacgtctaccccgggccctttccgattcctctttaaccc

SEQ ID NO: 14230 - DNA, 201 bp, Homo sapiens
  source 1..201: mol_type = unassigned DNA
gtagtgcagtggcgcaatctcggctcactgcaagctccgcctcccgggttcacgccattctcctgcctcagcctccgggctagctgggactacaggcgcccgccactgtgccaggctaattttttgtatttttagtagagatggggtttcaccatattagccaggatggtctcgatctcctgacttcgtgacccacccgcc

SEQ ID NO: 14231 - DNA, 201 bp, Homo sapiens
  source 1..201: mol_type = unassigned DNA
tccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaac

SEQ ID NO: 14232 - DNA, 201 bp, Homo sapiens
  source 1..201: mol_type = unassigned DNA
ggaacaaacattcctgttccacaaagacccagaattcactggatactgataaaatgtttactagaggccggcgcagtggctcatgcccataatcccggcgcggtggctcacacctgtaatcccgacgtggtggctcacacatgtaatcccagcacttcgcaaggccaggtggggggatcacttgagctcaggagttcatga

SEQ ID NO: 14233 - DNA, 201 bp, Homo sapiens
  source 1..201: mol_type = unassigned DNA
gtggtgcaattttggctcactgcaagctctgcctcccgggttcatgccattctcctgcctcaggctcccgagtagctgggactacaggtgcacaccaccacgcccggctaatttttttgtatttttagtaaagacggggtttcaccatgttagccaggatggtctcgatctcctgaccttgtgatccaccagcctcagcct

SEQ ID NO: 14234 - DNA, 201 bp, Homo sapiens
  source 1..201: mol_type = unassigned DNA
gtaaaccttctgcaaaatcctggccctccagaccccagctgggtcctcccctccaggcccccagtggcagctgtgccccttgtgtgcccacgtcggccagcgcaagccacacatggacccagtgcccactgcacccctgccagcctcagggtcccagcccgttgttccgggagacttcagtcctggcccaggcatctcctt

SEQ ID NO: 14235 - DNA, 201 bp, Homo sapiens
  source 1..201: mol_type = unassigned DNA
ttttaatttttttattaagatggagtcttgctctatcgcccaggctggagtgcagtggcgcgatcacggctcactacaacctccgcctcccgggctcaagcgattctcctgcctcagcctcccgagtagctgggattacaggcatgtgccaccatgcccaggtaattttagtacttttagttgagacggggtttcaccatg

SEQ ID NO: 14236 - DNA, 201 bp, Homo sapiens
  source 1..201: mol_type = unassigned DNA
ccccgccaggcgcggtggctcatgcctgtaatcccagcactttggaacgccgaggcaggcgaatcacgaggtcaagagatcgagactatccttgctaacacggtgaaaccccgtctctaccaaaaatacaaaaaattagccgggcgtgggggcgggcgcctgtagtcctagctgctcgggaggctgaggcaggagaatcgc

SEQ ID NO: 14237 - DNA, 201 bp, Homo sapiens
  source 1..201: mol_type = unassigned DNA
attattttctttttttttgagacggagtcttgctctgtcgcccacgctggggtgcagtggcacgatctcggctcactgcaagctccgcctcccgggttcacgccattctcctgtctcaacctctcgagtagctgggactacaggcacatgctaccacacccggctaatttttttgaatttttagtagagaggggtttcact

SEQ ID NO: 14238 - DNA, 201 bp, Homo sapiens
  source 1..201: mol_type = unassigned DNA
tccgcgaatccgggtggtgtccttttcttgtactattcagacgtgtttctaggaaggacgtgctgtcatgacccgccatggtggtcccggggatggtcagcggcgggatgatgggtgtgatgtggtcccggggatggtcagcggcaggatgatgggtgtgacgcatctgtgctacttgggattcaaattcatctatgatct

SEQ ID NO: 14239 - DNA, 201 bp, Homo sapiens
  source 1..201: mol_type = unassigned DNA
actgggtttcaccgtgttagccaggatggtctcgatttcctgaccttgtgatcagcccgcctcggcctcccaaagtgctggtattacaggcgtgagccaccgctcccggcaaagtcctttttcgatggtttcagtttgctggacaagccaggaacaaggccattggttgcaagggaggaggagctcttgtaggtggcagcg

SEQ ID NO: 14240 - DNA, 201 bp, Homo sapiens
  source 1..201: mol_type = unassigned DNA
ggtgactcaaatcgttcatgtggaacacacacacacacacacatatacacacacacgtgtcttagggacggacacacacaaacacgtgtcttaggggccccgtgtgaggagaggagattcacactactgacccagcaaccagggtcgaccccagagggctggagcacacactccgggttgacgataggcgcctggctctgg

SEQ ID NO: 14241 - DNA, 201 bp, Homo sapiens
  source 1..201: mol_type = unassigned DNA
cctcggcccgtccctttttacctcaggctgcctcaacctctccctgaaagcctggcgtccattccccatttcctgggaaacatcttgtcgctttggggtgcgccccgtgaaggagacacgctgggtgaaagccagggactccacaaccaccccccgcccccaccccgggcccagtgcaggggctgccgtgaaggcactggc

SEQ ID NO: 14242 - DNA, 201 bp, Homo sapiens
  source 1..201: mol_type = unassigned DNA
aggctgctgggaaggaactggcctccatggaagtgccccagccttcttgccctcccggcttttttcccccggctgtctcagtgtcccactgaaagcctggcgtcatatccccatcccccgggaaacttcatgcccctttggggtgccccccgtggggaagacacgcaccctgggtgaaagctagggactccatgaacaccc

SEQ ID NO: 14243 - DNA, 201 bp, Homo sapiens
  source 1..201: mol_type = unassigned DNA
accaacccaaatatccatcaatgatagactggataaagaaaatgtggtggggtggagccaagatggccgaataggaacagctccggtctacagctcccagcgtgagcgacgcagaagatgggtgatttctgcatttccaactgaggtaacgggttcatctcactggggagtgctggacagttggtgcaggacagtgggtgc

SEQ ID NO: 14244 - DNA, 201 bp, Homo sapiens
  source 1..201: mol_type = unassigned DNA
gcccgccaccacacccggctaattttttgtatttttaatagagacggggtttcaccgtgttagcaaggatggtctcgatctcctggcctcgtgatccgcccgcgtcggcctcccgaagtgctgggattacaggcatgagccaccgcgcccggccagaagtgtttttatctgtttgggaagttgcctctccctggcacctgc

SEQ ID NO: 14245 - DNA, 201 bp, Homo sapiens
  source 1..201: mol_type = unassigned DNA
tttttcatcttaaggaacaagttcttaattagattagatacagctataagtaaacataaactatgttcttatgtaacctcaagagttattttaggccgggcgcggtggctcatgcctgtaatcacagcactttcggaggccgtggcgggcggatcacgaggtcaggagattgagaccatcctggctaacatggtgaaacca

SEQ ID NO: 14246 - DNA, 201 bp, Homo sapiens
  source 1..201: mol_type = unassigned DNA
ggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccg

SEQ ID NO: 14247 - DNA, 366 bp, Homo sapiens
  source 1..366: mol_type = unassigned DNA
tgagcgacgcagaagacgggtgatttctgcatttccatctgaggtaccgggttcacctcactagggagtgccaggcagtgggcgcaggccagtgggtgcgcgcaccgtgggcgagccgaagcagggcgaggcattgcctcacctgggaagcgccaggggtcagggagttccctttccgagtcaaggaaaggggtgaccgacgcacctagaaaatcgggtcactcccacccgaatattgcgcttttcagaccggcttaaaaaatggcgcaccacgagactatatcccacacctggcttggagggtcctacgcccacggaatctcactgattgctagcacagcagtctgagatcaaactgcaaggcgg

SEQ ID NO: 14248 - DNA, 201 bp, Homo sapiens
  source 1..201: mol_type = unassigned DNA
ataaaggttctccaagtccacactagactcacgagcccagctggcttcacccagtggatcccgcaccgggggccgcaggtggagctgcctgccagtcccgcgcagtgctcccacagtcctcagcccttgggcggtcgatgggaccgggcgccgtggagcagggggcagcgctcattggggaggctcggccctgcaggagcc

SEQ ID NO: 14249 - DNA, 201 bp, Homo sapiens
  source 1..201: mol_type = unassigned DNA
ggtgccgtctgtcacccctttctttgactaggaaagggaactccctgaccccttgtgcttccggagtgaggcaatgcctcgccctgcttcggctcgcgtgcggtgcgctgcacccactgtcctgcgcccactgtctggcactccctagtgagatgaacccggtacctcatatggaaatgcagaaatcactcatcttctgcg

SEQ ID NO: 14250 - DNA, 201 bp, Homo sapiens
  source 1..201: mol_type = unassigned DNA
gccgccttgcagtttgatctcagactgctgtgctagcaatcagcgagactccgtgggcataggaccctccgagccaggtgcgggatacaatctccaggtgcgccgttttttaagcctgttggaaaagtgcagtattccggttggagtgacccgattttccaggtgctgtctgtcacccctttctttgactgggaaagggaa

SEQ ID NO: 14251 - DNA, 384 bp, Homo sapiens
  source 1..384: mol_type = unassigned DNA
ctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaa

SEQ ID NO: 14252 - DNA, 216 bp, Homo sapiens
  source 1..216: mol_type = unassigned DNA
gaagacgggtgatttctgcatttccatctgaggtaccgggttaatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgatggacgcagctggaaaatcgggtcactccca

SEQ ID NO: 14253 - DNA, 334 bp, Homo sapiens
  source 1..334: mol_type = unassigned DNA
tgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacag

SEQ ID NO: 14254 - DNA, 201 bp, Homo sapiens
  source 1..201: mol_type = unassigned DNA
gggatcctaaggtcttgctggtgcggcccaaaggcaccggacgttggggccaagatgacctccgcgctgccatgaaccaggccattggacgcgggctccgcgccgagcctgcagtcctcgaggagtctctcgggttcctccgttttgatcacaccttctcggatggctgccgggcttttgcctgccccgccttgcatcgag

SEQ ID NO: 14255 - DNA, 270 bp, Homo sapiens
  source 1..270: mol_type = unassigned DNA
gccactgcactccagcatgggtgacagagccagcctgaaactctgccctgcgtccttctgagaagtgacagtgtaccggcatggcagccctcacagccctcgctcgctcttggcgcctcctcggccttggcacccactctggccgcgcttgaggagcccttcagcccgccgctgcactgtggaagcccattcctgggctggccaaggccggagccggctccctcagcttgcggggaggtgtggagggagaggcacgggcgggaaccgggg

SEQ ID NO: 14256 - DNA, 253 bp, Homo sapiens
  source 1..253: mol_type = unassigned DNA
cgtgagcgacgtggaagacaggtgatttctgcatttccatctgaggtaccgggttcatctcactagggagtgccagacagtgggcgcaggtcagtgggtgcgcgcaccgtgcgcgagccgaagcagggcgaggcattgcctcacttgggaagcgcaaggggtcagggagttccgtttccgagtcaaagaaaggggtgacggacgcacctggaaaatcgggtcactcccaccggaatactgcgcttttccgacc

SEQ ID NO: 14257 - DNA, 204 bp, Homo sapiens
  source 1..204: mol_type = unassigned DNA
tcccagtaggggcggccgggcagaggcgcccctcacctcccggacggggcggctggccgggcaggggggctgaccccccccacctccctcccggacggggcggcggcaaagactgagacagctccgctgcccgctgaactccatcctcccggccaaaaccaagcttcttaacaaagatcctgaagtgttgagtttactaattta

SEQ ID NO: 14258 - DNA, 228 bp, Homo sapiens
  source 1..228: mol_type = unassigned DNA
gctaccttgcagtttgatctcagactgctgtgctagcaatcggcgagactccgtgggcgtaggaccctccgagccaggtgcgggatatagtctcctgatgcgccggtttttaagcccgtaggaaaagcgcagtattcgggtgggagaggcctgattttccacgtgctgtctgtcacccctttccttgaccaggaaagggaactccctgaccccttgtgcttcccgagt

SEQ ID NO: 14259 - DNA, 217 bp, Homo sapiens
  source 1..217: mol_type = unassigned DNA
cgcaggatgcagattgcagacgctcatcgtctcgcaggcagctccagctcgagtggtggccgtgctgggtctgtgcccggggccttcccccgtatgctttcgctttctagtgtctgcgatgacgtgcgattcactaatcacccggactcagcgcatctctatgttaaatagcgcgtgtccatctgcaaagcacacgacagcccctgcggccactggg

SEQ ID NO: 14260 - DNA, 201 bp, Homo sapiens
  source 1..201: mol_type = unassigned DNA
tcattcttgaagtcactgagaccacaagcccactggaaggaaccaactccggacacatcttgggtgttcgtctgggatattgccacacggtgagtaccatcggactcgtctgggatattgccacacggtgagtaccttcggacctgtttcactttctattctgccctatttttccttagaattcaggggttaaacaccgga

SEQ ID NO: 14261 - DNA, 204 bp, Homo sapiens
  source 1..204: mol_type = unassigned DNA
aagacaacaaactggtcctaaataaaaagtaagaaaaatgccggggaggagccaagatggccaaataggaacagctccggtctacagctcccagcgtgagcgacgcggaaaatgggtgatttctgcatttccatcggaggtaccgggttcatctcactagggagtgccagacagtgggcacaggtcagtgggtgtgcgcaccgt

SEQ ID NO: 14262 - DNA, 223 bp, Homo sapiens
  source 1..223: mol_type = unassigned DNA
cagtgggcatacagaggcagtcgggacccgtctggaagagcctccgcccggggtaaggagccgggactgtgtctaggaggcagtggggagctccggagagcgaagcgcctcctgcgcagactcgcgtgcttggagtaccggagcctgcagggcaagagagggtcttcagaagacccacgacgttccactgggatgcagagggaaacggttacttgtacttcta

SEQ ID NO: 14263 - DNA, 201 bp, Homo sapiens
  source 1..201: mol_type = unassigned DNA
cccaaagtactaggattacaagcagaaccaccgcgtctcttgttttcttttttgtttttgtttttgttttgttgttgttgttgatgttgttacagagtttcgctcttgtcgcccaggctgggatgcaatggtgtgatctcggctcattgcagcctccgcctcccggcttcaagcaattctcctgcctcagccttgtgagta

SEQ ID NO: 14264 - DNA, 203 bp, Homo sapiens
  source 1..203: mol_type = unassigned DNA
agtacaaataaattggtcgggcggtagtcccagctactcgggaggctgaggcagcagaatagcgtgaacccgggaggcggagcttgcagtgagccgagatcgcgccactgtactccagcctgggtgacagagtgagactacgtctcaaataaaaaaaaaaaaaaaaaaaaaaagcacttccctagacctagcttgatattagg

SEQ ID NO: 14265 - DNA, 201 bp, Homo sapiens
  source 1..201: mol_type = unassigned DNA
ccacgcccggctaatttttttgtattattagtagagacgaggtttcaccgaggtttcaccgtgttagccgggatggtctgggtctcctgacctcgtgatccgcccaactcggcctcccaaactgctgggattacaggcatgagacaccgcgcccggctgttgtctgatttttttcagcagtgttttgtagttctttttgta

SEQ ID NO: 14266 - DNA, 201 bp, Homo sapiens
  source 1..201: mol_type = unassigned DNA
ctcccgagtagctgggactacaggtgcctgccacctcgcccggctaattttttgtatttttagtagagatggggtttcaccgtgttagccaggatggtctcgatctcctgacctcgtgatccgccagcctcggccccccaaagtgctgggattacaggcgtgagccaccgcgcccggcccaatttaatttttaacaatggt

SEQ ID NO: 14267 - DNA, 201 bp, Homo sapiens
  source 1..201: mol_type = unassigned DNA
aaaagtcacagggggcgtgaggacagacggcgtgtcctttcctacacatatggagacgcaggccggagcaacggcacacggaccacgcacacgcggcggacgcaccaacgcctacgcagaagagaacaaaagtcgcttctaactgggcacaaaccctctgcacccaaatatcccgacacccacaaacaaaatcagaacaga

SEQ ID NO: 14268 - DNA, 201 bp, Homo sapiens
  source 1..201: mol_type = unassigned DNA
tgatctgccctcctcggcctcccaaagtgctgggattacaggcgtgagccaccgcgcccggcccaggtcactttttttttttttttttttttttttgaggcggagtctcgctctgtcgcccaggctggagtgcagtggcgcgatctcggctcactgcaagctccgccttccgggttcacatgattctcctgcctcagcctc

SEQ ID NO: 14269 - DNA, 201 bp, Homo sapiens
  source 1..201: mol_type = unassigned DNA
ggattacaggcgtgagccaccgcgcccggcctaaactatggatttttttttcccagtggagtttcgctcttgcccaggctggaataggatggcacgaactcggcttactgcaatctccacctcccgggttcaagcgattctcctgcctcagcctcccgagtagctgggattacaggcatgtgctaccatgcctggctagta

SEQ ID NO: 14270 - DNA, 201 bp, Homo sapiens
  source 1..201: mol_type = unassigned DNA
aattttttccccacccttcccgcctttctattccacaaaaccgccattgtcatcatggcccatccccaatgagctgctgggcacacctcccagacggggtcgtggccgggcagaggggctcctcacttcccagtaggggcggccgggcagaagcgcccctcacctcccggatggggcggctggccgggcggggggctgacc

SEQ ID NO: 14271 - DNA, 201 bp, Homo sapiens
  source 1..201: mol_type = unassigned DNA
gggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagt

SEQ ID NO: 14272 - DNA, 201 bp, Homo sapiens
  source 1..201: mol_type = unassigned DNA
tgggcagcagagtgagactctgtcttaaaaaaaaaaaaaaaaagggggggccgggtgcggtggctcacgcctgtaatcccagcactttgggagaccgaggcgggcagatcacgaggtcaggagatcgggaccatcccagctaaaacggtgaaaccccgtctctactaaaaatacaaaaaattagccgggcgtagtggcggg

SEQ ID NO: 14273 - DNA, 201 bp, Homo sapiens
  source 1..201: mol_type = unassigned DNA
gtgggagtcacagggtttcaggggaggagcgttccaggccgcggtaacagcaggtgcaaaggccctgaggcaggacggggcagggaggtccagagtccaccgcgcagagacccgggaggccggcaggcacggtgaggaccttgacttaaacccaggaaaggggaaccacactggggcatgacctcctgtactttccgagat

SEQ ID NO: 14274 - DNA, 201 bp, Homo sapiens
  source 1..201: mol_type = unassigned DNA
gggatttccccatgttggccaggctggtctcgaactcctgacctcaagtgatccacctgcctcggcctcccaaagtgatgggattataggcatgagccaccgcgcccggccaagggtcttttcagatgtaatcaagttaagatgaggtcatactgagttaggtgggccctaaatccaatggctagtgttcttataagcaca

SEQ ID NO: 14275 - DNA, 211 bp, Homo sapiens
  source 1..211: mol_type = unassigned DNA
gccctagggccggaggagcaggagacctgggcagcggggtgggcgagtgccgggaggaggtaagaggtcgcgggggaggaagacgctccccccggccttgcggggcaggtcgcgcagggcaggtcgtgcggggcaggtggggggtgccaaggaagtccgggcgtggccacaccgcagagaaagccatgggaggcacgtcctgagagctggg

SEQ ID NO: 14276 - DNA, 201 bp, Homo sapiens
  source 1..201: mol_type = unassigned DNA
gcagccaaagccatcttcttggttgaaagatactcttttcggggggaggagccaagatggccgagtaggaacagctccggtctacagctcccagcgtgagcgacaaagaagacgggtgatttctgcatttgcatctgaggtacccggttcatctcactagggagtgccagacagtgggcgcaggtcagtgggtgcgcgcac

SEQ ID NO: 14277 - DNA, 201 bp, Homo sapiens
  source 1..201: mol_type = unassigned DNA
gctcaggacctgcagcccaccatgcctgagcctcccacccactccatgggctcctgtgccgcccaagcctcccggacgagtgccaccccctgctccacggcgcccagtcccatcgaccacccaagggctgaggaatgtgagcacacggcgcaggactggcaggcagctccacctgcagccccggtgtgggatccactaggt

SEQ ID NO: 14278 - DNA, 201 bp, Homo sapiens
  source 1..201: mol_type = unassigned DNA
tggtaacattgtgaagacgtaggttctccatgggaaagactgttgtccggaagtttccacacaacaggtccccactgagattccaaggctgacagcacggcgggagtccctgggacccctgggcccggcacagcgccaccgcagcaggcaggcaccgggtggccagaagtcgatcattctcttaaatggcctgtacatatc

SEQ ID NO: 14279 - DNA, 201 bp, Homo sapiens
  source 1..201: mol_type = unassigned DNA
ctcccatgggctgacctggtgatcctccatggagaatgcgtaggagccggatattggcactgccaggtggaaaagtcccctgtcagggtgaaaagtcagacggcgtctgcctctcgctcttggagtgctcctggcctaacgcagcagtttcgcagataaacgttacagaaggtagagcgctctacagatatgaaggagtgg

SEQ ID NO: 14280 - DNA, 201 bp, Homo sapiens
  source 1..201: mol_type = unassigned DNA
gacttctggacccgctgggctgtttccgcacccggcttccctccctcaagcttgcggccgggtgtggctccctcaacctcagcgccgacctccgtgtctgcgcgctctctctctaccttcctcatccgcggggtcaggggtcacacggcaccgtcgcctgggtctccgagcagggagagtcgagtgctgactctgccagaa

SEQ ID NO: 14281 - DNA, 201 bp, Homo sapiens
  source 1..201: mol_type = unassigned DNA
ggacattttacaaaactcctgacgagtcctcctcaaaaccactaggttggccgggtgcggtggttcatgcctgtaatcccagcactttgggaggccgaggcgggcagatcacaaggtcaggagatcgagaccatcctggctaacacggtgaaaccccgtctctactaaacaatacaaaaaattagctgggcgtggcagcgg

SEQ ID NO: 14282 - DNA, 201 bp, Homo sapiens
  source 1..201: mol_type = unassigned DNA
cccctccccatccttccaggggcctgaccccttccccaaccgcacctttatagaatggtcggccagacaggaagtcccggctggcgaagcccagcccccgcgggcacaggctggcgaactccagagactcgggatccgggcaggcctcgcactcgactccccacacggccccgatggagcagcagcagacgtccatccggt

SEQ ID NO: 14283 - DNA, 201 bp, Homo sapiens
  source 1..201: mol_type = unassigned DNA
aaattagccaggcctggtggcaggcacctgtaatcccagctactccaggggttgaggcaggagaattgcctgaacccgggaggtggaggttgtagtgagccgagattgcgcctttgcactccagcctgggggacaagagtgagacttcgtctcaaaaaaaaaaaaaaaaaaaaaaaaaggccgggtggctcacacctgtaa

SEQ ID NO: 14284 - DNA, 201 bp, Homo sapiens
  source 1..201: mol_type = unassigned DNA
catcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgat

SEQ ID NO: 14285 - DNA, 201 bp, Homo sapiens
  source 1..201: mol_type = unassigned DNA
cccgcggggcccgtccgctcctccagccgctgcctcccgggcggcgctcgccggcgccgactcccataatttactttttctagacagagtctttctctgtcgcccaggctggagggaagtggcatgacctcagctcactgaaacctactccttccgggttcaagcgattctcacctctgcctttggagtagctgggactac

SEQ ID NO: 14286 - DNA, 201 bp, Homo sapiens
  source 1..201: mol_type = unassigned DNA
ccacctcagcctcctgagtagctgggaccacaggcttgtgccatcatgcccagctcattttttattttattttatttttatttttattttttttttgagacggagtctcgctctgtcgcccaggctggagtgcagtggcgggatctcggctcactgcaagctccgcctcccgggttcacgccattctcctgcctcagcctc

SEQ ID NO: 14287 - DNA, 201 bp, Homo sapiens
  source 1..201: mol_type = unassigned DNA
aaatggtgatttagaggccgcccccactcgacgggctttcttagccgaagacgttcagctaatgaacctcaagcagattcatggccgggtgtgaagtcaacggagtcctcactccgtggagacgagcagcataaatctttgtttttaatgtctaatgatatgtaaaatatttaaatttgcaacgcagaattattaagctgc

SEQ ID NO: 14288 - DNA, 201 bp, Homo sapiens
  source 1..201: mol_type = unassigned DNA
ggcaggcggattactttagcttaggagttcgagaccagcctgggtaacatggcaaaatcccatctctacaaaaaatacaaaaattagccggtcatggtgccgtgcacctgtagtcccagctactagggagactgaggtgggagggtcacttaagcctgggagaggcgggtgtggtggaggttgtagtgagccaagatgcac

SEQ ID NO: 14289 - DNA, 201 bp, Homo sapiens
  source 1..201: mol_type = unassigned DNA
tagattgacagattttttttttttttgagatggagtcttgcactgtcacccgggctggagtgcagtggtgcaatctcggctcaccgcaacctccccaacccgcgttcaagcaattctcctgcctcagcctcccgagtagctgggattacagggcgtgccaccacgcctggctaattttttgtatttttagtagagatgggg

SEQ ID NO: 14290 - DNA, 201 bp, Homo sapiens
  source 1..201: mol_type = unassigned DNA
cctcgggcggcaaggattccacggtgctggcacacgtgctgcgcacgctggcaccgggcctgggcatcttactgcagctcatggctgtagacaagggcatcgggcgtggcttagcgggaggatcccagtaaggagctggggaaatacgcatgtgcctatttagggccggagcctactgaaggctcatgtgggtagtacgtg

SEQ ID NO: 14291 - DNA, 201 bp, Homo sapiens
  source 1..201: mol_type = unassigned DNA
cggctcattgcaacttccaccttccgggttcaagcgattctcctgcctcagcctcctgagtagctaggattacaggcatgcaccaccacccccggctaatcgttgaattttcagtagagacggggtttcatcacgttcgcaaggctggtctcgaacccctgatctcaggtgatgcccccacgtcggccttccaaagtgcca

SEQ ID NO: 14292 - DNA, 201 bp, Homo sapiens
  source 1..201: mol_type = unassigned DNA
cggcctcccaaagtgttgagattacaggcgtgagccaccgcgcccggcccacctcaggtgatccacccctctcagcctcccaaagtgttgagattacaggcgtgagccaccacgccgggcccacctcaggtgatccacccccctcggcctcccaaagtgttgagattacaggcgtgagccaccgcgcccggcccacctcag

SEQ ID NO: 14293 - DNA, 201 bp, Homo sapiens
  source 1..201: mol_type = unassigned DNA
gacttgagaaccgtctgcatcagcctggcttcctgcacagtgtctgcgccggtgcacaccttagaggggagctgcgccatcagatgaaccaggaccctggcggaggaagggggtgccggcagggctcccatggcacctgctgcctgtggctgaggggagcctggaagggcaccagcctcacccacccctggccgagacccc

SEQ ID NO: 14294 - DNA, 201 bp, Homo sapiens
  source 1..201: mol_type = unassigned DNA
tccggcacactcagagcacactggggctggggtagatggtggcacctgtcttggctggaggagttgggagggctggggaagggacgtgtgatctcctctccgataaacctggacgagatgccaagtataacacagaggctggcggcggggcctcctcctgttcccggtggatcaactcattgtgggactttgggcaacttt

SEQ ID NO: 14295 - DNA, 201 bp, Homo sapiens
  source 1..201: mol_type = unassigned DNA
ttaaaaaacacacacggccgggcgcggtggctcacgcctgtaatcccagcactttgggaggccgaggtgggcggatcacgaggtcaggagatcgagaccacggtgaaaccccgtctctactaaaaaaatacaaaaaattagccgggcgcagtggcgggcgcctgtagtcccagctgctcgggaggctgaggcaggagaatg

SEQ ID NO: 14296 - DNA, 201 bp, Homo sapiens
  source 1..201: mol_type = unassigned DNA
acggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagaggtaagtcctgctgccacgtgc

SEQ ID NO: 14297 - DNA, 279 bp, Homo sapiens
  source 1..279: mol_type = unassigned DNA
gggcctgggctcgctaggtgtagaacaaggagaaaggggtagaggggaagagtcgggtcgaaccccagcgagggacccggccttccctggaggagaggatcgtactcgcgccaggagtatggactcacccagggagtgcttgggcggagaagcagcctctgctccaggccttccgctgcggcacctaaagaggccgggcggcccagaggcccgcaagccacgcccccttccaggccccgcctccgtttggccactccccttgctgtcagctcttccacc

SEQ ID NO: 14298 - DNA, 201 bp, Homo sapiens
  source 1..201: mol_type = unassigned DNA
ctggctgctatgaaatcataaattatgtttacagaaatttcagtctgagaaagaacctagattttcctttttttttttttttttttttgagactgagtctcgctctgtcgcccaggctggagtgcagtgatgccatctcggctcactgcgagctctgcctcccgggttcacgccattctctggcctcagcctcccgtgtag

SEQ ID NO: 14299 - DNA, 201 bp, Homo sapiens
  source 1..201: mol_type = unassigned DNA
tcgggggcggggcggggcggggcggggcggggcgggggggtggggctgaggcaggagaatggcgtgaacccgggaggcggagcttgcagttagccgagatcgtgccactgtactccaacccgggcgacagcgactctatctcaaaaaataataataataaaaaagaataaagattctataggcacttcttttacagcagag

SEQ ID NO: 14300 - DNA, 201 bp, Homo sapiens
  source 1..201: mol_type = unassigned DNA
ggggtctcaccgtgttagccaggatggtctcggtctcctgatgtcgtgatcctcccatctaggcctcccaaagtgctgggattataggcgtgagccaccgcgcccggcctagttcttcatttctaacaagttttcaggtgatgcttatgttggtagtcctctgagactatcacactttaagtttcagggtgttagaaaaac

SEQ ID NO: 14301 - DNA, 201 bp, Homo sapiens
  source 1..201: mol_type = unassigned DNA
tgttgttgttgtttttaagttggagtcttgttctgtcacccaggctgcagtgcagtggtacgatctcggctcactacaacctcggcctcccgggttccagcgattctcctgcctcagccacccaagtagctgggtctacaggcgcatgccactacgcctggctaatttttgtatttttaggagagacaggttttcaccatg

SEQ ID NO: 14302 - DNA, 201 bp, Homo sapiens
  source 1..201: mol_type = unassigned DNA
aaccgagctgtggaatggggttccgtggagcaggttgagtgtgccggtcgtggacgggtcgtgggcgggactccccagtgtgtcaccactgaggcatcttcgccctcttacgtgtctctgtttctctctctagaagtccaacacctccgagaggactcaaaacacagagtgaccagctcctatgtgcatttcctggacaaa

SEQ ID NO: 14303 - DNA, 201 bp, Homo sapiens
  source 1..201: mol_type = unassigned DNA
aggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcg

SEQ ID NO: 14304 - DNA, 201 bp, Homo sapiens
  source 1..201: mol_type = unassigned DNA
ccatacaccccacgcgccctgcccaccacgaggcctgtaccctctgggcagcaggtgccgcgcgcccccgggtaccttgtaggtggagccgtcggcgcagcgcagcaccccgtgtccctgacgccggtcccggacccagtcgccgtcgtacttgtcaccgttcctgggggacacacgcacggagtccactctcaacagggg

SEQ ID NO: 14305 - DNA, 201 bp, Homo sapiens
  source 1..201: mol_type = unassigned DNA
tctactacaaatacaaaaaattagccgggcgtggtggcgggcacctgtagtcccagctactcggaaggctgaggcaggaaaatgatgtgaacccgggaggcggagcttgcagtgagccgagatcgcgctgctgcacccaagcctgggcgacagagcgagactccgggtcaaaaaaaataaaagaatatagggtatggtatc

SEQ ID NO: 14306 - DNA, 201 bp, Homo sapiens
  source 1..201: mol_type = unassigned DNA
cagagtagctgggaccacaggcgcccactgccacgcccggcttatttttttttgtatttttagtagagacggggtttcaccgtgttagccaggatggtctcgatcttctgacgtgatccacccgcctcggcctcccaaagtgctgggattacaggcgtgagccaccgtgcccggcctattcatgtgctttctgggaagggg

SEQ ID NO: 14307 - DNA, 201 bp, Homo sapiens
  source 1..201: mol_type = unassigned DNA
aggcgcccgccaccacgcccggctaattttttgtatttttagtagagacggggtttcaccatgttagccaggatggtctcgatctcctgaccttgtgatccgcccacctcgtcctcctaaagtgctgggattacaggcgtgagccaccgtgcccggccgcctctcggcatacctcttattcctagcatgtggctctcacac

SEQ ID NO: 14308 - DNA, 203 bp, Homo sapiens
  source 1..203: mol_type = unassigned DNA
gttggtcatggaaggctacagtttcgcagatggtgtcggtggagtttggggcagggcattctgagcctgggaaggtttggggtgaaggcccggaggctggcgcgtaggaggctaaagcagcagggaggtctggggagagtcaggtggggttgtgtcttccacgttgcaggccgtgctcacagatggtgaaagacgttgtggaa

SEQ ID NO: 14309 - DNA, 201 bp, Homo sapiens
  source 1..201: mol_type = unassigned DNA
tcccaagtagctgggactacaggcgcccaccaccacgcccggctaatgtttttgtttttttagtagagacggggtttcaccgtgttagccaggatggtctcgatctcctgacctcgtgatcctcccgtctcggcctcccaaagtgctgggattacagcaatcactcgatggcgtgagccatcgcgcccggccatgtatgat

SEQ ID NO: 14310 - DNA, 201 bp, Homo sapiens
  source 1..201: mol_type = unassigned DNA
cctactctcgtgaaaactcttgtgcctgaaaattattgtaaaatatctggaattattattattatttatttttattttttgagacggagtctcgctctgtcgcccaggctggagtgcagtggcgcgatctcggctcactgcaagctccgcctcccgggttcacgccattctcctgcctcagcctcccgagtagctgggact

SEQ ID NO: 14311 - DNA, 201 bp, Homo sapiens
  source 1..201: mol_type = unassigned DNA
ttggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggaccccca

SEQ ID NO: 14312 - DNA, 201 bp, Homo sapiens
  source 1..201: mol_type = unassigned DNA
gtcactgatcctgagcttccgttttttcatctataaaactgagattagggccgggcatggtggctcactcctgtaatcccaacactttgggaggccgaggcgggcggatcacgaggtgaggagtttgagaccagcctgaccaacatggtgaaaccccgtctccactaaaaatacaaaaattagccgggcgtggtggcgcgt

SEQ ID NO: 14313 - DNA, 201 bp, Homo sapiens
  source 1..201: mol_type = unassigned DNA
gcatgttcattgcagaactattcacaacagcaaagacatggatagaccggattaagaaaatgtggtgtatatatatatatgccatggaatactatgcagtcgtaaaaagaacaaaatccggtcctttgcagcaacatggatgcagctggaggccattatccggagtgaattaacacaggaacagaaaaccaaatactgctt

SEQ ID NO: 14314 - DNA, 201 bp, Homo sapiens
  source 1..201: mol_type = unassigned DNA
ccccagttccgtgaccggccctctgctctgtgctgacacccagcaccctccccggcctctgctccgaggggaaaataaaacaggggccttcaggcctcaccgctggctcactccatcgcagcaaatcgaccgagggtcctctgctgcgtccttgcggcctgttgtcttactcagcggccctgacacccggcatttatttaa

SEQ ID NO: 14315 - DNA, 201 bp, Homo sapiens
  source 1..201: mol_type = unassigned DNA
gcgggcggatcacgaggtcagtagattgagaccattctggctaacatggtgaaacccagtctctactaaaaatacaaaaaattagccgggtgtggtggcacgcgactgtagtcctacctactggggaggctgaggcaggagaatcgcttgaacccgggaggcggaagttgcagtgagccgagatcgcgccactgcactccc

SEQ ID NO: 14316 - DNA, 201 bp, Homo sapiens
  source 1..201: mol_type = unassigned DNA
tctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaa

SEQ ID NO: 14317 - DNA, 201 bp, Homo sapiens
  source 1..201: mol_type = unassigned DNA
aaggcaggcggatcacggggtcaggagttcgagaccagcctggccaacttggtgaaaacccgtctctactaaagatacaaaaattagctgagtgttgtggcgcacgcctgtaatcccagctactggggaggctgaggcaagagaatcacttgcaaccgggaggcggaggatgcagtcagcgagatggcgccactgcattcc

SEQ ID NO: 14318 - DNA, 201 bp, Homo sapiens
  source 1..201: mol_type = unassigned DNA
actcagggggctgaggcaggagaatcgcttgaacccgggaggcggagtttgcagtgagccgagattgagccactgcacactccagcctgggcaacaagagcgagactcagtctcagaaaaaataaataaataataaaataaaaagcaggccgggtgcgatggttcacacctataacaccagcactttgggaggccgaggtg

SEQ ID NO: 14319 - DNA, 3238 bp, Homo sapiens
  source 1..3238: mol_type = unassigned DNA
tagaacgccaggcgtgaaaggtgacgttgaggcagcacgagggaaaaagcagcaggcagcgatcgtcacacggacgacagtgccttcccggcagcccctgcgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgccaggcccgagggggttgttgtgtcccaggcttgcacccagggttccacggggggcaccccaaagcggcaagtaggttcccaggggaaggggacagcacgtcaggcttggagggggacgttgaggcagccccgggaataaagaggggatgctggggtcctgccacggataacactgtcttcccgacagcatctgtggtgggcctgggagcgtcatggagtccttggcttgcacccaaggtgcgtgtctcgccctcggggggcaccacaaagcggcaagaaggccaccgggggaagggtatgggacgccagggttgaaagggatagttgaggcagtccggggaaaaacgtggcaggctggggtcgtcccatggacgacagtgccttcccagcagcccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtggagtccctatcttgcacccagggtgcgtgtttcgcccatgggaggcaccccaaagcggcaagtaggcccctgggggaaggggacagcacctcagacttgaagggggactttgaggtagcccgtggaaaaaaacggcgacgctgagtttctcccacaaacgacagtgccttcctggcagccccttcgctgggccagggtggtcctggagtccgtggcttgcacccagggtgcgtgtctcgctcaagggggcaccccaaagcggcaagtagattcccgggggaagggagagcacgtcaggcttgaaggggaggttgaggcggccccggggtaaaagtggtgaagctggggtcctcccacggatgacaccgccttcctggcagcctctgcagtgggcccagaggtgtcgtggagtctctggcttgctcccaggttgtgtgtctcgcccacgagtggcaccacaaagcagcaagaaggcccccaggggaagggtacaggactccagggttgaaaggtagagttgaggcagaccggtgtcatcccaaggacaacagtgtcttgtccggtagcccctgcatcgggcctggggtggttgtggagtccctggcttgcacccggggtgcgtgtcgtgcccacgatgggcaccgcaatgcggtaagaagtccccgagtggaagggaacaggacgccgagcttgaaaggggacgttgaggcagtccggggaaaaaatttccactgagaacagtgccttcccggcagcctctgagtgggacccaggtggacggtggagcccctggcttggacccagggtgcctgtcttgctcacggggtgcacgtgaaagtggcaacagggcccccgggggaaggggacaacatgtcaggcttgaagagggacgttgggccagccagaggaaaacagcggctaggctgtggtcgtcccacagaccacagtgccttcccggcagcccctgagcctggcccaggcgggggggtttggagtccctgtcttgcaacagagtgcgtgtctcgcctaagtgtgcacgcgaaagctgcaagaagggctccgggggaagggaacaggatgccaggcttgaaaggggactttgaggcagtccagggaaaaactttccacggaggacagtgacttcccgacatcccctgcgcctggccctgggggtcttggagtccctggtttacacccagggtgcgtgcctcgcccacgggtggcaccccaaagcagcaagaaagccccggggggggaagaacaggatgccagacttgaaaggggacgttgaggcagcccaggaaaaaaaggggcgaggctggggtcctttcacggatgacagtgccttccctacagcccctatgccagtcccgggagggtcgcggagtccctgtcttgcacacaatgtgcgtgtctcgcccacggggggcaccccaaagtggcaagaagtcccccgcgggaaggcaacaggacgccaggcttgaatggggacgtttaggtagcctggagaaaaaagcagcgaggctggggtgatcccacgaatgacagtgccttaccggcagcccctttgccgggcatgcgggggttgttgattccctggcttgcacccagggtgagtgtcttgcccacggcgggcaccacaaagcagcaagaaggttcccgggggaaagggacagcacgtcagtcttgaagggggaagttgaggcagccccggggaaaaaaagcggggatgctggggtcctctcacggacgacactgccttcccagcagcctctgcagtgggcccgggagcgtcctggagtccctgtcttgcaccccgggtgcgtgtctcacccacggggagcaccacaaagcggcaagaaggccactgggggaagggtacaggacgccagggttgaaggggatagtggagacagtccaaggaaaaaagtggcgggatggtgtcgtcccaaggatggccacccctgcgccgggccagggatggtcgcggagtccctggcttgcacccaggttgtgtgtctcgcccacagggggcaccccaaagcagcacgaaggcctccaggggaagggaagaggacgccaggcttggaaggtgacgttgaggcagcagggggtaaaaagtggcgggccgggccctcccacggatgacagtgccttcccggaagccgctgcgcagggcccggcgtgtttgtggagtctctggcttgcacccagaatcgtgcggcgcccacgacgggcaccccaaagcggcaagatatcccccgctggaagggaacaggatgccaggcttgaaaggagaagttgagccagtccggggaaaaa

SEQ ID NO: 14320 - DNA, 201 bp, Homo sapiens
  source 1..201: mol_type = unassigned DNA
ccaaggctattacctcaaagtgtctcagaaaataatatacagaaggccgggcgcggtggctcacgcctgtaatcccagcactttgggaggccgaggggggcggatcacgaggtcaggagatcgagaccatcctggctaacacggtgaaaccccgtctctactaaaaacacacacacacaaaattagccgggcgaggtggca

SEQ ID NO: 14321 - DNA, 201 bp, Homo sapiens
  source 1..201: mol_type = unassigned DNA
ccaccatctattcattactctgcctgcaatttgggccatcactcattagtaatttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcg

SEQ ID NO: 14322 - DNA, 201 bp, Homo sapiens
  source 1..201: mol_type = unassigned DNA
acggtgattagaaatgcatcaaactctgaatgtacaaaagagagagcttcaatatgaaacagtaatcctctgagaacgaagaccccgcagtgccggtgcccgctgggccgtgcaggtctcggccgccccacgcccgtgtccgtctccaccgtgaccccctcgcccccggcacgcccagggtcaacccccgggcttattgca

SEQ ID NO: 14323 - DNA, 201 bp, Homo sapiens
  source 1..201: mol_type = unassigned DNA
cctggggatcattctgcctccttgctctgacttcttctttttttttttttttttttttgagacggagtctcgctctgtcgcccaggctggagtgcagtggcgcgatctcggctcactgcaagctccacctcccgggttcacaccattctcctgcctcagcctcccgagtagctgggattacaagtacccgccaccacgccc

SEQ ID NO: 14324 - DNA, 201 bp, Homo sapiens
  source 1..201: mol_type = unassigned DNA
cccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggcc

SEQ ID NO: 14325 - DNA, 201 bp, Homo sapiens
  source 1..201: mol_type = unassigned DNA
cggcgcccggcatgaaactttttttttttttttgagacagagtctcgctcttgcgcccaacctggagtgaagtggcacgattttggctcatggcaacctccgccccgcaggatcaagctattatcctgactcagcctcccgagcagttgggattacaggcacccaccactatggccggctaatttttgttttttgcttttt

SEQ ID NO: 14326 - DNA, 201 bp, Homo sapiens
  source 1..201: mol_type = unassigned DNA
aagcagcttcttaaaattttaaaaagtaagcatagctctaggaaggagggaggtcagtgaaatcaaactcctgtcgacaagcttaaagtaactggcaagacgctgggaaactagatactgaaacatccgctcttaacttttaacctgtcactatttgaaataaagttatcagggatagccgggcgcggtggctcacgcctg

SEQ ID NO: 14327 - DNA, 201 bp, Homo sapiens
  source 1..201: mol_type = unassigned DNA
atctattgaagaagctgaagtgtgaagtgtgaaattgaagaaccctgaaatgtattgagcagtgaaaagattatgtatacaaaaacaggttggccgggtgcggaggcaggcagatcacctgaggtcaggaggcgcgatctcggctcactgcaagctccacctcccgcgttcacgccattctcctgcctcagcctccggagt

SEQ ID NO: 14328 - DNA, 201 bp, Homo sapiens
  source 1..201: mol_type = unassigned DNA
attttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccctg

SEQ ID NO: 14329 - DNA, 201 bp, Homo sapiens
  source 1..201: mol_type = unassigned DNA
gtggcgcaatctcggctcactgcaagctccgcctcccaggttcatgccattctcctgcctcagcctcctgagcagctggtactacaggcgccgaccaccacgcccggctaattttttgtattttttgatagagacggggtttcatcgtgctacccaggatggtctcgatattctgaccttgtgatccgcctgcctcggcct

SEQ ID NO: 14330 - DNA, 201 bp, Homo sapiens
  source 1..201: mol_type = unassigned DNA
ggtgggcgggtcacgaggtcaggatatcgagaccatcctggctaacacggtgaaaccccgtctctactaaaaatacagaaaattagccgggcatgttggcgggcacctgtaagtcccagccactcgggaggctgaggcaggagaatggcgtgatcccgggaggcggagcttgcagtgagccgagatcacgccactgcactc

SEQ ID NO: 14331 - DNA, 208 bp, Homo sapiens
  source 1..208: mol_type = unassigned DNA
tttatttatttatttttgagacagagtctcgctctgtcgcccaggctggagtgcagtggtgtgatctcggctcactgcaagctccgcctcccgggttcacgccattcggcctcagtctcccgagtagctgggactacaggcgcccgccaccacgcccggctaattttttatatttttagtagagacagggtttcatcatgttagccag

SEQ ID NO: 14332 - DNA, 201 bp, Homo sapiens
  source 1..201: mol_type = unassigned DNA
tttctttcttttttttttttttttttgagacggagtctggctctgttgcccaggctggcgtgcagtggctcactgcaccctccgcctcccgggttcaagcgattctcctacctcagcctcccaagtagctggggctaaaggcctgtgccactatgcccggctaattttttgtactttagtagagacggggtttcaccgtgt

SEQ ID NO: 14333 - DNA, 201 bp, Homo sapiens
  source 1..201: mol_type = unassigned DNA
ccgtggtgcaatctcagctcattgcaacctctgccggcagggttcaagcaattctcctgcctcagtctcccgagtagctgggattacaggcacgcaccacgatgcccggttaatttttgtatttttagtagagatggggtttcaccatgttgaccaggctggtcttgaactcctgacctcaggtgattcgcccacctcggc

SEQ ID NO: 14334 - DNA, 201 bp, Homo sapiens
  source 1..201: mol_type = unassigned DNA
gtgggtttcaaacatcttacaagctagagtaatcagaacagtatggtactggtataaagacaggtacacagcccgtccggtcccgtcccgtcctgccgccgcgcctgtcagccatgagctccatgcagttaaacaaaggcccctctgtggactcttggctgaggttaagaaccggctcctgtccaaatatgacctccagaa

SEQ ID NO: 14335 - DNA, 201 bp, Homo sapiens
  source 1..201: mol_type = unassigned DNA
cattgacctggaagaacggaatgatagttagtgaggcacactcagcaaccgagcacggccagtgccggtccccggctcccgagacactgacccacgcagcgccaggatccggggaccctctaggtgcaaatcagaggccaaacagcctgcctggccaatgggtcagaatctgtggttgaacagaggctttgttgtggtttt

SEQ ID NO: 14336 - DNA, 201 bp, Homo sapiens
  source 1..201: mol_type = unassigned DNA
ctattcttgggggatgagaggagggatggtgagaggacactcttaaagaacatttggggccggggaagaatccttcatgatctcgccctataacctggccgctcatcttgcattctgctgcacgctgcccggcctttggccatgttatgtgaactcctggagccatccttctttcttctttacctggatggagagggcctc

SEQ ID NO: 14337 - DNA, 201 bp, Homo sapiens
  source 1..201: mol_type = unassigned DNA
tttaacagatatgaaaactgaaggccgggcgcagtggctcaagcctgtaatcccagcactttgggaggccgaggcgggcggatcacgaggtcaggagatcgagaccatcctggctaacacagtgaaaccccgtctctactaaaaatattaaaaattagccgggcgtggtggcgggcgcctgtagtcccagctacttgggag

SEQ ID NO: 14338 - DNA, 201 bp, Homo sapiens
  source 1..201: mol_type = unassigned DNA
ctgaatagctgggactacaggcgcctgccaccgcgcccggctcattttttgtgtgtttttagtagagacggggtttcaccgtgttagccaggatggtctcgatctcctgacctcgtgatccgcccgcctcggcctcccaaagtgctgggattacaggcttgagccaccgcgcccggctaaaacaactaatttttgtgttaa

SEQ ID NO: 14339 - DNA, 201 bp, Homo sapiens
  source 1..201: mol_type = unassigned DNA
acggacccttgcggtgagtgttacagttcttaaaggtggcgtgtccggagtttgttccttctgatgttcggatgtgttcggagtttcttctggtgggttcgtggtcttgccggctcaggagtgaacctgcagacctttgcggtgagtgttacagctcataaaggcagtgtggacccatagagtgaacagcagcaagattta

SEQ ID NO: 14340 - DNA, 201 bp, Homo sapiens
  source 1..201: mol_type = unassigned DNA
tattaaaaataaagaaggaggccgggcgcggtggctcacgcctgtaatcccagcactttgggaggccgaggtgggcggcggatcacgaggtcaggagatcgagaccacggtgaaaccccgtttctattaaaaatacaaaaaattagccgggcgcggtggcgggcgcctgtagtcccagctactgggaaggctgaggcagga

SEQ ID NO: 14341 - DNA, 201 bp, Homo sapiens
  source 1..201: mol_type = unassigned DNA
gtcaagacagcgccattgcactccagcctgggaatagagcgagactccgtctcaaaaaaaaactattgatatacataaatacctgtgaaaccggctgggcgcggtggctcacgcctgtaatcccagcattttggggggccgaggcgggcgtattacaaggtcaggagatcgagaccatcctggctaacacggtgaaacccc

SEQ ID NO: 14342 - DNA, 235 bp, Homo sapiens
  source 1..235: mol_type = unassigned DNA
gtctacagctcccagagagagcgacgcagaagatgggtgatttctgcatttccatctgaggtaccgggttcatctcactagggagtgccagacagtgggcgcaggtcagtgggtgcgcgcaccctgcgtgagccgaagcagggcgaggcattgcctcactccggaagcacaaggggtcagggagttccctttcctagtcaaagaaaggggtgacagacggcacctggaaaattgg

SEQ ID NO: 14343 - DNA, 201 bp, Homo sapiens
  source 1..201: mol_type = unassigned DNA
ccccgagtagctggcgctacaggcgcccaccaccacgctcggctaattttttgtatttttagtagagacagggtttcaccatgttagccaggatggtctcgatctcctgacttcgtgatccgttcgccttggcctcccaaagtgctgggattacaggcatgagtcaccgcggccggccctaatcatgtatctttatctacc

SEQ ID NO: 14344 - DNA, 201 bp, Homo sapiens
  source 1..201: mol_type = unassigned DNA
ctgattatccaggtgcgtctgtcacccctttttttgactcggaaagggaactccctgtccccttgcgcttcccaagtgaggcaatgcctcgccctgcttcggcttgcgcatggtgcacgcacccactgacccgcgcccactgtctggcactccctagtgagatgaacccggtacctcagatggaaatgcagaaatcacctg

SEQ ID NO: 14345 - DNA, 201 bp, Homo sapiens
  source 1..201: mol_type = unassigned DNA
tgggccgctgggtgcccgggctgtcctcctactgcccaggacaaactccacctcgtcccaccggtcgatggcctgccggggagcccgcgggcgagccggcgtctgtaggtgtgttcttctgctgacatgctctccgtgaccagccgcttctgtcttcttccactgatgcgttcctctcgccctccagcagcttctgtctct

SEQ ID NO: 14346 - DNA, 201 bp, Homo sapiens
  source 1..201: mol_type = unassigned DNA
cacctggctcggagggtcctatgcccaccgagtcttgctgattgctagcacagcagtctgagatcaaactgcaaggcagcagcgaggctgggggaggggcgcccgccattgcccaggctcgcttaggtaaacaaagcagccgggaagctcgaactgggtggagcccaccacagctcaaggaggcctgcctgcctctgtagg

SEQ ID NO: 14347 - DNA, 201 bp, Homo sapiens
  source 1..201: mol_type = unassigned DNA
ccgccttgcagtttgatcttagactgctgtgctagcaatcagcgagactctgtgggcgtaggaccctctgagccaggtgccggatataatctccaggtgcgccgttttttaagcccgtcggaaaagcgcagtattctggtgggagtgacccgattttccaggtgccttctgtcacccctttctttgactaggaaagggaac

SEQ ID NO: 14348 - DNA, 201 bp, Homo sapiens
  source 1..201: mol_type = unassigned DNA
agcgacgcagaagacgggtgatttctgcatttccatctgaggtaccgggttcatctcactaagggagtgccagacagtgggcgcaggccagtgggtgcgcgcaccgtgcgcgagccgaagcagggcgaggcattgcctcacctgggaagcacaaggggtcagggagttccctttccgagtcaaagaaaggggtgacggacg

SEQ ID NO: 14349 - DNA, 201 bp, Homo sapiens
  source 1..201: mol_type = unassigned DNA
catcaggacaccctggctgcagagaggagctacccaccgcgagtctcctctgagctgttctattactcagtaaagctcctcttcaccttgctcaccctccgcttgtccacgtacgtcattgttcccgggcgctgaacctgccaaatggtggaggtgaaagagctctaacacaaacagagctgaaacacgccccttgcttgc

SEQ ID NO: 14350 - DNA, 201 bp, Homo sapiens
  source 1..201: mol_type = unassigned DNA
gctggagtgcaatggcatgatcttggctcactgcaacatctgcctcccgggatccagcaattctcctgcctcagcctcccgagtagctgagattacaggcgaccaccaccacgcccggctgatatttgtatttttagtagagacggggtttcaccatgttggccaggctggtctcgaactcctgacctcaggtgatctgcc

SEQ ID NO: 14351 - DNA, 201 bp, Homo sapiens
  source 1..201: mol_type = unassigned DNA
cactgttggcactagcatctggaagaggggaacaccgtggctcctgaaaacttggagccgccagcaactgaggagtcccaaggagtgagacgggggtgtcgttctaccactctctcattcctgcagccggcagctttgttagcggtgggggccgggttgaggggtggtggtatactaggggggtggtggtatatactacag

SEQ ID NO: 14352 - DNA, 201 bp, Homo sapiens
  source 1..201: mol_type = unassigned DNA
gtcttccggcactaccagtatctgggccctctggagcggaagtggctggccggggatatgcagctcacagaggtccagatgaaaacctggtttcaaaaccgccagatgaaacacgaacggcaaatgcaggattcacagctgaacagccccttcttggggtctctccacgcgcccgggctttccactcaccgtcttctggcc

SEQ ID NO: 14353 - DNA, 207 bp, Homo sapiens
  source 1..207: mol_type = unassigned DNA
accagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagc

SEQ ID NO: 14354 - DNA, 201 bp, Homo sapiens
  source 1..201: mol_type = unassigned DNA
acatcaggggaagaagacacaagcgctggtcatccataggagcaccccagcagaaggacacgctgacaggcacccggaagccagtaggccgtggaccagcgggaggaggcggaggttggcctgggcagtcaggggagagccggggctgccgagcaccccaactccaggggaaaaccatctcccttctggctgccccatggg

SEQ ID NO: 14355 - DNA, 201 bp, Homo sapiens
  source 1..201: mol_type = unassigned DNA
ccgattttccaggtgcgtccgtcacccctttctttgactcggaaagggaactccctgaccccttgcgcttcccaagtgaggcagtgcctcgccctgcttcgcgcacggtgcacgcacccactgacctgcgcccactgtctggcactccctagtgagatgaaaccggtacctcagatggaaatgcagaaatcacccgtcttc

SEQ ID NO: 14356 - DNA, 201 bp, Homo sapiens
  source 1..201: mol_type = unassigned DNA
ccacgccccaggcacaccgacatctccgcactggttccctccaggaggccacgccccaggcacacgggcatctccacactgactccctctagtaggccacgccccaggcacacgggcatctccacactgactccctccgggaggccacgccccaggcacacgggcatctccacactggttccctccaggaggccacgcccc

SEQ ID NO: 14357 - DNA, 201 bp, Homo sapiens
  source 1..201: mol_type = unassigned DNA
gcccctctgcccggccgcccagtctgggaagtgaggagcgcctcttcctggccgtcatcccgtctaggaagtgaggagcgtctctgcccggccacccatcgtctgggatgtggggagcacctctgccaggccgcgaccccatctgggaactgaggagtgtctctgccccgccaccaccccatctgggaggtgaggagcgtc

SEQ ID NO: 14358 - DNA, 201 bp, Homo sapiens
  source 1..201: mol_type = unassigned DNA
gagggagacgcggggcgggaactggggctgctcgcggtaggccagagcaagttctgggtggacatggccttggcgggccccacactccgagcagctggccgccccaccagccccgggcagtgaggggcttaccacccgggacagcagctgtggagggtgcgccgagtcccccagcagtgccagcccgccggcgctgtgctc

SEQ ID NO: 14359 - DNA, 201 bp, Homo sapiens
  source 1..201: mol_type = unassigned DNA
tctgattaaaaataaataaatatggccgggtgcggtggctcaggcctgtaatcccagcatttcgggaggccgaggcggtggatcacaacgtcaggagatcgagaccatcctggctaacacggtgaaaccccatctctactgaaaatacaaaaaattagccgggcgtggtggtgggcacctgtagccccagctactcaggag

SEQ ID NO: 14360 - DNA, 201 bp, Homo sapiens
  source 1..201: mol_type = unassigned DNA
cggccagggggcacccctagacgcacagaagcttcggaggccatggcaagtctgcaaccgggacccgcctctaggctcacacgtgtagctttccagctgcgcaatctccttaaatggagcagctccggcgtgggtggggcccgggccggcagtgggggcggggccggcagtgggggcggggccagtcgggggaggaggggg

SEQ ID NO: 14361 - DNA, 201 bp, Homo sapiens
  source 1..201: mol_type = unassigned DNA
tatggcgaaaccccatctctactaaaaatacaaaaattagttgggcgtggtagtgcacgtctgtaattccagctacttgggaggctgaggcaggattatcgcttgaacccggaaggtggaggttgcagtgaaccaagagagcggttctgcactacagcctgaacgacagagcaagactccatctcaaaataactaactaac

SEQ ID NO: 14362 - DNA, 201 bp, Homo sapiens
  source 1..201: mol_type = unassigned DNA
atcacgcccggctaattttttttttttgtatttttagtagagacggggtttcaccgtgttagccaggatggtctcgatctcctgacctcataatccgcccgcctcggcctcccaaagtgctgggatgacaggtgggagccaccgcgcccggcccaattcagcgttcgatatttgaagacgatctgggtcagaggagaccgc

SEQ ID NO: 14363 - DNA, 201 bp, Homo sapiens
  source 1..201: mol_type = unassigned DNA
agcgagccgccgatgccagcgagatgccaggctggactcagcaagccgccgatgccagccagacgcagagcagagaacgctggtcaaagagcagctaggcggtgtctgctcggccgaagcccagtcccggagaggcaggctctgtaccaggacgtggaggctccggggtcatgaaacccccagggtgagagacaaaggtag

SEQ ID NO: 14364 - DNA, 380 bp, Homo sapiens
  source 1..380: mol_type = unassigned DNA
tttttttttttttttttagacggagtctagctctgtctccatgctgcagggcagtggcgcggtctcggctcactgcaacctccgcctcccgggttcccgcgattctcctgcctcagtctcccgagtagctgggactacaggcacacgccaccacgcccagctaatttttgtttgtttgtttatttatttattattatttttgagacggagtctcgctctgtcatcaggctggagtgccattggagtgcaatggcacgatctcggctcactgcaatctccgcctcccgggttcaagcaattcccctgcttcagcctcccgtgtaactgggactacaggcacgtgccaccacccccagccaattttttgtattttagtagag

SEQ ID NO: 14365 - DNA, 201 bp, Homo sapiens
  source 1..201: mol_type = unassigned DNA
gagtgcaatggcgcgatctcggctcactgcaagctccgcctcccgggttcacgccattctcctgcctcagcctcccaagtagctgggactagaggtgcccgccgccacgcccagctaattttttgtatttttagtagagacggggtttcaccgtattagccaggatggtctcgatctcctgacctcgtgatccgcccgcct

SEQ ID NO: 14366 - DNA, 201 bp, Homo sapiens
  source 1..201: mol_type = unassigned DNA
cacagggtgtcgaaatcaagccacccagggagcccgcagatcccaccctctccggtgagagagtttggtggggagcacttcatccaatgcagggaacagcgttactgcggccttcacctcccggcttcaagtgattcacctgccgcagcctcccaagtagttgggattacaggcgcgtgccaccacgccgggctagttttt

SEQ ID NO: 14367 - DNA, 201 bp, Homo sapiens
  source 1..201: mol_type = unassigned DNA
ttcctcccttgggggctccctcatgcctcatgcagctcatggtgtggggttcattggccctggcggggtggaaggtcccatgccgtcgtcgtctcacgtcgtcggtggtgggggcttgttgggggttgggaggaaggcaaataggaagggtccaccggggagagggtgggggagcacgtcacagtcgccgcagttcgccgt

SEQ ID NO: 14368 - DNA, 201 bp, Homo sapiens
  source 1..201: mol_type = unassigned DNA
tccaggtgcgtccgtcacccctttgactcggaaagggaactccctgaccccttgcgcttcccaagtgaggcaatgcctcaccctgcttcggctcacgcacggtgtgcgcacccactgacctgtgcccactgtctggcactccctagtgagatgaacccggtacctcagatggaaatgcagaaatcacccgtcttctgcgtc

SEQ ID NO: 14369 - DNA, 201 bp, Homo sapiens
  source 1..201: mol_type = unassigned DNA
ggctgtagtgcagtggcgcgatctccgcttactgcaagctcctcctcccgggttcacgccattctcctgcctcagtctctgagtagctgagactacaggcgcccgccaccacacccggctaattttttgtaaaaaatttaaaaaaaaaattaaagataaaatgggttcggcagtatgatactctttatccctaattatttg

SEQ ID NO: 14370 - DNA, 201 bp, Homo sapiens
  source 1..201: mol_type = unassigned DNA
ttctgttttccctaagcgtcggccaggttgagaaataaagggacagagtacaaaagagggaaattttaaagccgggcatccgggggagacatcacatgtcggtaggttctgtgatgcccctgagccgtaaaaccagcaagtttttattagggattttcaaaaggggagggagtgtacgaatagggtgtgggtcacagagat

SEQ ID NO: 14371 - DNA, 201 bp, Homo sapiens
  source 1..201: mol_type = unassigned DNA
agcagtgcccctacaaacaggcgtgaaaaccgagcatgtcttgggctggtcagctgaatcattgcgtgtagagagggagtcctggccgcacaggcacagcggcggattatgtttctacatatgtcgcctgtatagaaaatggagaataagctcctccctgggccgggtttttaagattataacaataagagttcgccaaag

SEQ ID NO: 14372 - DNA, 201 bp, Homo sapiens
  source 1..201: mol_type = unassigned DNA
ccccaggggcctcaaaccggagccttatctccaggacccacaaaactctagacacagccaggacctgccagggagaccagcctcctccggcagcctgggcgctgctgtttccaacacacagtgataacccggaacccatcctcagagttactcagaaacacgctctggagatggtgccttccgaaagacctctactcccaa

SEQ ID NO: 14373 - DNA, 201 bp, Homo sapiens
  source 1..201: mol_type = unassigned DNA
ggatgtctggttatatctgatttctcacctctgggtatggaggtctgtctgcagaggcccgggcccgggcacaaagggagagagaggcctccattgtcccgcaggggccgaaatgcagaccgtgcatccccggtgacctcggggacccttctctgatcatcaggattctcttggactctagggtccttgtcctgctcaggc

SEQ ID NO: 14374 - DNA, 201 bp, Homo sapiens
  source 1..201: mol_type = unassigned DNA
ttagtagagacggggtttcaccgtgttagccaggatggtctcgatctcctgacctcgtgatccgcccgtctcggcctcccaaagtgctgggattacaggcgtgagccaccgcgcccggccacctattttttttaagagatggttgatatgatttcaatcttcttaaatttctgaagacttgttttgtgacctagcatgtga

SEQ ID NO: 14375 - DNA, 568 bp, Homo sapiens
  source 1..568: mol_type = unassigned DNA
aggtggagctgcctgccagtccggcgccgtgtgcccgcactcctcagcccttgggcagtcgatgggactgggcgccgtggaacaggggttggcgctcgtcggggaggcttgggctgcacaggagcgcacggcgggggtggaggctcaggcatggagggctgcaggtcccgagccctgcccggcggggaggcagctaaggcccagcgagaagtcgagcacagcagctgctggcccaggtgctaagctcctcactgcccgggccggctggccgctccgagtgcggggcttgccaagcccacgcccacccggaactcgagctggcccgcaagcgcagcctgcagccacggttcccgcccacgcctctctctccacacctacccgcaagctgagggagccggctccagccttgtccagcccagaaaggggctcccacagtgcagcgacgggctgaagggctcctcaaacgcggccagagtgggcgccaaggccgaggaggtgccgagagggagcgagggctgtgagggctgccagcacgctgtcacctctcatttttgtgtctgtatactaa

SEQ ID NO: 14376 - DNA, 201 bp, Homo sapiens
  source 1..201: mol_type = unassigned DNA
tcttttcttttctttcttttttttctttttttgagacggactcgtgctctgtcgcccaggctggagtgcagcggcgcgatctccgctcactgcaagctccgcctcccgggttcacgccattctcctgcctcagcctcccgagtagctgggactacaggcacccaccatgatgcccagctaattttttgtatttttagtaga

SEQ ID NO: 14377 - DNA, 201 bp, Homo sapiens
  source 1..201: mol_type = unassigned DNA
atcccagagaagcccatgggagccccagggagagttttctttgtgaagggcagggcaccctggaatgggtttgccgagcccgctcccacccggaactcacgcttgcccacaagcgccccacacagccctggttcccacctgcgcctctccctccacacctccccgcaagcagagggagccaactccggccttggccagccc

SEQ ID NO: 14378 - DNA, 201 bp, Homo sapiens
  source 1..201: mol_type = unassigned DNA
ggataaagaaaatgtggtatatggctgggcacggtggctcacgcctgtaatcccggcactttgagaggccaaggcgggcagatcacgaggtcaggagatcgagaccatcctggttaacacgatgaaaccccatctgtactaaaaaatacaaaaaattagccaggcatggtggcgggtgcctgtagtcccagctacttggga

SEQ ID NO: 14379 - DNA, 201 bp, Homo sapiens
  source 1..201: mol_type = unassigned DNA
ctgcactccagcctgggggacagagtgagactccgtctcaaaaaagaaagaaaaaaatgcccctccctccctgttccccctgactcctactctgtcttgcgggctcttcactaacaaccgcccgtgtttgacccgggtgcccctcccatcacaaccttccccccaggtgcatgtccccataacaaagttcaccccatggtt

SEQ ID NO: 14380 - DNA, 201 bp, Homo sapiens
  source 1..201: mol_type = unassigned DNA
ctagccccatccatgcgccactcatggataagggtaatcaccagcagcagtgattatgtgtgtcaggcactcgtaggtcccttcccgttctctgaaccacgtgctacgcccagctcagggatgataaactgaggtgcacgagtaggtgagaagacgaacagtgtacccgggcaaggccgccagcccttttgtgctcctgtg

SEQ ID NO: 14381 - DNA, 201 bp, Homo sapiens
  source 1..201: mol_type = unassigned DNA
ccatcattgatatccacccttcctccacctacagcatccgcatgtacgccaagaaccggattggcaagagcgagcccagcaacgagctcaccatcacggcggacgaggcaggtacgtgggaccgggcggaaccttgctccagaggagcccgggagctaactcttgagggctcagatgcttaaatgcagaagcagacctttg

SEQ ID NO: 14382 - DNA, 201 bp, Homo sapiens
  source 1..201: mol_type = unassigned DNA
gcgggaggcgcgcaagtgacacactgaggggcccaggcagcagcccccatacgctgccaggtcagagcagccccgggccacgtgggtgcccccagctgccgctgtaggcggaggtacgccggttcctcaaggatgtgacagcggctggactttcatgaccactgcttggccaccagagggcaagtcccagggccagccaag

SEQ ID NO: 14383 - DNA, 201 bp, Homo sapiens
  source 1..201: mol_type = unassigned DNA
gggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgag

SEQ ID NO: 14384 - DNA, 201 bp, Homo sapiens
  source 1..201: mol_type = unassigned DNA
taacattgtttgcaaatgattgaaccggcctctgaccctctcagagaagatcgtgtacagacacccggatgaccccaccagccaggaaattgagcggggcgggacgtacctgcagcagtggccggacagcgtgaccatgcaggatggacggcccagatggccatgctgcagttcatcagcagcaggctcccaaggtgacca

SEQ ID NO: 14385 - DNA, 201 bp, Homo sapiens
  source 1..201: mol_type = unassigned DNA
ccggacagtaaacacgcgtgggtctcccctgtgccggacagtaaacacgcgtgggtctccctgtgccaaacggtaaacacgcgtgggtctctcgtgtgccgaacagtaaacacgcgtgggtctcccctgtgcccgacagtaaacacgcgtgggtctcccgtgtgccggatgataaacacgcatgggtgtcctgtgtgctgg

SEQ ID NO: 14386 - DNA, 201 bp, Homo sapiens
  source 1..201: mol_type = unassigned DNA
gtttcaccatgttggctaggctggtctctctaactcctgacctcgtgatccacccacctcggcctcccaaagtgctgggattacaggagtgagccactgcgcccggccgagattcttatgctattattctatgaagcccttggcacaatgcttgacacacagtaggtacctgataagtggagcttctattgctgttcccct

SEQ ID NO: 14387 - DNA, 201 bp, Homo sapiens
  source 1..201: mol_type = unassigned DNA
gagccaggtgtgggatatagtctcgtggtgcgccgttttttaagcccgccggaaaagcgcagtattcgggtgggagtgacccgattttccaggtgcgtccgtcacccctttctttgactaggaatgggaactccctgacccctcgtgcttcccgagtgaggcaatgcctcgccctgcttcggctcgcgcacggtgcgtgca

SEQ ID NO: 14388 - DNA, 201 bp, Homo sapiens
  source 1..201: mol_type = unassigned DNA
tcctttggagccaactgtgctttcattactttaaatagagcagtcgggaccgggcgctgtgcctcacgcctataatcccagcactttgcgaggccgaggcgggcagatcacgaggtcaggagatcgagaccatcctggctaacatggtgaaaacctgtctccactaaaaatacaaaaaattctccgggcgtggtggcgggc

SEQ ID NO: 14389 - DNA, 201 bp, Homo sapiens
  source 1..201: mol_type = unassigned DNA
ccgacagagtgaaatggcggcggcggccgggatgatgctgctgggcttgctacaggcgggtgggtaggtgctgggccaggcgatggaggaggtggcaggcggcaacctcttgtccatgctgctgatcgcctgcgccttcaccctcagcctggtctacttgttccgtctcgctgccggccacctggtccagctgaccgcagg

SEQ ID NO: 14390 - DNA, 201 bp, Homo sapiens
  source 1..201: mol_type = unassigned DNA
gtgaaaccctgtctctactaaaaataccaaaaaaattagccggcgcggtggcaggcgcctgtagtcccagctactcgcaaagctgaggcaggagaatggcgtgaacccgggaggcggagcttgcagtgagctgagatcgcgcctccgcactctagcctgggtgacagagcgagactctgtctcaaaaaaaaagcagtctgg

SEQ ID NO: 14391 - DNA, 201 bp, Homo sapiens
  source 1..201: mol_type = unassigned DNA
tttttatttttgtttttgagatggagtctcactcttatccaggctggagtgcagtagcatgatctgggctcactgcaatctctgcctcccgggttcagtcgattctcttgcctcagcctcccaagtggctggaattacaggcacacaccaccacacccggcaaatttttttttttttttttttgtatttttagtagactgt

SEQ ID NO: 14392 - DNA, 201 bp, Homo sapiens
  source 1..201: mol_type = unassigned DNA
catggtgaaactccgactctgctaaaaacacaaaaattagccgggcgtggttgtgagcacctgcaatcccagctacttgggaggctgaggcaggagaatcgctagaacccgggaggtggaggttgcagtgagccaagatggcaccactgcactccagcctgggcaatagagtgagactccatctcaaaacaaaaaaaaaca

SEQ ID NO: 14393 - DNA, 201 bp, Homo sapiens
  source 1..201: mol_type = unassigned DNA
acctgctttaaggactggaagaggaaaatcaaaaataccatttgaaaggccggacgcggtggctcacacttgtaatcctagcactttgggaggccaaggcgggcggatcacgaggtcaggagttcgagaccagcctggccaacacaatgaaaccccgtctctactaaaaatacaaaaattagctgggcttggtggcaggca

SEQ ID NO: 14394 - DNA, 201 bp, Homo sapiens
  source 1..201: mol_type = unassigned DNA
tgcagtggcacaacctctgctcctgcaacctccccctcccggcttcaagcgattctcgcgcctcagctcccaagtagctgggattacaggctcgagccccgcccggctaattttttccatatttttagtagagatggggtttcaccatgttggccaggctggtctcgaactcctgacctcaagtgatccgcccaccttggc

SEQ ID NO: 14395 - DNA, 201 bp, Homo sapiens
  source 1..201: mol_type = unassigned DNA
aacacgggtggctccgcgcaggacgggggccccagggccgcttgagccggaggacagcccgcagtctccaccgtctgcagttgaagtgtgttgtgagatcgctgcaggggcccgggccacctctgccttgggggaccctaaaaagctgagccacacccatgttgaaacttccactgaggataatcacgcaccatacagacc

SEQ ID NO: 14396 - DNA, 201 bp, Homo sapiens
  source 1..201: mol_type = unassigned DNA
agcctccgctgaccccagcacgagccgctcatacacattcaaggccggcagcacagcggcatatgtggcaaaaccgagcaggcgtggatgggaagggagcgcatcagcctgcgtgtgaaggccacatctaggggcggagggaggggagaaacacctctgccgtatctgcagtgtttcacttctctcagtaacccaaaacgc

SEQ ID NO: 14397 - DNA, 234 bp, Homo sapiens
  source 1..234: mol_type = unassigned DNA
ccctgctgacgcagtgcccgccgccgttcctggatgacttcagtggtgaagtggtgcaccatgtcacaggcctgccggaacctccgcccatccgccgagcggtagtaaatgaagtcgaggtagtggtgcaagcgatactggcgccggacagacagagcgctcagttcaatgatagcggagatataatcactcatcttcctgccaaggagaaggggatccatgagtgtagcccct

SEQ ID NO: 14398 - DNA, 201 bp, Homo sapiens
  source 1..201: mol_type = unassigned DNA
cagctttctcatctgtgcagtgggcgcaatgtcgatgactgcctccgggaagtcagacggtgtctgggaggcgctgagctggggctgacacagagcgagcgctccgtgaagtacctgggtcctgtgatgtttccaagtctacagacgcatcacgccatgaggaacacacctgggctggcgatgctggagacaagggacccc

SEQ ID NO: 14399 - DNA, 201 bp, Homo sapiens
  source 1..201: mol_type = unassigned DNA
cagtgagcacagaccgcgccactgcactgcagcctgggtgacagaagtgaaaagaaacactgtctcaaaaaaaaaacaggagggaggagccaagatggccgaataggaacagctccggtctacagctcccagcgtgagcgacgcagaagacgggtgatttctgcatttccatctgaggtaccgggttcatctcactaggga

SEQ ID NO: 14400 - DNA, 201 bp, Homo sapiens
  source 1..201: mol_type = unassigned DNA
gatgaaaccccgtctctactaaaaatacaaaaatttagccgggcgtggtggcggacgcctgtagtcccagttattcaggaggctgaggcaggcgaatggcgtgaacccgggaggcggagcttgcagtgagccgagattgcgccactgcactccagcctgggcgacagagcgagactctgtctcaaaaacaaaataaaatta

SEQ ID NO: 14401 - DNA, 201 bp, Homo sapiens
  source 1..201: mol_type = unassigned DNA
gtgagtgtggggtccagctggctgttccaagcaccggtacacaggcaggttctaggcagggcttgcagctggaccaggcatgtcaccccgaagggaatgcggtggcaccccaagaggggtgctcagaccttgaagccccggaaggggcgattctacttgctaattagctcttttagttctgccatccgcagccctagggat

SEQ ID NO: 14402 - DNA, 201 bp, Homo sapiens
  source 1..201: mol_type = unassigned DNA
gtgcggctccttagccagggcagctcgaaatccaggaacgctccaaggtcatcctgtgggaactgtggcgccagggcccctgaacaccctcctgtcctccgagtcgagtcgctccatctgcctcctaaacgggcttcgggaggaaggcccgcgtgtctcctcaaggtgaggagctactgatgtaaactccctgcaaggacc

SEQ ID NO: 14403 - DNA, 201 bp, Homo sapiens
  source 1..201: mol_type = unassigned DNA
ggggacccagctcacgtgtgtgggggccgtgcgtgtccgtttcgcctgttcatgtatgtcacacatgtgagagtccacagcgagggcagcctttacacgcgatggcccagaggagcgagcatctcaggctcctcagcacgtctctgtgctgacctcctgcagcactgccgggagccatgtgagtgtccacgcctgtgtgtg

SEQ ID NO: 14404 - DNA, 201 bp, Homo sapiens
  source 1..201: mol_type = unassigned DNA
tccatccgcctttcgtctccctccctgctggatctgaggcgccgctcccgccgcgctgtcctcgcgccatgccacgtcacgtcacgtcacgtcacgttacgttcccacgtcacgtccacgtcacgttcccacttcccgtccacagggaaacgggccccggcgatgtgagggcgtctgccgtgcttggtgccttcacagggg

SEQ ID NO: 14405 - DNA, 201 bp, Homo sapiens
  source 1..201: mol_type = unassigned DNA
agttcttaaagcctcaactccttcttttttttttttttttctttttttttttttttgagccggagtctcactctgttgccaggctggagtgcagtggcgcgatctcagctcactgcaacctctgcgtcccgggttcaagggattctcctgcctcagcctcctgagtagctgagactgcaggcacgtgccaccacgcccagc

SEQ ID NO: 14406 - DNA, 201 bp, Homo sapiens
  source 1..201: mol_type = unassigned DNA
ttgtaggacagccctaaaaaggaaggctatcttttttctgtctaccaccgtagtttgctaaccaatcagaaggcaggcgctgagacagtaacaaccagccgacagttgcggaggactgccgggactcccacagagctcgacaagtgggatcacagtcatcaccagccactgagaagagtgtcccctacccacagagtgcaa

SEQ ID NO: 14407 - DNA, 201 bp, Homo sapiens
  source 1..201: mol_type = unassigned DNA
tcaaactcccagagggcttactgtaagattctccccgggcctgaaagcttaagatgaataactcctcccttttcaggcccagtcccaaggcgcaacttgcgccagcagggtgcgccagcagggtgcgccagcagggtgcgccagcagggtgcgccagcagggtgcgccagcagggtgcgccagcagggtgcgccagcaggg

SEQ ID NO: 14408 - DNA, 686 bp, Homo sapiens
  source 1..686: mol_type = unassigned DNA
atcatgcctcagccttcctggccgctctcacctccaaacacccgaaaaacagaggcgctgggtgcgaggcggagagatgcacaggtctggtcccggccccgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgtgagttttgctctgccttgtattaagtctgcacttcccaggtccctggcacttctgtccctgggacgtggggtcctcacagacctggaaattcttgcctgtcttccttcacccagagcaaattgagacgcccataagagtctggaagttgcttccttttgggtttgaagtcgcttggaggctggtcccgtccccggtctttctgctatagggcaatgtatacacttcctatcgcatagttttcctgctcaaaaccttgttgactcatcctgccccttgctttttaaagtcctcacccgtgcgctggattcccgccctgggcgcctcccagcccccgtcggcctcccctggagcgcagcgccggggccccagtcctggggaggctgggtcctctgcctggtcctgggagcctgcaggtgccac

SEQ ID NO: 14409 - DNA, 201 bp, Homo sapiens
  source 1..201: mol_type = unassigned DNA
aggctggcagatcacgaggtcaggagatcgagaccgtcctggctaatatggtgaaaccccgtctctactaaaaatacaaaaactagccgggcgtggcggcgtgcccctgtcccagctgctggggaggctgaggcaggagaatggcgtgaacccgggaggcggagcttgcagtgagccgagatcgcaccactgcactctagc

SEQ ID NO: 14410 - DNA, 201 bp, Homo sapiens
  source 1..201: mol_type = unassigned DNA
cactgcaagctccgccttccgggttcacgccgttctgctgatctcgtgatccgccccgcctcggcctcccaaagtgctgggattacaggcgtgagccaccgcgcccggccaacagttttcaatattaattattcagagtgtgtaataacttggaaaagggctttttttttcttttttgcttttagagacagggtctctggc

SEQ ID NO: 14411 - DNA, 201 bp, Homo sapiens
  source 1..201: mol_type = unassigned DNA
tgggagtgacccgattttcaaggtgcgtccgtcacccctttctttgactcagaaagggaactccctgaccccttgcgcttcccaagtgaggcagtgcctcgccctgcttcggctcgcacacggtgcacgcacccactgacctgcgcccactgtctggcactccctagtgagatgaacccggtacctcagatggaaatgcag

SEQ ID NO: 14412 - DNA, 201 bp, Homo sapiens
  source 1..201: mol_type = unassigned DNA
attccataaaaatgaaaattaaataagtacaagaatggttatatccgggggaggagccaacatggccgaataggaacagctccggtctacagctcccagcgtgagcgacacagaagatggtgatttctgcatttccaactgaggtaccgggttcatctcactagggactgccagacagtgggcgcaggtcagtgggtgcgt

SEQ ID NO: 14413 - DNA, 201 bp, Homo sapiens
  source 1..201: mol_type = unassigned DNA
cggggtttcaccctgttagccaggatggtctcgatctcctgacctcgtggtccgcctgcctcggcctcccaaagtgctgggattacagacctgaaccaccgcgccgggccagttctgtgggtttctaacgtgctttcttccacttgtaatttagagtcagaagaggctagcgctgacaggcaggcagtagtcacatgaaaa

SEQ ID NO: 14414 - DNA, 201 bp, Homo sapiens
  source 1..201: mol_type = unassigned DNA
ctactaaaaatacaaaaaattagccgggcgtggtggtgggcgcctgtaatcccagctactcgggaggctgaggcagaagaatggcatgaacccaagaggcggagcttgcagtgagccgggatagcgccactgcagtccagcttgggcgaaagagtgagactccgtctcaaaaaaaaaaaaaaaaaaaaaaaaaaaagactt

SEQ ID NO: 14415 - DNA, 201 bp, Homo sapiens
  source 1..201: mol_type = unassigned DNA
ggagggtggtgagggtggggagggggaaggcgggaggccgggttcggtgcatgggggccgggcacactttctctgggcatccctaggacaggcgaggaacgcatcggccgggactccacctacgagcaggagggcaaggtgcagtttgtgattgatgcggtgtacgccattgcccacgccctccacagcatgcaccaggcg

SEQ ID NO: 14416 - DNA, 201 bp, Homo sapiens
  source 1..201: mol_type = unassigned DNA
ctacacaagtcgtagtctgggcagacgctgcacttgtagcgggttcctaccacaggcccattgcagccatcgcagatcacattggggtgcaccatgttgcggggcgcctcctgagcacacggtgggcggtggtcccgccggcactcttttttctctacaggaagggtaaagagagccgctagggtgggaccccctaaagtc

SEQ ID NO: 14417 - DNA, 201 bp, Homo sapiens
  source 1..201: mol_type = unassigned DNA
tatggggaaaccctgtctctactaaaaatacaaaaattagcccggcgtggtggcacataactgtaaccccagctactcgggaggctgaggcaggagaatcgctggaacccgggaggcggagcctgcagtgagccaagattgcgccatgcactccaacctgggcgtcgcagcgagactctgtctctaaataaataaagtgcc

SEQ ID NO: 14418 - DNA, 201 bp, Homo sapiens
  source 1..201: mol_type = unassigned DNA
agcaatcaacaaagtgaagacatggcccactgaagcgcagaaaatatttacaagccgggcgcggtagctcacgcctgtaatcccagcactttgggaggccgagacacgcggatcacaaggtcaggagatcgagaccatcctggctaacacagtgaaaccctgtctctactacaaatagaaaaaattagttgggcatggtgg

SEQ ID NO: 14419 - DNA, 227 bp, Homo sapiens
  source 1..227: mol_type = unassigned DNA
agattggcttctttcacttaataatatgcatttcaatttctagggctgggcgtggtggctcacgcctgtaatcccagcactttgggaggccgaggccggcggatcacgaggtcaggagatcaagacgatcctggctaacatggtgaaaccccgtctctactaaaaatacagaaaataagccgggcgtggtggcgggcacctgtagttccagctactcaggaggctga

SEQ ID NO: 14420 - DNA, 201 bp, Homo sapiens
  source 1..201: mol_type = unassigned DNA
gttccctttccgagtcaaagaaaggggtgacggacgcacctggaaaatcgggtcactcccacccgaatattgcgcttttccgaccggcttaaaaaacggcgcaccacgagattatatcccacacctggctcggagtctcgctgattgctagcacagcagtctgagatcaaactgcaaggtggcagcaaggctgggggaggg

SEQ ID NO: 14421 - DNA, 201 bp, Homo sapiens
  source 1..201: mol_type = unassigned DNA
acgcagaagacgggtgatttctgcatttccatctgaggtaccgggttcatctcacttgggagagccagacagtgggcgcaggtcagtgggggcatgcaccgtgcgcgagccgaagcagggagaggcattgcctcacttgggaagcgcaaggggtcagggagttccctttccgagtcaaagaaaggggtgacagacgcacct

SEQ ID NO: 14422 - DNA, 201 bp, Homo sapiens
  source 1..201: mol_type = unassigned DNA
ggcacccgccaccacgcccggctaattttttgtattcacagtacagacggggtttcaccgtgttagccaggatggtttcgatctcctgacctcgtgatccgcccgcctctgcctcccaaagtgctgggattacaggcgtgagccaccgcgcccggtggaaaggacacttttttacagtatgagcactgaaacaaaaaggca

SEQ ID NO: 14423 - DNA, 201 bp, Homo sapiens
  source 1..201: mol_type = unassigned DNA
aaccgtgtcactggaagttaggaagcaaacttcaatcctagtattgtttttttttgaaatggagtctcgctctgtcacccaggctggagtgcagtggcgcgatctcggctcactgcaagctccgcctcccgggttcaccccattctcctgcctcagcctcccgagtagctgggactacaggtgcccgccaccacgcccggc

SEQ ID NO: 14424 - DNA, 201 bp, Homo sapiens
  source 1..201: mol_type = unassigned DNA
tctgggtgaccgtctgcaatggagggagtgtgtgggctggtttgccagcggagagatttgcctcacgtcaccaggagcctggccgagcaccacggtgaccgtggccgggtggaaggagatggacgcccacttgtgcaatttgcttccattctttctccaggggccatttcagaataaaatgtaatggccctttcttgttca

SEQ ID NO: 14425 - DNA, 201 bp, Homo sapiens
  source 1..201: mol_type = unassigned DNA
acaagctggctgcccggcaggccacaccggggtctctaagagcttgggctgcagacgaatccaggtctgcccctctcaatcagtgtgactcgggcaagccgcgtcccccctctgagcctcagtctcctcatctctcaaatgggggtgacgccatccccactgccaggggttcctctgagcgggtcacaggaaggtgcttag

SEQ ID NO: 14426 - DNA, 201 bp, Homo sapiens
  source 1..201: mol_type = unassigned DNA
cccagcctgggatcggcagtaccttcacctgcacgccatcctcagggacggcaatactgctcaccttgagcccagagcagctactatccccggcccctccgctggctttctgggaggtcccaggaagacgtgacctcttgtcaggcactcgtgggctcccccatagctgccggggtggttcttgcccctccaaaatcacac

SEQ ID NO: 14427 - DNA, 201 bp, Homo sapiens
  source 1..201: mol_type = unassigned DNA
aaagctaccgtaggtaatcagaaaagttgcttccattccatggctgtgtccacctgcggtagacaggataatggcccaaagatgtctgagacccgtgaccgtcttaccctgtgaccgtattaccccacatggcaaagaagcctctgtacgtgtgactacgattaaggaccttgagattcggagatgacctgggtatccggg

SEQ ID NO: 14428 - DNA, 201 bp, Homo sapiens
  source 1..201: mol_type = unassigned DNA
gtggcggcaggtttgctgcgctcgtcccagccagggcccagagtccctcggccagtttatcgcatctggaccccagatgggcgcgttgggtggtgcccgcgccagggaaagagctggcggctggctgagttgctgcgttcctgagcgctgtgcccgttgtgaccattggcgtggctgtctcccggcaggctcgaaggaatc

SEQ ID NO: 14429 - DNA, 201 bp, Homo sapiens
  source 1..201: mol_type = unassigned DNA
cccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaagg

SEQ ID NO: 14430 - DNA, 201 bp, Homo sapiens
  source 1..201: mol_type = unassigned DNA
gggttcagaggcacttcagcaaatggtttaggaactgcagcattaatttatactgagaaatagaactgctacttaagaaagataactgccggcccaatgcggtggctcacgcctgtaatcccagcactttgggaggccgaggctggcggatcacgaggtcaggagatcgagaccatcctggctaacagggtgaaaccctgt

SEQ ID NO: 14431 - DNA, 201 bp, Homo sapiens
  source 1..201: mol_type = unassigned DNA
cacggtgaaaccctgtctctactaaaaatacaaaaaattagccaggtgtggaggcactccctgtaatcccagatactcaggaggctgaggcaggaaaatcgcttgaacccgggaggtggagtttgcagtgagctgatatcgcaccactgtgctccagcctgggcaacagagcaaaattctgtctcaaaaaaaaaaaaaaaa

SEQ ID NO: 14432 - DNA, 201 bp, Homo sapiens
  source 1..201: mol_type = unassigned DNA
cattctcctgcctcagccttaggagtagctgggactacaggcgtccgccacaacgcccggctaattttttttgtatttttagtggagacggggtttcaccgtgctagccaggatggtctcgatttcctgacctcgtgatctacccgcctcagcctcccaaagtgctgggattacaggtgtgagccaccgcgcccagctgtt

SEQ ID NO: 14433 - DNA, 201 bp, Homo sapiens
  source 1..201: mol_type = unassigned DNA
gtctacagctcccagcgtgagcgatgcagaagacgggtgatttctgcatttccatctgaggtaccgggttcatctcactagggagggccagacagtgggcgcaggtcagtgggtgcgcgcaccgtgcgccagccaaagcagggcaaggcattgcctcacttgggaagcgcaaggggtcagggagttccctttccgagtcaa

SEQ ID NO: 14434 - DNA, 201 bp, Homo sapiens
  source 1..201: mol_type = unassigned DNA
tggcaaaaccccatctctactaaaaatacaaagacttagtatgggcatggtggtgcacacctgcaatcccagctgcttgggaggctgaagcagaagaatcgcgtgaacccgggaggcagaagttgcagtgagccaagatcacgccactgcactccagcctgggtgacacaacgagattctgtctaaaaaacaaaataaaaa

SEQ ID NO: 14435 - DNA, 201 bp, Homo sapiens
  source 1..201: mol_type = unassigned DNA
aaatcttctatttctttgaggcagagtctcactctgtcgcccaggctggagtgcagtagcgtgatctcggttcactgcaagctccacctcccgggttcacgccattctcctgcctcagcctcctgagtagctgcgactacaggtgcccttcaccacgccgggctaattttttgtatttttagtagagacggggtttcactg

SEQ ID NO: 14436 - DNA, 201 bp, Homo sapiens
  source 1..201: mol_type = unassigned DNA
tcccgagtagctgggactacaggcgcccgccactacgcccggctaatattttgtatttttagtagagacggggtttcaccgcgttagccaggatggtctcgatctcctgacctcgtgatctgcctgcttcggcctcccaaagtgctgggattacaggcgtgagccaccgcgcccggcttattttttttatttttcacagag

SEQ ID NO: 14437 - DNA, 201 bp, Homo sapiens
  source 1..201: mol_type = unassigned DNA
tgagccgagcggagattgcgccactgctctccagcctgggtgacagagggagaccctgtgtctaaaaaaaatagatgcaggtaggagcttttcttccggcgctcatactcagactgaagaaagtaattgggctgggcccggtggctcagatctgtaattccagcactttgggaggcccaggcagacgtatcactttagctc

SEQ ID NO: 14438 - DNA, 201 bp, Homo sapiens
  source 1..201: mol_type = unassigned DNA
ctggagcagtggcaggtggcaagggctgggtggggggttgccccactgggctctctatttttctctccttcccccaactttttttttttttttttgagacggagtcttgctctgccactcaggctggagtaaagaggtatgatctcggctcacagcaacctctgcctcccgggttcaagtgactctcctgcctcatgctcc

SEQ ID NO: 14439 - DNA, 201 bp, Homo sapiens
  source 1..201: mol_type = unassigned DNA
tgaagggagggacgagagtcctaccatctaaccccaagcctagtggccggtgtccctggaagtggagacacatgctcactggtgtgcgactcacacttacgaaagggaacgtgccctctggaacacaggggagccctggtcagggaagccgtctttccacccaagagggacaaaggtgtgcaaatcccagaaaccagatat

SEQ ID NO: 14440 - DNA, 201 bp, Homo sapiens
  source 1..201: mol_type = unassigned DNA
aaatcatctctgatttgagatataaaaataaagaggccgggcgcaaggtggctcacgcctgtaatcccagcactttgggaggccgaggcgggcggatcacgaggtcagcagatcgagaccatcctggctaatacggtgaaaccccgtctctactaaacaaaacacaaaaaattagccgggcgtggtggcgggcgcctgtag

SEQ ID NO: 14441 - DNA, 217 bp, Homo sapiens
  source 1..217: mol_type = unassigned DNA
ttttgaatgaaattaggaaggagaaagtatgggacaatgggcttttgataatgataaaaagagaaaaaacaaatagaaaaaagaggagggtcggccgggcgcggtcaggaaggcgcggtctcggtcaggagatcgagaccatcctggctaacgcggtgaagccccgtctctactaaaaatacaaaaaattagccgggcgtggtggggggcgcctgta

SEQ ID NO: 14442 - DNA, 217 bp, Homo sapiens
  source 1..217: mol_type = unassigned DNA
ccgtcacccctttctttgactgggaaagggaactccctgaccccttgcccttcccaagtgaggcagtgcctcgccctgcttcggctcgcgcacggtgcacgcactcactgacctgcgcccactgtctggcactccctagtgagatgaacccggtacctcagatggaaatgcagaaatcacccgtcttctgcgtcgctcaagctgggagctgtagacc

SEQ ID NO: 14443 - DNA, 201 bp, Homo sapiens
  source 1..201: mol_type = unassigned DNA
tgctggtgggagttaaaatggatcaactacataaaaaacaatttccaggccgggcgcagtggctcacgcctgtaatcccggcactttgggaggccaaggcgggcggatcacgaggtcaggaaatcgacaccatcctggttaacaaggtgaaaccccatctctactaaaaatacaaaaatttagccgggcgtggtggcgggc

SEQ ID NO: 14444 - DNA, 201 bp, Homo sapiens
  source 1..201: mol_type = unassigned DNA
tggagatttcccacttattgtggcagcaaacccgtctgaggtgcctgcatgtctcagtcccggggctccgggggccgtgcccacagcctccccatctttcggctcccacgtcagggttcccggtccacaccgtgctgttctgcctcatatgagaccggaaagtcacatgtggataattcaggacttattcagggtcatata

SEQ ID NO: 14445 - DNA, 201 bp, Homo sapiens
  source 1..201: mol_type = unassigned DNA
gtagggtccgaacctcttccccaggagggccagggttgcggccgggcgacgccaggtggggaagacactagaagaggagaaaaccaggagcgcaggacgcggtgggagactgggaggctgcagagaggaggcctgaggacaggagggaaggaggcggggacagaggccgagggctggaggggctgccgggtcttctctggg

SEQ ID NO: 14446 - DNA, 201 bp, Homo sapiens
  source 1..201: mol_type = unassigned DNA
gccaccgcgcccggctaatttttttgtatttttttagtagagtcggggtttcaccgtgttagccaggatggtcacgatctcctgaccttgtgatccggccgcctcggcctcccaaagtgctgggattacaggcgttaagccaccgcgcccggccgatagtcagactcttaaaggtgtttgaatttttccaatgtggaaaca

SEQ ID NO: 14447 - DNA, 201 bp, Homo sapiens
  source 1..201: mol_type = unassigned DNA
agctcacgcacggtgcgcgcacccactgacctgcacccactgtctggcactccctagtgagatgaacccggtacctcagatggaaatacagaaatcacccgtcttctgcgtcgctcacagtgggagctgtagaccggagctgttcctattcggccatcttggctcgatccggagtggcacacgcttctaaacaaccaaatc

SEQ ID NO: 14448 - DNA, 201 bp, Homo sapiens
  source 1..201: mol_type = unassigned DNA
ctggcgagaagtcgagcacagcagctgctggcccaggtgctaagcccctcactgcccggggctgctggccgctccaagtgcgggccagcccagcccacgcgcacccggaagtcgcgctggtgagggagggctgcgagggctgccagcatgctatcacctctcactgggattacaggcgtgagccacggcgcccggccgaag

SEQ ID NO: 14449 - DNA, 201 bp, Homo sapiens
  source 1..201: mol_type = unassigned DNA
tcacgccattcttctgcctcagcctgtagctgggactacaggtgcccgccaccacgcccggctactttttctgtatttttaatagagacggggtttcaccgtgttagccaggatggtctcaatctgctgatctcgtgatccgcccgcctcggcctcccaaagttctgggattgcaggagtgagccaccgcgcccggccgca

SEQ ID NO: 14450 - DNA, 201 bp, Homo sapiens
  source 1..201: mol_type = unassigned DNA
cagactggagtgcagtggcacgacctcggcttagaacctccgcctcatgggttcaagcaattcccctgcctcagcctccggagtagctgggactacaggcgcccgccaccacgccaggctaattttttgtatttttagtagggacggctgaccgggcgcggtggctcacgcctgtaaccccagcactttgggaggccgagg

SEQ ID NO: 14451 - DNA, 201 bp, Homo sapiens
  source 1..201: mol_type = unassigned DNA
cacttcccagatgggatagcggccgggaagaggcgctcctcacttcctagatgggatggcggccaggcagagacgctcctcacttctcagacggggtggcggccgggcagaggctgcaatctcggcactttgggaggccaaggcaggctgctgggaggtgaaggttgtagcgagccgagatcacgccactgcactccagcc

SEQ ID NO: 14452 - DNA, 201 bp, Homo sapiens
  source 1..201: mol_type = unassigned DNA
gatggagctgcctgccagtcccggtactgtgcgcccgcactcctcagcccttgggtggtcaatgggactgggtgccgtggagcagggggtggcgctcgtcggggaggctcgggccgcacaggagcccacggaaggggtgggaggctcaggcatggcgggctgcaggtcccgagccctgccccgcgggaaggcagctaaggc

SEQ ID NO: 14453 - DNA, 286 bp, Homo sapiens
  source 1..286: mol_type = unassigned DNA
gagccaggtgtgggatatagtctcgtggtgcaccgttttttaagccggtctgaaaagcgcaataatcgggtgggagtgacccgattttccaggtgcgtccgtcacccatttatttgactcggaaagggaactctctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttc

SEQ ID NO: 14454 - DNA, 201 bp, Homo sapiens
  source 1..201: mol_type = unassigned DNA
aggcaaagctgcctgccagtcccatgccttgtgcccacgctcctcagccgttccacagtcgatgggaccgggtgccatggagcagggggcggtgctcgtcggggaggctcctgctgcacaggagcctagggcagtggggggaggctcacacatggcaggctgcaggtcccaagccctgccccgcagggaggcagctgaggc

SEQ ID NO: 14455 - DNA, 201 bp, Homo sapiens
  source 1..201: mol_type = unassigned DNA
aggcgggtggatcacgaggtcaggggttcgagacgagcctggccaacatggtgaaactccgtctctactaaaaatacaaaaattagttgggcgtggaggcgcgcgcctgtaatcccagatactcgggaggctgaggcaagagaatcgcctgaacccgggaggcggaggttgcagtgagccgagatggtgccattgcactcc

SEQ ID NO: 14456 - DNA, 201 bp, Homo sapiens
  source 1..201: mol_type = unassigned DNA
gagcgacgcagaagacgggtgatttctgcatttccatctgaggtaccgggttcatctcactagggagtgccagacagtgggcgcaggtcagtgggtgtgcgcaatgtgcgcgagccgaagcagggcgaggcattgcctcactcgggaagcgcaaggggtcagggagttccctttccgagtcaaaggaaggggtgacggagg

SEQ ID NO: 14457 - DNA, 201 bp, Homo sapiens
  source 1..201: mol_type = unassigned DNA
gtgccgtctgtcacccctttctttgactaggaaagggaactccctgaccccctgcgcttccggagtgaggcaatgcctcgccctgcttcagctcgcacacggtgcatgcacccacggacctgcgcccactgtctggcactccctagtgagatgaacccggtacctcagatggaaatgcagaaatcacccgtcttctgcgtc

SEQ ID NO: 14458 - DNA, 201 bp, Homo sapiens
  source 1..201: mol_type = unassigned DNA
atcttcatttgaattctgacagcagctactatgtagagctgttaaaatgtatacttccggccgggtgcggtggctcacgcctgtaatcccagcactttgcggggccgaggcgggcggatcacgaggtcaagagatcaagactatcctggccaacatggtgaaaccctgtctctattaaaaatataaaaaaaattagctggg

SEQ ID NO: 14459 - DNA, 201 bp, Homo sapiens
  source 1..201: mol_type = unassigned DNA
ccaggtgccatccgtcacccctttccctgactcagaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctg

SEQ ID NO: 14460 - DNA, 201 bp, Homo sapiens
  source 1..201: mol_type = unassigned DNA
ttcagcccaccgctgcactgtgagagcccctttctgggctggccaaggccagagcccgctccctcagcttgcagggaggtgtggatggagaggcgtgagcgggaacccaggctgtgcatggtgcttgcgggccagctggagttccgggtgggcgtgggcttggcaggccccgcactgggagcagccggccggccctgccag

SEQ ID NO: 14461 - DNA, 201 bp, Homo sapiens
  source 1..201: mol_type = unassigned DNA
ggggagagggactgaccccttgtgctccacccccagctcatccaaccccagtgcagcctggagactgccaccgtgccccccggagggcgatggagcctccgctctgctcaggagcagcctggcttccgggagggcagcctgactcccacggcactgccggtgacccctcagctcaggccccggggctgcgagaatctcaag

SEQ ID NO: 14462 - DNA, 201 bp, Homo sapiens
  source 1..201: mol_type = unassigned DNA
atgagcgtcaccgacggcagagtcgccttctccatgttctgtggggaccgggaagagaccgcagggagtgaggcaccccactcgcccactcggcagacccgaagactgagacccgagagcccgcagccccgggtcacacccccagcgtttggcccagcccctcctccacctccccacccgccccctgcagacgaggggttt

SEQ ID NO: 14463 - DNA, 201 bp, Homo sapiens
  source 1..201: mol_type = unassigned DNA
gttgtaactttactgagtgtgcctgtctaccagacacctgatcttgcaagactgctttttttttttttttttgacggagtctcgctctgtcgcccaggccgaagtgcagtggcgcgatctcggctcactgcaagctccgcctcccgggttcatgccattctcctgcctcagcctcccgagtagctgggactacaggcgccc

SEQ ID NO: 14464 - DNA, 210 bp, Homo sapiens
  source 1..210: mol_type = unassigned DNA
ttctgggttcccacttcttttttttttttttttttttttctgagacgaagtctcactctgtcgcccgggctggagtgctgtggcaggatctcggctcaccgcaagctccgcctcccggattcacgccattctcctgcctcagcctcccgagcagctgggactagaggcgcccgccaccgcgccaggctaatttttttgtatttttagtag

SEQ ID NO: 14465 - DNA, 201 bp, Homo sapiens
  source 1..201: mol_type = unassigned DNA
caagctgggcgcggtggctcacgcctgtaatcccagcactttgggaggcccaggcaggcggatcacgaggtcaggagatcaagaccatcctggctaacacggtgagaaccccgtctctataaaaaatacaaaaaattagccgggtgcctgtagtcccagctactcgggaggctgaggcgagagaatggcgtgaacccgggg

SEQ ID NO: 14466 - DNA, 201 bp, Homo sapiens
  source 1..201: mol_type = unassigned DNA
gggttaaagaggaatcggaaagggcccggggtagacgtgggcgccacagggtgagccgggccaggctgagaggactcacgggctatgggagcttgtgggcgacggtccggcaggggcctgcggcgggaacagggacaaaatatacttaataaattgcccatttagagcaagttgtgtgggtacaatggcgagaaaacggtc

SEQ ID NO: 14467 - DNA, 201 bp, Homo sapiens
  source 1..201: mol_type = unassigned DNA
ggcgggtgggtcacgaagtcaggagatcgagaccatcctggctaatatggtgaaaccccatctctactaaaaatacaaaaaattagcctggcacagtggcgggcgcctgtagtcccagctagcccggaggctgaggcaggagaatggcgtgaacccgggaggcggagcttgcagtgagccgagattgcgccactgcactac

SEQ ID NO: 14468 - DNA, 201 bp, Homo sapiens
  source 1..201: mol_type = unassigned DNA
gttcatgccatcctaacagtgggtttttccccggtgagaactggccaacagtcattgcctcgcctctttagtatgttgtttgaccagagagggacagggcggggaggaaaaccggggcgccgtgggctgcagttccagctgcaaatacgggagtttcttccgacgtctgtggcccgccggctcgaaagggagaaacacgga

SEQ ID NO: 14469 - DNA, 201 bp, Homo sapiens
  source 1..201: mol_type = unassigned DNA
tcatgaactcctgagctcaagtgatccccccacctggccttgcgaagtgctgggattacatgtgtgagccaccacgtcgggattacaggtgtgagccaccgcgccgggattatgggcatgagccactgcgccggcctctagtaaacattttatcagtatccagtgaattctgggtctttgtggaacaggaatgtttgttcc

SEQ ID NO: 14470 - DNA, 201 bp, Homo sapiens
  source 1..201: mol_type = unassigned DNA
aggctgaggctggtggatcacaaggtcaggagatcgagaccatcctggctaacatggtgaaaccccgtctttactaaaaatacaaaaaaattagccgggcgtggtggtgtgcacctgtagtcccagctactcgggagcctgaggcaggagaatggcatgaacccgggaggcagagcttgcagtgagccaaaattgcaccac

SEQ ID NO: 14471 - DNA, 201 bp, Homo sapiens
  source 1..201: mol_type = unassigned DNA
aaggagatgcctgggccaggactgaagtctcccggaacaacgggctgggaccctgaggctggcaggggtgcagtgggcactgggtccatgtgtggcttgcgctggccgacgtgggcacacaaggggcacagctgccactgggggcctggaggggaggacccagctggggtctggagggccaggattttgcagaaggtttac

SEQ ID NO: 14472 - DNA, 201 bp, Homo sapiens
  source 1..201: mol_type = unassigned DNA
catggtgaaaccccgtctcaactaaaagtactaaaattacctgggcatggtggcacatgcctgtaatcccagctactcgggaggctgaggcaggagaatcgcttgagcccgggaggcggaggttgtagtgagccgtgatcgcgccactgcactccagcctgggcgatagagcaagactccatcttaataaaaaaattaaaa

SEQ ID NO: 14473 - DNA, 201 bp, Homo sapiens
  source 1..201: mol_type = unassigned DNA
gcgattctcctgcctcagcctcccgagcagctaggactacaggcgcccgcccccacgcccggctaattttttgtatttttggtagagacggggtttcaccgtgttagcaaggatagtctcgatctcttgacctcgtgattcgcctgcctcggcgttccaaagtgctgggattacaggcatgagccaccgcgcctggcgggg

SEQ ID NO: 14474 - DNA, 201 bp, Homo sapiens
  source 1..201: mol_type = unassigned DNA
agtgaaacccctctctactaaaaattcaaaaaaattagccgggtgtggtagcatgtgcctgtagtcccagctactcgagaggttgagacaggagaatggcgtgaacccgggaggcggagcttgcagtgagccgagatcgtgccactgcaccccagcgtgggcgacagagcaagactccgtctcaaaaaaaaagaaaataat

SEQ ID NO: 14475 - DNA, 201 bp, Homo sapiens
  source 1..201: mol_type = unassigned DNA
agatcatagatgaatttgaatcccaagtagcacagatgcgtcacacccatcatcctgccgctgaccatccccgggaccacatcacacccatcatcccgccgctgaccatccccgggaccaccatggcgggtcatgacagcacgtccttcctagaaacacgtctgaatagtacaagaaaaggacaccacccggattcgcgga

SEQ ID NO: 14476 - DNA, 201 bp, Homo sapiens
  source 1..201: mol_type = unassigned DNA
cgctgccacctacaagagctcctcctcccttgcaaccaatggccttgttcctggcttgtccagcaaactgaaaccatcgaaaaaggactttgccgggagcggtggctcacgcctgtaataccagcactttgggaggccgaggcgggctgatcacaaggtcaggaaatcgagaccatcctggctaacacggtgaaacccagt

SEQ ID NO: 14477 - DNA, 201 bp, Homo sapiens
  source 1..201: mol_type = unassigned DNA
ccagagccaggcgcctatcgtcaacccggagtgtgtgctccagccctctggggtcgaccctggttgctgggtcagtagtgtgaatctcctctcctcacacggggcccctaagacacgtgtttgtgtgtgtccgtccctaagacacgtgtgtgtgtatatgtgtgtgtgtgtgtgtgttccacatgaacgatttgagtcacc

SEQ ID NO: 14478 - DNA, 201 bp, Homo sapiens
  source 1..201: mol_type = unassigned DNA
gccagtgccttcacggcagcccctgcactgggcccggggtgggggcggggggtggttgtggagtccctggctttcacccagcgtgtctccttcacggggcgcaccccaaagcgacaagatgtttcccaggaaatggggaatggacgccaggctttcagggagaggttgaggcagcctgaggtaaaaagggacgggccgagg

SEQ ID NO: 14479 - DNA, 201 bp, Homo sapiens
  source 1..201: mol_type = unassigned DNA
gggtgttcatggagtccctagctttcacccagggtgcgtgtcttccccacggggggcaccccaaaggggcatgaagtttcccgggggatggggatatgacgccaggctttcagtgggacactgagacagccgggggaaaaaagccgggagggcaagaaggctggggcacttccatggaggccagttccttcccagcagcct

SEQ ID NO: 14480 - DNA, 201 bp, Homo sapiens
  source 1..201: mol_type = unassigned DNA
gcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggt

SEQ ID NO: 14481 - DNA, 201 bp, Homo sapiens
  source 1..201: mol_type = unassigned DNA
gcaggtgccagggagaggcaacttcccaaacagataaaaacacttctggccgggcgcggtggctcatgcctgtaatcccagcacttcgggaggccgacgcgggcggatcacgaggccaggagatcgagaccatccttgctaacacggtgaaaccccgtctctattaaaaatacaaaaaattagccgggtgtggtggcgggc

SEQ ID NO: 14482 - DNA, 201 bp, Homo sapiens
  source 1..201: mol_type = unassigned DNA
tggtttcaccatgttagccaggatggtctcaatctcctgacctcgtgatccgcccgccacggcctccgaaagtgctgtgattacaggcatgagccaccgcgcccggcctaaaataactcttgaggttacataagaacatagtttatgtttacttatagctgtatctaatctaattaagaacttgttccttaagatgaaaaa

SEQ ID NO: 14483 - DNA, 201 bp, Homo sapiens
  source 1..201: mol_type = unassigned DNA
cgggctcccgacttgcgtggatgagcagttctgagccttacacagggcgggtgacgctgcagactgacaaggcccatccctggccacactgagccaaagcggaaggggtgcaggtgtggagtgccatgtgcgatgccactgccggccagctggagtggaggtgcccgccatgtgcatggggagacgtgcccctggttagcc

SEQ ID NO: 14484 - DNA, 366 bp, Homo sapiens
  source 1..366: mol_type = unassigned DNA
ccgccttgcagtttgatctcagactgctgtgctagcaatcagtgagattccgtgggcgtaggaccctccaagccaggtgtgggatatagtctcgtggtgcgccattttttaagccggtctgaaaagcgcaatattcgggtgggagtgacccgattttctaggtgcgtcggtcacccctttccttgactcggaaagggaactccctgacccctggcgcttcccaggtgaggcaatgcctcgccctgcttcggctcgcccacggtgcgcgcacccactggcctgcgcccactgcctggcactccctagtgaggtgaacccggtacctcagatggaaatgcagaaatcacccgtcttctgcgtcgctca

SEQ ID NO: 14485 - DNA, 201 bp, Homo sapiens
  source 1..201: mol_type = unassigned DNA
ggctcctgcagggccgagcctccccaatgagcgctgccccctgctccacggcgcccggtcccatcgaccgcccaagggctgaggactgtgggagcactgcgcgggactggcaggcagctccacctgcggcccccggtgcgggatccactgggtgaagccagctgggctcgtgagtctagtgtggacttggagaacctttat

SEQ ID NO: 14486 - DNA, 201 bp, Homo sapiens
  source 1..201: mol_type = unassigned DNA
cgcagaagatgagtgatttctgcatttccatatgaggtaccgggttcatctcactagggagtgccagacagtgggcgcaggacagtgggtgcagcgcaccgcacgcgagccgaagcagggcgaggcattgcctcactccggaagcacaaggggtcagggagttccctttcctagtcaaagaaaggggtgacagacggcacc

SEQ ID NO: 14487 - DNA, 201 bp, Homo sapiens
  source 1..201: mol_type = unassigned DNA
ttccctttcccagtcaaagaaaggggtgacagacagcacctggaaaatcgggtcactccaaccggaatactgcacttttccaacaggcttaaaaaacggcgcacctggagattgtatcccgcacctggctcggagggtcctatgcccacggagtctcgctgattgctagcacagcagtctgagatcaaactgcaaggcggc

SEQ ID NO: 14488 - DNA, 384 bp, Homo sapiens
  source 1..384: mol_type = unassigned DNA
ttcgtttctttggcctctgttgcccatgagaaatgaggaaaaataaaggccagattcctaataaccttcccggaagaaagagctgttttgagtgggtgtcggtgcttacatacgctgcttttaaaaaaatttgctttgttcaggtttgtgtgaatacaacgccggatgaactctgtcccttcagaagaaagccgggttggtgtgctcgatgacgcagcgcttgcagtggcgtttgacaaagcgcagggcctccacggagacctcgcagtcctggacattcagcgtctggaggtcaaagcagttggcggccacgatctgcaagccctggccggtgatgctctcgcaggacttgaggctgagccgcttgaggttgaagcagttcag

SEQ ID NO: 14489 - DNA, 216 bp, Homo sapiens
  source 1..216: mol_type = unassigned DNA
tgggagtgacccgattttccagctgcgtccatcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagattaacccggtacctcagatggaaatgcagaaatcacccgtcttc

SEQ ID NO: 14490 - DNA, 334 bp, Homo sapiens
  source 1..334: mol_type = unassigned DNA
ctgtgctggcaatcagcgagactccgtcgggtaggaccctccgagccagatgcgggatataatctcgtggtgcgccgttttttaggccggtccgaaaagcgcaatattcgggtgggagtgacccgattttccaggtgcgtccgtcacccctttctttgactaggaaagggaactccctgacccctggcgcttcccgagtgaggcattgccttaccctgcttcggctcgcgcacggtgcgcgcacccactgacctgtgcccactgtctggcactccctagtgagatgaacccggtacctcagatggaaatgcagaaatcaccgtcttctatgtca

SEQ ID NO: 14491 - DNA, 201 bp, Homo sapiens
  source 1..201: mol_type = unassigned DNA
ctcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccc

SEQ ID NO: 14492 - DNA, 270 bp, Homo sapiens
  source 1..270: mol_type = unassigned DNA
ccccggttcccgcccgtgcctctccctccacacctccccgcaagctgagggagccggctccggccttggccagcccaggaatgggcttccacagtgcagcggcgggctgaagggctcctcaagcgcggccagagtgggtgccaaggccgaggaggcgccaagagcgagcgagggctgtgagggctgccatgccggtacactgtcacttctcagaaggacgcagggcagagtttcaggctggctctgtcacccatgctggagtgcagtggc

SEQ ID NO: 14493 - DNA, 253 bp, Homo sapiens
  source 1..253: mol_type = unassigned DNA
ggtcggaaaagcgcagtattccggtgggagtgacccgattttccaggtgcgtccgtcacccctttctttgactcggaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctgtcttccacgtcgctcacg

SEQ ID NO: 14494 - DNA, 204 bp, Homo sapiens
  source 1..204: mol_type = unassigned DNA
taaattagtaaactcaacacttcaggatctttgttaagaagcttggttttggccgggaggatggagttcagcgggcagcggagctgtctcagtctttgccgccgccccgtccgggagggaggtggggggggtcagcccccctgcccggccagccgccccgtccgggaggtgaggggcgcctctgcccggccgcccctactggga

SEQ ID NO: 14495 - DNA, 228 bp, Homo sapiens
  source 1..228: mol_type = unassigned DNA
actcgggaagcacaaggggtcagggagttccctttcctggtcaaggaaaggggtgacagacagcacgtggaaaatcaggcctctcccacccgaatactgcgcttttcctacgggcttaaaaaccggcgcatcaggagactatatcccgcacctggctcggagggtcctacgcccacggagtctcgccgattgctagcacagcagtctgagatcaaactgcaaggtagc

SEQ ID NO: 14496 - DNA, 217 bp, Homo sapiens
  source 1..217: mol_type = unassigned DNA
cccagtggccgcaggggctgtcgtgtgctttgcagatggacacgcgctatttaacatagagatgcgctgagtccgggtgattagtgaatcgcacgtcatcgcagacactagaaagcgaaagcatacgggggaaggccccgggcacagacccagcacggccaccactcgagctggagctgcctgcgagacgatgagcgtctgcaatctgcatcctgcg

SEQ ID NO: 14497 - DNA, 201 bp, Homo sapiens
  source 1..201: mol_type = unassigned DNA
tccggtgtttaacccctgaattctaaggaaaaatagggcagaatagaaagtgaaacaggtccgaaggtactcaccgtgtggcaatatcccagacgagtccgatggtactcaccgtgtggcaatatcccagacgaacacccaagatgtgtccggagttggttccttccagtgggcttgtggtctcagtgacttcaagaatga

SEQ ID NO: 14498 - DNA, 204 bp, Homo sapiens
  source 1..204: mol_type = unassigned DNA
acggtgcgcacacccactgacctgtgcccactgtctggcactccctagtgagatgaacccggtacctccgatggaaatgcagaaatcacccattttccgcgtcgctcacgctgggagctgtagaccggagctgttcctatttggccatcttggctcctccccggcatttttcttactttttatttaggaccagtttgttgtctt

SEQ ID NO: 14499 - DNA, 223 bp, Homo sapiens
  source 1..223: mol_type = unassigned DNA
tagaagtacaagtaaccgtttccctctgcatcccagtggaacgtcgtgggtcttctgaagaccctctcttgccctgcaggctccggtactccaagcacgcgagtctgcgcaggaggcgcttcgctctccggagctccccactgcctcctagacacagtcccggctccttaccccgggcggaggctcttccagacgggtcccgactgcctctgtatgcccactg

SEQ ID NO: 14500 - DNA, 201 bp, Homo sapiens
  source 1..201: mol_type = unassigned DNA
tactcacaaggctgaggcaggagaattgcttgaagccgggaggcggaggctgcaatgagccgagatcacaccattgcatcccagcctgggcgacaagagcgaaactctgtaacaacatcaacaacaacaacaaaacaaaaacaaaaacaaaaaagaaaacaagagacgcggtggttctgcttgtaatcctagtactttggg

SEQ ID NO: 14501 - DNA, 203 bp, Homo sapiens
  source 1..203: mol_type = unassigned DNA
cctaatatcaagctaggtctagggaagtgctttttttttttttttttttttttatttgagacgtagtctcactctgtcacccaggctggagtacagtggcgcgatctcggctcactgcaagctccgcctcccgggttcacgctattctgctgcctcagcctcccgagtagctgggactaccgcccgaccaatttatttgtact

SEQ ID NO: 14502 - DNA, 201 bp, Homo sapiens
  source 1..201: mol_type = unassigned DNA
tacaaaaagaactacaaaacactgctgaaaaaaatcagacaacagccgggcgcggtgtctcatgcctgtaatcccagcagtttgggaggccgagttgggcggatcacgaggtcaggagacccagaccatcccggctaacacggtgaaacctcggtgaaacctcgtctctactaataatacaaaaaaattagccgggcgtgg

SEQ ID NO: 14503 - DNA, 201 bp, Homo sapiens
  source 1..201: mol_type = unassigned DNA
accattgttaaaaattaaattgggccgggcgcggtggctcacgcctgtaatcccagcactttggggggccgaggctggcggatcacgaggtcaggagatcgagaccatcctggctaacacggtgaaaccccatctctactaaaaatacaaaaaattagccgggcgaggtggcaggcacctgtagtcccagctactcgggag

SEQ ID NO: 14504 - DNA, 201 bp, Homo sapiens
  source 1..201: mol_type = unassigned DNA
tctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgactttt

SEQ ID NO: 14505 - DNA, 201 bp, Homo sapiens
  source 1..201: mol_type = unassigned DNA
gaggctgaggcaggagaatcatgtgaacccggaaggcggagcttgcagtgagccgagatcgcgccactgcactccagcctgggcgacagagcgagactccgcctcaaaaaaaaaaaaaaaaaaaaaaaaagtgacctgggccgggcgcggtggctcacgcctgtaatcccagcactttgggaggccgaggagggcagatca

SEQ ID NO: 14506 - DNA, 201 bp, Homo sapiens
  source 1..201: mol_type = unassigned DNA
tactagccaggcatggtagcacatgcctgtaatcccagctactcgggaggctgaggcaggagaatcgcttgaacccgggaggtggagattgcagtaagccgagttcgtgccatcctattccagcctgggcaagagcgaaactccactgggaaaaaaaaatccatagtttaggccgggcgcggtggctcacgcctgtaatcc

SEQ ID NO: 14507 - DNA, 201 bp, Homo sapiens
  source 1..201: mol_type = unassigned DNA
ggtcagccccccgcccggccagccgccccatccgggaggtgaggggcgcttctgcccggccgcccctactgggaagtgaggagcccctctgcccggccacgaccccgtctgggaggtgtgcccagcagctcattggggatgggccatgatgacaatggcggttttgtggaatagaaaggcgggaagggtggggaaaaaatt

SEQ ID NO: 14508 - DNA, 201 bp, Homo sapiens
  source 1..201: mol_type = unassigned DNA
actggccaaagagcactgtgggttctcggaagcacctgctcttccatcagctgtaaaccggaatgataaccagctcctaggctttggtttctgaatgtacgctgcgaacgatgcactgccttggcctcatggcaggggctggggaggcccgctctaccctgtaccccgacccgggcccaaagctgagcttgaagggccccc

SEQ ID NO: 14509 - DNA, 201 bp, Homo sapiens
  source 1..201: mol_type = unassigned DNA
cccgccactacgcccggctaattttttgtatttttagtagagacggggtttcaccgttttagctgggatggtcccgatctcctgacctcgtgatctgcccgcctcggtctcccaaagtgctgggattacaggcgtgagccaccgcacccggccccccctttttttttttttttttaagacagagtctcactctgctgccca

SEQ ID NO: 14510 - DNA, 201 bp, Homo sapiens
  source 1..201: mol_type = unassigned DNA
atctcggaaagtacaggaggtcatgccccagtgtggttcccctttcctgggtttaagtcaaggtcctcaccgtgcctgccggcctcccgggtctctgcgcggtggactctggacctccctgccccgtcctgcctcagggcctttgcacctgctgttaccgcggcctggaacgctcctcccctgaaaccctgtgactcccac

SEQ ID NO: 14511 - DNA, 201 bp, Homo sapiens
  source 1..201: mol_type = unassigned DNA
tgtgcttataagaacactagccattggatttagggcccacctaactcagtatgacctcatcttaacttgattacatctgaaaagacccttggccgggcgcggtggctcatgcctataatcccatcactttgggaggccgaggcaggtggatcacttgaggtcaggagttcgagaccagcctggccaacatggggaaatccc

SEQ ID NO: 14512 - DNA, 211 bp, Homo sapiens
  source 1..211: mol_type = unassigned DNA
cccagctctcaggacgtgcctcccatggctttctctgcggtgtggccacgcccggacttccttggcaccccccacctgccccgcacgacctgccctgcgcgacctgccccgcaaggccggggggagcgtcttcctcccccgcgacctcttacctcctcccggcactcgcccaccccgctgcccaggtctcctgctcctccggccctagggc

SEQ ID NO: 14513 - DNA, 201 bp, Homo sapiens
  source 1..201: mol_type = unassigned DNA
gtgcgcgcacccactgacctgcgcccactgtctggcactccctagtgagatgaaccgggtacctcagatgcaaatgcagaaatcacccgtcttctttgtcgctcacgctgggagctgtagaccggagctgttcctactcggccatcttggctcctccccccgaaaagagtatctttcaaccaagaagatggctttggctgc

SEQ ID NO: 14514 - DNA, 201 bp, Homo sapiens
  source 1..201: mol_type = unassigned DNA
acctagtggatcccacaccggggctgcaggtggagctgcctgccagtcctgcgccgtgtgctcacattcctcagcccttgggtggtcgatgggactgggcgccgtggagcagggggtggcactcgtccgggaggcttgggcggcacaggagcccatggagtgggtgggaggctcaggcatggtgggctgcaggtcctgagc

SEQ ID NO: 14515 - DNA, 201 bp, Homo sapiens
  source 1..201: mol_type = unassigned DNA
gatatgtacaggccatttaagagaatgatcgacttctggccacccggtgcctgcctgctgcggtggcgctgtgccgggcccaggggtcccagggactcccgccgtgctgtcagccttggaatctcagtggggacctgttgtgtggaaacttccggacaacagtctttcccatggagaacctacgtcttcacaatgttacca

SEQ ID NO: 14516 - DNA, 201 bp, Homo sapiens
  source 1..201: mol_type = unassigned DNA
ccactccttcatatctgtagagcgctctaccttctgtaacgtttatctgcgaaactgctgcgttaggccaggagcactccaagagcgagaggcagacgccgtctgacttttcaccctgacaggggacttttccacctggcagtgccaatatccggctcctacgcattctccatggaggatcaccaggtcagcccatgggag

SEQ ID NO: 14517 - DNA, 201 bp, Homo sapiens
  source 1..201: mol_type = unassigned DNA
ttctggcagagtcagcactcgactctccctgctcggagacccaggcgacggtgccgtgtgacccctgaccccgcggatgaggaaggtagagagagagcgcgcagacacggaggtcggcgctgaggttgagggagccacacccggccgcaagcttgagggagggaagccgggtgcggaaacagcccagcgggtccagaagtc

SEQ ID NO: 14518 - DNA, 201 bp, Homo sapiens
  source 1..201: mol_type = unassigned DNA
ccgctgccacgcccagctaattttttgtattgtttagtagagacggggtttcaccgtgttagccaggatggtctcgatctcctgaccttgtgatctgcccgcctcggcctcccaaagtgctgggattacaggcatgaaccaccgcacccggccaacctagtggttttgaggaggactcgtcaggagttttgtaaaatgtcc

SEQ ID NO: 14519 - DNA, 201 bp, Homo sapiens
  source 1..201: mol_type = unassigned DNA
accggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaaggtgcggttggggaaggggtcaggcccctggaaggatggggagggg

SEQ ID NO: 14520 - DNA, 201 bp, Homo sapiens
  source 1..201: mol_type = unassigned DNA
ttacaggtgtgagccacccggcctttttttttttttttttttttttttgagacgaagtctcactcttgtcccccaggctggagtgcaaaggcgcaatctcggctcactacaacctccacctcccgggttcaggcaattctcctgcctcaacccctggagtagctgggattacaggtgcctgccaccaggcctggctaattt

SEQ ID NO: 14521 - DNA, 201 bp, Homo sapiens
  source 1..201: mol_type = unassigned DNA
atcacccggcccagcaggtagaggcgcaggaacatggggatggacagcagcacgtccacgtcggcctcggccaccgagggcgcgtacgtgaaggccagccgcgccgtccacgtgaagcggtagtggccgggcaccgggtgaatggcgcacactgccagctctagcgagatgaggaacacgcgctcgcaggtcatggcgatg

SEQ ID NO: 14522 - DNA, 201 bp, Homo sapiens
  source 1..201: mol_type = unassigned DNA
gtagtcccagctactccaaaggcagaggtgagaatcgcttgaacccggaaggagtaggtttcagtgagctgaggtcatgccacttccctccagcctgggcgacagagaaagactctgtctagaaaaagtaaattatgggagtcggcgccggcgagcgccgcccgggaggcagcggctggaggagcggacgggccccgcggg

SEQ ID NO: 14523 - DNA, 201 bp, Homo sapiens
  source 1..201: mol_type = unassigned DNA
gaggctgaggcaggagaatggcgtgaacccgggaggcggagcttgcagtgagccgagatcccgccactgcactccagcctgggcgacagagcgagactccgtctcaaaaaaaaaataaaaataaaaataaaataaaataaaaaatgagctgggcatgatggcacaagcctgtggtcccagctactcaggaggctgaggtgg

SEQ ID NO: 14524 - DNA, 201 bp, Homo sapiens
  source 1..201: mol_type = unassigned DNA
gcagcttaataattctgcgttgcaaatttaaatattttacatatcattagacattaaaaacaaagatttatgctgctcgtctccacggagtgaggactccgttgacttcacacccggccatgaatctgcttgaggttcattagctgaacgtcttcggctaagaaagcccgtcgagtgggggcggcctctaaatcaccattt

SEQ ID NO: 14525 - DNA, 201 bp, Homo sapiens
  source 1..201: mol_type = unassigned DNA
gtgcatcttggctcactacaacctccaccacacccgcctctcccaggcttaagtgaccctcccacctcagtctccctagtagctgggactacaggtgcacggcaccatgaccggctaatttttgtattttttgtagagatgggattttgccatgttacccaggctggtctcgaactcctaagctaaagtaatccgcctgcc

SEQ ID NO: 14526 - DNA, 201 bp, Homo sapiens
  source 1..201: mol_type = unassigned DNA
ccccatctctactaaaaatacaaaaaattagccaggcgtggtggcacgccctgtaatcccagctactcgggaggctgaggcaggagaattgcttgaacgcgggttggggaggttgcggtgagccgagattgcaccactgcactccagcccgggtgacagtgcaagactccatctcaaaaaaaaaaaaaatctgtcaatcta

SEQ ID NO: 14527 - DNA, 201 bp, Homo sapiens
  source 1..201: mol_type = unassigned DNA
cacgtactacccacatgagccttcagtaggctccggccctaaataggcacatgcgtatttccccagctccttactgggatcctcccgctaagccacgcccgatgcccttgtctacagccatgagctgcagtaagatgcccaggcccggtgccagcgtgcgcagcacgtgtgccagcaccgtggaatccttgccgcccgagg

SEQ ID NO: 14528 - DNA, 201 bp, Homo sapiens
  source 1..201: mol_type = unassigned DNA
tggcactttggaaggccgacgtgggggcatcacctgagatcaggggttcgagaccagccttgcgaacgtgatgaaaccccgtctctactgaaaattcaacgattagccgggggtggtggtgcatgcctgtaatcctagctactcaggaggctgaggcaggagaatcgcttgaacccggaaggtggaagttgcaatgagccg

SEQ ID NO: 14529 - DNA, 201 bp, Homo sapiens
  source 1..201: mol_type = unassigned DNA
ctgaggtgggccgggcgcggtggctcacgcctgtaatctcaacactttgggaggccgaggggggtggatcacctgaggtgggcccggcgtggtggctcacgcctgtaatctcaacactttgggaggctgagaggggtggatcacctgaggtgggccgggcgcggtggctcacgcctgtaatctcaacactttgggaggccg

SEQ ID NO: 14530 - DNA, 201 bp, Homo sapiens
  source 1..201: mol_type = unassigned DNA
ggggtctcggccaggggtgggtgaggctggtgcccttccaggctcccctcagccacaggcagcaggtgccatgggagccctgccggcacccccttcctccgccagggtcctggttcatctgatggcgcagctcccctctaaggtgtgcaccggcgcagacactgtgcaggaagccaggctgatgcagacggttctcaagtc

SEQ ID NO: 14531 - DNA, 201 bp, Homo sapiens
  source 1..201: mol_type = unassigned DNA
aaagttgcccaaagtcccacaatgagttgatccaccgggaacaggaggaggccccgccgccagcctctgtgttatacttggcatctcgtccaggtttatcggagaggagatcacacgtcccttccccagccctcccaactcctccagccaagacaggtgccaccatctaccccagccccagtgtgctctgagtgtgccgga

SEQ ID NO: 14532 - DNA, 201 bp, Homo sapiens
  source 1..201: mol_type = unassigned DNA
cattctcctgcctcagcctcccgagcagctgggactacaggcgcccgccactgcgcccggctaattttttgtatttttttagtagagacggggtttcaccgtggtctcgatctcctgacctcgtgatccgcccacctcggcctcccaaagtgctgggattacaggcgtgagccaccgcgcccggccgtgtgtgttttttaa

SEQ ID NO: 14533 - DNA, 201 bp, Homo sapiens
  source 1..201: mol_type = unassigned DNA
gcacgtggcagcaggacttacctctggggtgccccgggtcggtgaactcatacttccccacgccaatggtccgcagcatctgcagcccgtgggccgagtcggttgtggggggcccattggtggcaggggcaccactggggagagtggcggacggctgggctggcggcggtggaggcagcaggggccctgccatgtggccgt

SEQ ID NO: 14534 - DNA, 279 bp, Homo sapiens
  source 1..279: mol_type = unassigned DNA
ggtggaagagctgacagcaaggggagtggccaaacggaggcggggcctggaagggggcgtggcttgcgggcctctgggccgcccggcctctttaggtgccgcagcggaaggcctggagcagaggctgcttctccgcccaagcactccctgggtgagtccatactcctggcgcgagtacgatcctctcctccagggaaggccgggtccctcgctggggttcgacccgactcttcccctctacccctttctccttgttctacacctagcgagcccaggccc

SEQ ID NO: 14535 - DNA, 201 bp, Homo sapiens
  source 1..201: mol_type = unassigned DNA
ctacacgggaggctgaggccagagaatggcgtgaacccgggaggcagagctcgcagtgagccgagatggcatcactgcactccagcctgggcgacagagcgagactcagtctcaaaaaaaaaaaaaaaaaaaaaggaaaatctaggttctttctcagactgaaatttctgtaaacataatttatgatttcatagcagccag

SEQ ID NO: 14536 - DNA, 201 bp, Homo sapiens
  source 1..201: mol_type = unassigned DNA
ctctgctgtaaaagaagtgcctatagaatctttattcttttttattattattattttttgagatagagtcgctgtcgcccgggttggagtacagtggcacgatctcggctaactgcaagctccgcctcccgggttcacgccattctcctgcctcagccccacccccccgccccgccccgccccgccccgccccgcccccga

SEQ ID NO: 14537 - DNA, 201 bp, Homo sapiens
  source 1..201: mol_type = unassigned DNA
gtttttctaacaccctgaaacttaaagtgtgatagtctcagaggactaccaacataagcatcacctgaaaacttgttagaaatgaagaactaggccgggcgcggtggctcacgcctataatcccagcactttgggaggcctagatgggaggatcacgacatcaggagaccgagaccatcctggctaacacggtgagacccc

SEQ ID NO: 14538 - DNA, 201 bp, Homo sapiens
  source 1..201: mol_type = unassigned DNA
catggtgaaaacctgtctctcctaaaaatacaaaaattagccaggcgtagtggcatgcgcctgtagacccagctacttgggtggctgaggcaggagaatcgctggaacccgggaggccgaggttgtagtgagccgagatcgtaccactgcactgcagcctgggtgacagaacaagactccaacttaaaaacaacaacaaca

SEQ ID NO: 14539 - DNA, 201 bp, Homo sapiens
  source 1..201: mol_type = unassigned DNA
tttgtccaggaaatgcacataggagctggtcactctgtgttttgagtcctctcggaggtgttggacttctagagagagaaacagagacacgtaagagggcgaagatgcctcagtggtgacacactggggagtcccgcccacgacccgtccacgaccggcacactcaacctgctccacggaaccccattccacagctcggtt

SEQ ID NO: 14540 - DNA, 201 bp, Homo sapiens
  source 1..201: mol_type = unassigned DNA
cgccaggacaagcgagggtggcctgagtcctgtgctcacatggcgtatgccgcccagtagatgacattgacggccgcaaacgccgcagggaacacagcgcgggcgtaaatgtcaatggtgtctgcgtcgatgggcctgagccgggcacggatgcccccctggcctcctgagcgggctgccccctccttcttcgtctcccct

SEQ ID NO: 14541 - DNA, 201 bp, Homo sapiens
  source 1..201: mol_type = unassigned DNA
cccctgttgagagtggactccgtgcgtgtgtcccccaggaacggtgacaagtacgacggcgactgggtccgggaccggcgtcagggacacggggtgctgcgctgcgccgacggctccacctacaaggtacccgggggcgcgcggcacctgctgcccagagggtacaggcctcgtggtgggcagggcgcgtggggtgtatgg

SEQ ID NO: 14542 - DNA, 201 bp, Homo sapiens
  source 1..201: mol_type = unassigned DNA
gataccataccctatattcttttattttttttgacccggagtctcgctctgtcgcccaggcttgggtgcagcagcgcgatctcggctcactgcaagctccgcctcccgggttcacatcattttcctgcctcagccttccgagtagctgggactacaggtgcccgccaccacgcccggctaattttttgtatttgtagtaga

SEQ ID NO: 14543 - DNA, 201 bp, Homo sapiens
  source 1..201: mol_type = unassigned DNA
ccccttcccagaaagcacatgaataggccgggcacggtggctcacgcctgtaatcccagcactttgggaggccgaggcgggtggatcacgtcagaagatcgagaccatcctggctaacacggtgaaaccccgtctctactaaaaatacaaaaaaaaataagccgggcgtggcagtgggcgcctgtggtcccagctactctg

SEQ ID NO: 14544 - DNA, 201 bp, Homo sapiens
  source 1..201: mol_type = unassigned DNA
gtgtgagagccacatgctaggaataagaggtatgccgagaggcggccgggcacggtggctcacgcctgtaatcccagcactttaggaggacgaggtgggcggatcacaaggtcaggagatcgagaccatcctggctaacatggtgaaaccccgtctctactaaaaatacaaaaaattagccgggcgtggtggcgggcgcct

SEQ ID NO: 14545 - DNA, 203 bp, Homo sapiens
  source 1..203: mol_type = unassigned DNA
ttccacaacgtctttcaccatctgtgagcacggcctgcaacgtggaagacacaaccccacctgactctccccagacctccctgctgctttagcctcctacgcgccagcctccgggccttcaccccaaaccttcccaggctcagaatgccctgccccaaactccaccgacaccatctgcgaaactgtagccttccatgaccaac

SEQ ID NO: 14546 - DNA, 201 bp, Homo sapiens
  source 1..201: mol_type = unassigned DNA
atcatacatggccgggcgcgatggctcacgccatcgagtgattgctgtaatcccagcactttgggaggccgagacgggaggatcacgaggtcaggagatcgagaccatcctggctaacacggtgaaaccccgtctctactaaaaaaacaaaaacattagccgggcgtggtggtgggcgcctgtagtcccagctacttggga

SEQ ID NO: 14547 - DNA, 201 bp, Homo sapiens
  source 1..201: mol_type = unassigned DNA
agtcccagctactcgggaggctgaggcaggagaatggcgtgaacccgggaggcggagcttgcagtgagccgagatcgcgccactgcactccagcctgggcgacagagcgagactccgtctcaaaaaataaaaataaataataataataattccagatattttacaataattttcaggcacaagagttttcacgagagtagg

SEQ ID NO: 14548 - DNA, 201 bp, Homo sapiens
  source 1..201: mol_type = unassigned DNA
tgggggtcccagaacttttgtagtttatatctctttggtcttttcctgggcagcttggaggcttccgaccttccggagcccctggtatttgagtttctccgtgaaagctcgtccgagaagggcttctgccccgggtctggcagactggagtcccttcctgggcttttttcttctttccctgggtgccttgtctctcgccaa

SEQ ID NO: 14549 - DNA, 201 bp, Homo sapiens
  source 1..201: mol_type = unassigned DNA
acgcgccaccacgcccggctaatttttgtatttttagtggagacggggtttcaccatgttggtcaggctggtctcaaactcctcacctcgtgatccgcccgcctcggcctcccaaagtgttgggattacaggagtgagccaccatgcccggccctaatctcagttttatagatgaaaaaacggaagctcaggatcagtgac

SEQ ID NO: 14550 - DNA, 201 bp, Homo sapiens
  source 1..201: mol_type = unassigned DNA
aagcagtatttggttttctgttcctgtgttaattcactccggataatggcctccagctgcatccatgttgctgcaaaggaccggattttgttctttttacgactgcatagtattccatggcatatatatatatacaccacattttcttaatccggtctatccatgtctttgctgttgtgaatagttctgcaatgaacatgc

SEQ ID NO: 14551 - DNA, 201 bp, Homo sapiens
  source 1..201: mol_type = unassigned DNA
ttaaataaatgccgggtgtcagggccgctgagtaagacaacaggccgcaaggacgcagcagaggaccctcggtcgatttgctgcgatggagtgagccagcggtgaggcctgaaggcccctgttttattttcccctcggagcagaggccggggagggtgctgggtgtcagcacagagcagagggccggtcacggaactgggg

SEQ ID NO: 14552 - DNA, 201 bp, Homo sapiens
  source 1..201: mol_type = unassigned DNA
gggagtgcagtggcgcgatctcggctcactgcaacttccgcctcccgggttcaagcgattctcctgcctcagcctccccagtaggtaggactacagtcgcgtgccaccacacccggctaattttttgtatttttagtagagactgggtttcaccatgttagccagaatggtctcaatctactgacctcgtgatccgcccgc

SEQ ID NO: 14553 - DNA, 201 bp, Homo sapiens
  source 1..201: mol_type = unassigned DNA
ttagtagaaacagggtttcaccatgttggccagaatggtcttgatctcttgaccttgtgatctgcccgcctcgctctcccaaagcgctgggattacaggcgtgagccactgcgccctgtccactgtccatcttcttttgctcgctctatcctgactgccggggccctggacactacacaaagagctagctggagagtgaga

SEQ ID NO: 14554 - DNA, 201 bp, Homo sapiens
  source 1..201: mol_type = unassigned DNA
ggaatgcagtggcgccatctcgctgactgcatcctccgcctcccggttgcaagtgattctcttgcctcagcctccccagtagctgggattacaggcgtgcgccacaacactcagctaatttttgtatctttagtagagacgggttttcaccaagttggccaggctggtctcgaactcctgaccccgtgatccgcctgcctt

SEQ ID NO: 14555 - DNA, 201 bp, Homo sapiens
  source 1..201: mol_type = unassigned DNA
cacctcggcctcccaaagtgctggtgttataggtgtgaaccatcgcacccggcctgctttttattttattatttatttattttttctgagactgagtctcgctcttgttgcccaggctggagtgtgcagtggctcaatctcggctcactgcaaactccgcctcccgggttcaagcgattctcctgcctcagccccctgagt

SEQ ID NO: 14556 - DNA, 3238 bp, Homo sapiens
  source 1..3238: mol_type = unassigned DNA
tttttccccggactggctcaacttctcctttcaagcctggcatcctgttcccttccagcgggggatatcttgccgctttggggtgcccgtcgtgggcgccgcacgattctgggtgcaagccagagactccacaaacacgccgggccctgcgcagcggcttccgggaaggcactgtcatccgtgggagggcccggcccgccactttttaccccctgctgcctcaacgtcaccttccaagcctggcgtcctcttcccttcccctggaggccttcgtgctgctttggggtgccccctgtgggcgagacacacaacctgggtgcaagccagggactccgcgaccatccctggcccggcgcaggggtggccatccttgggacgacaccatcccgccacttttttccttggactgtctccactatccccttcaaccctggcgtcctgtacccttcccccagtggccttcttgccgctttgtggtgctccccgtgggtgagacacgcacccggggtgcaagacagggactccaggacgctcccgggcccactgcagaggctgctgggaaggcagtgtcgtccgtgagaggaccccagcatccccgctttttttccccggggctgcctcaacttcccccttcaagactgacgtgctgtccctttcccccgggaaccttcttgctgctttgtggtgcccgccgtgggcaagacactcaccctgggtgcaagccagggaatcaacaacccccgcatgcccggcaaaggggctgccggtaaggcactgtcattcgtgggatcaccccagcctcgctgcttttttctccaggctacctaaacgtccccattcaagcctggcgtcctgttgccttcccgcgggggacttcttgccactttggggtgccccccgtgggcgagacacgcacattgtgtgcaagacagggactccgcgaccctcccgggactggcataggggctgtagggaaggcactgtcatccgtgaaaggaccccagcctcgcccctttttttcctgggctgcctcaacgtcccctttcaagtctggcatcctgttcttccccccccggggctttcttgctgctttggggtgccacccgtgggcgaggcacgcaccctgggtgtaaaccagggactccaagacccccagggccaggcgcaggggatgtcgggaagtcactgtcctccgtggaaagtttttccctggactgcctcaaagtcccctttcaagcctggcatcctgttcccttcccccggagcccttcttgcagctttcgcgtgcacacttaggcgagacacgcactctgttgcaagacagggactccaaacccccccgcctgggccaggctcaggggctgccgggaaggcactgtggtctgtgggacgaccacagcctagccgctgttttcctctggctggcccaacgtccctcttcaagcctgacatgttgtccccttcccccgggggccctgttgccactttcacgtgcaccccgtgagcaagacaggcaccctgggtccaagccaggggctccaccgtccacctgggtcccactcagaggctgccgggaaggcactgttctcagtggaaattttttccccggactgcctcaacgtcccctttcaagctcggcgtcctgttcccttccactcggggacttcttaccgcattgcggtgcccatcgtgggcacgacacgcaccccgggtgcaagccagggactccacaaccaccccaggcccgatgcaggggctaccggacaagacactgttgtccttgggatgacaccggtctgcctcaactctacctttcaaccctggagtcctgtacccttcccctgggggccttcttgctgctttgtggtgccactcgtgggcgagacacacaacctgggagcaagccagagactccacgacacctctgggcccactgcagaggctgccaggaaggcggtgtcatccgtgggaggaccccagcttcaccacttttaccccggggccgcctcaacctccccttcaagcctgacgtgctctcccttcccccgggaatctacttgccgctttggggtgcccccttgagcgagacacgcaccctgggtgcaagccacggactccaggaccaccctggcccagcgaaggggctgccaggaaggcactgtcgtttgtgggagaaactcagcgtcgccgtttttttccacgggctacctcaaagtcccccttcaagtctgaggtgctgtccccttcccccaggggcctacttgccgctttggggtgcctcccatgggcgaaacacgcaccctgggtgcaagatagggactccacgatccccccgggcccagcgcagggactgccaggaaggcactgtcatccgtaggaggaacccgactagccgcttttctctctgtgctgcctcagcatccccattaaagcctggccttctgtggcgttcgcccggcggccttcttgccactttggggtgcccccatgggtgcgacccgcaccctcggtgcaagccagggactccacgaccaccccgggcctgacgcaggggctgctgggaaggcactgtcgtccatgggacgaccccagcctgccacgtttttccccggactgcctcaactatccctttcaaccctggcgtcccatacccttcccccggtggccttcttgccgctttgtggtgccccccgagggcgagacacgcaccttgggtgcaagccaaggactccatgacgctcccaggcccaccacagatgctgtcgggaagacagtgttatccgtggcaggaccccagcatcccctctttattcccggggctgcctcaacgtccccctccaagcctgacgtgctgtccccttcccctgggaacctacttgccgctttggggtgccccccgtggaaccctgggtgcaagcctgggacacaacaaccccctcgggcctggcaaaggggctgccgggaaggcaccgtggtccgtgggaagttttttcctggactgcttcaaagtcccctttcaagcctggcgtcctgttcccttcccagggggcattcttgccgctttggggtgtccccccgtgggcgcgacacgcaccctgggttcaagtcaggaactccacgacaaccccgagtctggcgcaggggctgccgggaaggcactgtcgtccgtgtgacgatcgctgcctgctgctttttccctcgtgctgcctcaacgtcacctttcacgcctggcgttcta

SEQ ID NO: 14557 - DNA, 201 bp, Homo sapiens
  source 1..201: mol_type = unassigned DNA
tgccacctcgcccggctaattttgtgtgtgtgtgtttttagtagagacggggtttcaccgtgttagccaggatggtctcgatctcctgacctcgtgatccgcccccctcggcctcccaaagtgctgggattacaggcgtgagccaccgcgcccggccttctgtatattattttctgagacactttgaggtaatagccttgg

SEQ ID NO: 14558 - DNA, 201 bp, Homo sapiens
  source 1..201: mol_type = unassigned DNA
cgacgcccaagcactcgagaacggtgaccaattattttggagagcacttgcaaaggcggccccctagccgtcctctccggaagccgcagtctttgtgtccgcccccgcaccttgcacacctgctgaggtggggcgtgttaatcatcaaattactaatgagtgatggcccaaattgcaggcagagtaatgaatagatggtgg

SEQ ID NO: 14559 - DNA, 201 bp, Homo sapiens
  source 1..201: mol_type = unassigned DNA
tgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgt

SEQ ID NO: 14560 - DNA, 201 bp, Homo sapiens
  source 1..201: mol_type = unassigned DNA
gggcgtggtggcgggtacttgtaatcccagctactcgggaggctgaggcaggagaatggtgtgaacccgggaggtggagcttgcagtgagccgagatcgcgccactgcactccagcctgggcgacagagcgagactccgtctcaaaaaaaaaaaaaaaaaaaaagaagaagtcagagcaaggaggcagaatgatccccagg

SEQ ID NO: 14561 - DNA, 201 bp, Homo sapiens
  source 1..201: mol_type = unassigned DNA
ggccagggcgcacgcggcgctggggcccggggggatgcccgctgtcccggccgcaccctggtcacgtacacctttgggggcggctgctccactgcagggcgcgggggcggagctcggcccaagaagagcggcaaagggcgggcggccctggcggcccagctcagggcccgggagtgcctgggggtccccccgtcccggggg

SEQ ID NO: 14562 - DNA, 201 bp, Homo sapiens
  source 1..201: mol_type = unassigned DNA
aaaaagcaaaaaacaaaaattagccggccatagtggtgggtgcctgtaatcccaactgctcgggaggctgagtcaggataatagcttgatcctgcggggcggaggttgccatgagccaaaatcgtgccacttcactccaggttgggcgcaagagcgagactctgtctcaaaaaaaaaaaaaaagtttcatgccgggcgccg

SEQ ID NO: 14563 - DNA, 201 bp, Homo sapiens
  source 1..201: mol_type = unassigned DNA
caggcgtgagccaccgcgcccggctatccctgataactttatttcaaatagtgacaggttaaaagttaagagcggatgtttcagtatctagtttcccagcgtcttgccagttactttaagcttgtcgacaggagtttgatttcactgacctccctccttcctagagctatgcttactttttaaaattttaagaagctgctt

SEQ ID NO: 14564 - DNA, 201 bp, Homo sapiens
  source 1..201: mol_type = unassigned DNA
actccggaggctgaggcaggagaatggcgtgaacgcgggaggtggagcttgcagtgagccgagatcgcgcctcctgacctcaggtgatctgcctgcctccgcacccggccaacctgtttttgtatacataatcttttcactgctcaatacatttcagggttcttcaatttcacacttcacacttcagcttcttcaatagat

SEQ ID NO: 14565 - DNA, 201 bp, Homo sapiens
  source 1..201: mol_type = unassigned DNA
cagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaaat

SEQ ID NO: 14566 - DNA, 201 bp, Homo sapiens
  source 1..201: mol_type = unassigned DNA
aggccgaggcaggcggatcacaaggtcagaatatcgagaccatcctgggtagcacgatgaaaccccgtctctatcaaaaaatacaaaaaattagccgggcgtggtggtcggcgcctgtagtaccagctgctcaggaggctgaggcaggagaatggcatgaacctgggaggcggagcttgcagtgagccgagattgcgccac

SEQ ID NO: 14567 - DNA, 201 bp, synthetic construct
  misc_feature 1..201: note = Description of Artificial Sequence: Synthetic polynucleotide
  source 1..201: mol_type = other DNA
gagtgtagtggygtgatttyggtttattgtaagtttygtttttygggattaygttatttttttgttttagtttttygagtggttgggatttataggtgttygttaatatgttyggttaattttttgtatttttagtagagayggggttttatygtgttagttaggatggtttygatattttgatttygtgattygtttatt

SEQ ID NO: 14568 - DNA, 208 bp, synthetic construct
  misc_feature 1..208: note = Description of Artificial Sequence: Synthetic polynucleotide
  source 1..208: mol_type = other DNA
ttggttaatatgatgaaattttgtttttattaaaaatataaaaaattagtygggygtggtggygggygtttgtagttttagttattygggagattgaggtygaatggygtgaattygggaggyggagtttgtagtgagtygagattatattattgtattttagtttgggygatagagygagattttgttttaaaaataaataaataaa

SEQ ID NO: 14569 - DNA, 201 bp, synthetic construct
  misc_feature 1..201: note = Description of Artificial Sequence: Synthetic polynucleotide
  source 1..201: mol_type = other DNA
atayggtgaaatttygtttttattaaagtataaaaaattagtygggtatagtggtataggtttttagttttagttatttgggaggttgaggtaggagaatygtttgaattygggaggyggagggtgtagtgagttattgtaygttagtttgggtaatagagttagatttygttttaaaaaaaaaaaaaaaaaagaaagaaa

SEQ ID NO: 14570 - DNA, 201 bp, synthetic construct
  misc_feature 1..201: note = Description of Artificial Sequence: Synthetic polynucleotide
  source 1..201: mol_type = other DNA
gtygaggtgggygaattatttgaggttaggagtttaagattagtttggttaatatggtgaaattttatttttattaaaaatataaaaattaatygggtatygtggtgygtgtttgtaattttagttattygggagattgaggtaggagaattgtttgaattttgtyggtagaggttgtaatgagttgagattgtattaygg

SEQ ID NO: 14571 - DNA, 201 bp, synthetic construct
  misc_feature 1..201: note = Description of Artificial Sequence: Synthetic polynucleotide
  source 1..201: mol_type = other DNA
ttttggaggttatatttggataggagtyggtttttaattttagttaagagtttatagaggggtttttgtttaattgtatggagtttatggttgataggygyggyggtaggaygggaygggatyggatgggttgtgtatttgtttttatattagtattatattgttttgattattttagtttgtaagatgtttgaaatttat

SEQ ID NO: 14572 - DNA, 201 bp, synthetic construct
  misc_feature 1..201: note = Description of Artificial Sequence: Synthetic polynucleotide
  source 1..201: mol_type = other DNA
aaaattataataaagtttttgtttaattatagattttgatttattggttaggtaggttgtttggtttttgatttgtatttagagggttttyggattttggygttgygtgggttagtgtttygggagtyggggatyggtattggtygtgttyggttgttgagtgtgttttattaattattatttygtttttttaggttaatg

SEQ ID NO: 14573 - DNA, 201 bp, synthetic construct
  misc_feature 1..201: note = Description of Artificial Sequence: Synthetic polynucleotide
  source 1..201: mol_type = other DNA
gaggttttttttatttaggtaaagaagaaagaaggatggttttaggagtttatataatatggttaaaggtygggtagygtgtagtagaatgtaagatgagyggttaggttatagggygagattatgaaggattttttttyggttttaaatgttttttaagagtgtttttttattatttttttttttattttttaagaatag

SEQ ID NO: 14574 - DNA, 201 bp, synthetic construct
  misc_feature 1..201: note = Description of Artificial Sequence: Synthetic polynucleotide
  source 1..201: mol_type = other DNA
tttttaagtagttgggattataggygttygttattaygttyggttaatttttaatatttttagtagagayggggttttattgtgttagttaggatggtttygattttttgatttygtgattygttygtttyggttttttaaagtgttgggattataggtttgagttattgygttyggtttttagtttttatatttgttaaa

SEQ ID NO: 14575 - DNA, 201 bp, synthetic construct
  misc_feature 1..201: note = Description of Artificial Sequence: Synthetic polynucleotide
  source 1..201: mol_type = other DNA
ttaatataaaaattagttgttttagtygggygyggtggtttaagtttgtaattttagtattttgggaggtygaggygggyggattaygaggttaggagatygagattattttggttaatayggtgaaatttygtttttattaaaaatatataaaaaatgagtygggygyggtggtaggygtttgtagttttagttatttag

SEQ ID NO: 14576 - DNA, 201 bp, synthetic construct
  misc_feature 1..201: note = Description of Artificial Sequence: Synthetic polynucleotide
  source 1..201: mol_type = other DNA
taaattttgttgttgtttattttatgggtttatattgtttttatgagttgtaatatttatygtaaaggtttgtaggtttatttttgagtyggtaagattaygaatttattagaagaaatttygaatatattygaatattagaaggaataaatttyggataygttatttttaagaattgtaatatttatygtaagggttygt

SEQ ID NO: 14577 - DNA, 201 bp, synthetic construct
  misc_feature 1..201: note = Description of Artificial Sequence: Synthetic polynucleotide
  source 1..201: mol_type = other DNA
ttttgttttagtttttttagtagttgggattataggygttygttatygygttyggttaattttttgtatttttaatagaaayggggttttatygtggtttygattttttgatttygtgattygtygtttatttyggttttttaaagtgttgggattataggygtgagttatygygttyggtttttttttttatttttaata

SEQ ID NO: 14578 - DNA, 201 bp, synthetic construct
  misc_feature 1..201: note = Description of Artificial Sequence: Synthetic polynucleotide
  source 1..201: mol_type = other DNA
ggggttttatygtgttagttaggatggtttygattttttgattttgtaataygttygtttyggttttttaaaatgttgggattataggygtgagttatygygtttagttggttttataggtatttatgtatattaatagtttttttttgagayggagtttygttttatttttaggttggagtgtaatggygttgttttgat

SEQ ID NO: 14579 - DNA, 235 bp, synthetic construct
  misc_feature 1..235: note = Description of Artificial Sequence: Synthetic polynucleotide
  source 1..235: mol_type = other DNA
ttaattttttaggtgtygtttgttatttttttttttgattaggaaagggaattttttgattttttgtgttttyggagtgaggtaatgtttygttttgtttyggtttaygtagggtgygygtatttattgatttgygtttattgtttggtattttttagtgagatgaattyggtattttagatggaaatgtagaaattatttattttttgygtygttttttttgggagttgtagat

SEQ ID NO: 14580 - DNA, 201 bp, synthetic construct
  misc_feature 1..201: note = Description of Artificial Sequence: Synthetic polynucleotide
  source 1..201: mol_type = other DNA
ggtagataaagatatatgattagggtyggtygyggtgatttatgtttgtaattttagtattttgggaggttaaggygaayggattaygaagttaggagatygagattattttggttaatatggtgaaattttgtttttattaaaaatataaaaaattagtygagygtggtggtgggygtttgtagygttagttattygggg

SEQ ID NO: 14581 - DNA, 201 bp, synthetic construct
  misc_feature 1..201: note = Description of Artificial Sequence: Synthetic polynucleotide
  source 1..201: mol_type = other DNA
taggtgatttttgtatttttatttgaggtatygggtttattttattagggagtgttagatagtgggygygggttagtgggtgygtgtattatgygtaagtygaagtagggygaggtattgttttatttgggaagygtaaggggatagggagtttttttttygagttaaaaaaaggggtgatagaygtatttggataattag

SEQ ID NO: 14582 - DNA, 201 bp, synthetic construct
  misc_feature 1..201: note = Description of Artificial Sequence: Synthetic polynucleotide
  source 1..201: mol_type = other DNA
agagatagaagttgttggagggygagaggaaygtattagtggaagaagatagaagyggttggttayggagagtatgttagtagaagaatatatttatagaygtyggttygttygygggtttttyggtaggttatygatyggtgggaygaggtggagtttgttttgggtagtaggaggatagttygggtatttagyggttta

SEQ ID NO: 14583 - DNA, 201 bp, synthetic construct
  misc_feature 1..201: note = Description of Artificial Sequence: Synthetic polynucleotide
  source 1..201: mol_type = other DNA
tttatagaggtaggtaggtttttttgagttgtggtgggttttatttagttygagtttttyggttgttttgtttatttaagygagtttgggtaatggygggygttttttttttagtttygttgttgttttgtagtttgattttagattgttgtgttagtaattagtaagattyggtgggtataggatttttygagttaggtg

SEQ ID NO: 14584 - DNA, 201 bp, synthetic construct
  misc_feature 1..201: note = Description of Artificial Sequence: Synthetic polynucleotide
  source 1..201: mol_type = other DNA
gtttttttttttagttaaagaaaggggtgatagaaggtatttggaaaatygggttatttttattagaatattgygttttttygaygggtttaaaaaayggygtatttggagattatattyggtatttggtttagagggttttaygtttatagagtttygttgattgttagtatagtagtttaagattaaattgtaaggygg

SEQ ID NO: 14585 - DNA, 201 bp, synthetic construct
  misc_feature 1..201: note = Description of Artificial Sequence: Synthetic polynucleotide
  source 1..201: mol_type = other DNA
ygttygttatttttttttttgattyggaaagggaattttttgattttttgtgttttttaggtgaggtaatgtttygttttgtttyggttygygtayggtgygygtatttattggtttgygtttattgtttggtatttttttagtgagatgaattyggtattttagatggaaatgtagaaattattygttttttgygtygtt

SEQ ID NO: 14586 - DNA, 201 bp, synthetic construct
  misc_feature 1..201: note = Description of Artificial Sequence: Synthetic polynucleotide
  source 1..201: mol_type = other DNA
gtaagtaaggggygtgttttagttttgtttgtgttagagtttttttatttttattatttggtaggtttagygttygggaataatgaygtaygtggataagyggagggtgagtaaggtgaagaggagttttattgagtaatagaatagtttagaggagattygyggtgggtagtttttttttgtagttagggtgttttgatg

SEQ ID NO: 14587 - DNA, 201 bp, synthetic construct
  misc_feature 1..201: note = Description of Artificial Sequence: Synthetic polynucleotide
  source 1..201: mol_type = other DNA
ggtagattatttgaggttaggagttygagattagtttggttaatatggtgaaatttygtttttattaaaaatataaatattagtygggygtggtggtggtygtttgtaattttagttattygggaggttgaggtaggagaattgttggatttygggaggtagatgttgtagtgagttaagattatgttattgtattttagt

SEQ ID NO: 14588 - DNA, 201 bp, synthetic construct
  misc_feature 1..201: note = Description of Artificial Sequence: Synthetic polynucleotide
  source 1..201: mol_type = other DNA
ttgtagtatatattattatttttttagtatattattattttttaattyggtttttatygttaataaagttgtyggttgtaggaatgagagagtggtagaaygatattttygttttattttttgggattttttagttgttggyggttttaagtttttaggagttayggtgttttttttttttagatgttagtgttaatagtg

SEQ ID NO: 14589 - DNA, 201 bp, synthetic construct
  misc_feature 1..201: note = Description of Artificial Sequence: Synthetic polynucleotide
  source 1..201: mol_type = other DNA
ggttagaagayggtgagtggaaagttygggygygtggagagattttaagaaggggttgtttagttgtgaattttgtatttgtygttygtgttttatttggyggttttgaaattaggtttttatttggatttttgtgagttgtatattttyggttagttattttygttttagagggtttagatattggtagtgtyggaagac

SEQ ID NO: 14590 - DNA, 207 bp, synthetic construct
  misc_feature 1..207: note = Description of Artificial Sequence: Synthetic polynucleotide
  source 1..207: mol_type = other DNA
gtttttgtgatttttgtagttagygaattagtatatttttggggttgaagttaygtgttaggtaygttagygttattagttygtttagggttagttttttygayggyggyggtagtaggtggatttygggtyggaatgtgttttttggagggtagagagttaggttagggggttgggtaggggatgagagagtttttttgttttggt

SEQ ID NO: 14591 - DNA, 201 bp, synthetic construct
  misc_feature 1..201: note = Description of Artificial Sequence: Synthetic polynucleotide
  source 1..201: mol_type = other DNA
tttatggggtagttagaagggagatggtttttttttggagttggggtgttyggtagtttyggtttttttttgattgtttaggttaattttygttttttttygttggtttayggtttattggttttygggtgtttgttagygtgtttttttgttggggtgtttttatggatgattagygtttgtgttttttttttttgatgt

SEQ ID NO: 14592 - DNA, 201 bp, synthetic construct
  misc_feature 1..201: note = Description of Artificial Sequence: Synthetic polynucleotide
  source 1..201: mol_type = other DNA
gaagaygggtgatttttgtatttttatttgaggtatyggttttattttattagggagtgttagatagtgggygtaggttagtgggtgygtgtatygtgygygaagtagggygaggtattgttttatttgggaagygtaaggggttagggagtttttttttygagttaaagaaaggggtgayggaygtatttggaaaatygg

SEQ ID NO: 14593 - DNA, 201 bp, synthetic construct
  misc_feature 1..201: note = Description of Artificial Sequence: Synthetic polynucleotide
  source 1..201: mol_type = other DNA
ggggygtggttttttggagggaattagtgtggagatgttygtgtgtttggggygtggtttttyggagggagttagtgtggagatgttygtgtgtttggggygtggtttattagagggagttagtgtggagatgttygtgtgtttggggygtggttttttggagggaattagtgyggagatgtyggtgtgtttggggygtgg

SEQ ID NO: 14594 - DNA, 201 bp, synthetic construct
  misc_feature 1..201: note = Description of Artificial Sequence: Synthetic polynucleotide
  source 1..201: mol_type = other DNA
gaygttttttattttttagatggggtggtggyggggtagagatattttttagtttttagatggggtygyggtttggtagaggtgttttttatattttagaygatgggtggtygggtagagaygttttttattttttagaygggatgayggttaggaagaggygttttttattttttagattgggyggtygggtagaggggt

SEQ ID NO: 14595 - DNA, 201 bp, synthetic construct
  misc_feature 1..201: note = Description of Artificial Sequence: Synthetic polynucleotide
  source 1..201: mol_type = other DNA
gagtatagygtyggygggttggtattgttgggggattyggygtattttttatagttgttgtttygggtggtaagttttttattgttyggggttggtggggyggttagttgttyggagtgtggggttygttaaggttatgtttatttagaatttgttttggtttatygygagtagttttagttttygtttygygtttttttt

SEQ ID NO: 14596 - DNA, 201 bp, synthetic construct
  misc_feature 1..201: note = Description of Artificial Sequence: Synthetic polynucleotide
  source 1..201: mol_type = other DNA
tttttgagtagttggggttataggtgtttattattaygttyggttaattttttgtatttttagtagagatggggttttatygtgttagttaggatggtttygattttttgaygttgtgatttatygtttyggtttttygaaatgttgggattataggtttgagttatygtattyggttatatttatttatttttaattaga

SEQ ID NO: 14597 - DNA, 201 bp, synthetic construct
  misc_feature 1..201: note = Description of Artificial Sequence: Synthetic polynucleotide
  source 1..201: mol_type = other DNA
ttttttttttttttgattggtttygtttttattgtyggtttygtttttattgtyggttygggttttatttaygttggagttgttttatttaaggagattgygtagttggaaagttataygtgtgagtttagaggygggtttyggttgtagatttgttatggttttygaagtttttgtgygtttaggggtgttttttggtyg

SEQ ID NO: 14598 - DNA, 201 bp, synthetic construct
  misc_feature 1..201: note = Description of Artificial Sequence: Synthetic polynucleotide
  source 1..201: mol_type = other DNA
gttagttagttattttgagatggagttttgttttgtygtttaggttgtagtgtagaatygtttttttggtttattgtaatttttatttttygggtttaagygataattttgttttagttttttaagtagttggaattatagaygtgtattattaygtttaattaatttttgtatttttagtagagatggggtttygttata

SEQ ID NO: 14599 - DNA, 201 bp, synthetic construct
  misc_feature 1..201: note = Description of Artificial Sequence: Synthetic polynucleotide
  source 1..201: mol_type = other DNA
gyggttttttttgatttagatygtttttaaatatygaaygttgaattgggtygggygyggtggtttttatttgttattttagtattttgggaggtygaggygggyggattatgaggttaggagatygagattattttggttaatayggtgaaatttygtttttattaaaaatataaaaaaaaaaaattagtygggygtgat

SEQ ID NO: 14600 - DNA, 201 bp, synthetic construct
  misc_feature 1..201: note = Description of Artificial Sequence: Synthetic polynucleotide
  source 1..201: mol_type = other DNA
ttatttttgttttttattttgggggttttatgatttyggagtttttaygttttggtatagagtttgttttttygggattgggtttyggtygagtagatatygtttagttgttttttgattagygttttttgttttgygtttggttggtatyggyggtttgttgagtttagtttggtatttygttggtatyggyggttygtt

SEQ ID NO: 14601 - DNA, 380 bp, synthetic construct
  misc_feature 1..380: note = Description of Artificial Sequence: Synthetic polynucleotide
  source 1..380: mol_type = other DNA
ttttattaaaatataaaaaattggttgggggtggtggtaygtgtttgtagttttagttataygggaggttgaagtaggggaattgtttgaattygggaggyggagattgtagtgagtygagatygtgttattgtattttaatggtattttagtttgatgatagagygagatttygttttaaaaataataataaataaataaataaataaataaaaattagttgggygtggtggygtgtgtttgtagttttagttattygggagattgaggtaggagaatygygggaattygggaggyggaggttgtagtgagtygagatygygttattgttttgtagtatggagatagagttagatttygtttaaaaaaaaaaaaaaaaa

SEQ ID NO: 14602 - DNA, 201 bp, synthetic construct
  misc_feature 1..201: note = Description of Artificial Sequence: Synthetic polynucleotide
  source 1..201: mol_type = other DNA
aggygggyggattaygaggttaggagatygagattattttggttaatayggtgaaatttygtttttattaaaaatataaaaaattagttgggygtggyggygggtatttttagttttagttatttgggaggttgaggtaggagaatggygtgaattygggaggyggagtttgtagtgagtygagatygygttattgtattt

SEQ ID NO: 14603 - DNA, 201 bp, synthetic construct
  misc_feature 1..201: note = Description of Artificial Sequence: Synthetic polynucleotide
  source 1..201: mol_type = other DNA
aaaaattagttyggygtggtggtaygygtttgtaattttaattatttgggaggttgyggtaggtgaattatttgaagtygggaggtgaaggtygtagtaaygttgttttttgtattggatgaagtgttttttattaaatttttttatyggagagggtgggatttgygggttttttgggtggtttgatttygatattttgtg

SEQ ID NO: 14604 - DNA, 201 bp, synthetic construct
  misc_feature 1..201: note = Description of Artificial Sequence: Synthetic polynucleotide
  source 1..201: mol_type = other DNA
ayggygaattgyggygattgtgaygtgtttttttatttttttttyggtggattttttttatttgttttttttttaatttttaataagtttttattatygaygaygtgagaygaygayggtatgggattttttatttygttagggttaatgaattttatattatgagttgtatgaggtatgagggagtttttaagggaggaa

SEQ ID NO: 14605 - DNA, 201 bp, synthetic construct
  misc_feature 1..201: note = Description of Artificial Sequence: Synthetic polynucleotide
  source 1..201: mol_type = other DNA
gaygtagaagaygggtgatttttgtatttttatttgaggtatygggtttattttattagggagtgttagatagtgggtataggttagtgggtgygtatatygtgygtgagtygaagtagggtgaggtattgttttatttgggaagygtaaggggttagggagtttttttttygagttaaaggggtgayggaygtatttgga

SEQ ID NO: 14606 - DNA, 201 bp, synthetic construct
  misc_feature 1..201: note = Description of Artificial Sequence: Synthetic polynucleotide
  source 1..201: mol_type = other DNA
taaataattagggataaagagtattatattgtygaatttattttatttttaattttttttttaaattttttataaaaaattagtygggtgtggtggygggygtttgtagttttagttatttagagattgaggtaggagaatggygtgaattygggaggaggagtttgtagtaagyggagatygygttattgtattatagtt

SEQ ID NO: 14607 - DNA, 201 bp, synthetic construct
  misc_feature 1..201: note = Description of Artificial Sequence: Synthetic polynucleotide
  source 1..201: mol_type = other DNA
atttttgtgatttatattttattygtatattttttttttttttgaaaatttttaataaaaatttgttggttttayggtttaggggtattatagaatttatygatatgtgatgtttttttyggatgttyggttttaaaattttttttttttgtattttgtttttttattttttaatttggtygaygtttagggaaaatagaa

SEQ ID NO: 14608 - DNA, 201 bp, synthetic construct
  misc_feature 1..201: note = Description of Artificial Sequence: Synthetic polynucleotide
  source 1..201: mol_type = other DNA
ttttggygaatttttattgttataattttaaaaattyggtttagggaggagtttattttttattttttatataggygatatatgtagaaatataattygtygttgtgtttgtgyggttaggattttttttttataygtaatgatttagttgattagtttaagatatgttyggtttttaygtttgtttgtaggggtattgtt

SEQ ID NO: 14609 - DNA, 201 bp, synthetic construct
  misc_feature 1..201: note = Description of Artificial Sequence: Synthetic polynucleotide
  source 1..201: mol_type = other DNA
ttgggagtagaggtttttyggaaggtattatttttagagygtgtttttgagtaattttgaggatgggtttygggttattattgtgtgttggaaatagtagygtttaggttgtyggaggaggttggtttttttggtaggttttggttgtgtttagagttttgtgggttttggagataaggtttyggtttgaggtttttgggg

SEQ ID NO: 14610 - DNA, 201 bp, synthetic construct
  misc_feature 1..201: note = Description of Artificial Sequence: Synthetic polynucleotide
  source 1..201: mol_type = other DNA
gtttgagtaggataaggattttagagtttaagagaattttgatgattagagaagggttttygaggttatyggggatgtayggtttgtatttyggtttttgygggataatggaggtttttttttttttttgtgttygggttygggtttttgtagatagatttttatatttagaggtgagaaattagatataattagatattt

SEQ ID NO: 14611 - DNA, 201 bp, synthetic construct
  misc_feature 1..201: note = Description of Artificial Sequence: Synthetic polynucleotide
  source 1..201: mol_type = other DNA
ttatatgttaggttataaaataagtttttagaaatttaagaagattgaaattatattaattattttttaaaaaaaataggtggtygggygyggtggtttaygtttgtaattttagtattttgggaggtygagaygggyggattaygaggttaggagatygagattattttggttaatayggtgaaatttygtttttattaa

SEQ ID NO: 14612 - DNA, 568 bp, synthetic construct
  misc_feature 1..568: note = Description of Artificial Sequence: Synthetic polynucleotide
  source 1..568: mol_type = other DNA
ttagtatatagatataaaaatgagaggtgatagygtgttggtagtttttatagttttygttttttttyggtattttttyggttttggygtttattttggtygygtttgaggagttttttagttygtygttgtattgtgggagtttttttttgggttggataaggttggagtyggtttttttagtttgygggtaggtgtggagagagaggygtgggygggaatygtggttgtaggttgygtttgygggttagttygagtttygggtgggygtgggtttggtaagtttygtattyggagyggttagtyggttygggtagtgaggagtttagtatttgggttagtagttgttgtgttygatttttygttgggttttagttgttttttygtygggtagggttygggatttgtagttttttatgtttgagtttttattttygtygtgygtttttgtgtagtttaagttttttygaygagygttaatttttgttttayggygtttagttttatygattgtttaagggttgaggagtgygggtatayggygtyggattggtaggtagttttattt

SEQ ID NO: 14613 - DNA, 201 bp, synthetic construct
  misc_feature 1..201: note = Description of Artificial Sequence: Synthetic polynucleotide
  source 1..201: mol_type = other DNA
tttattaaaaatataaaaaattagttgggtattatggtgggtgtttgtagttttagttattygggaggttgaggtaggagaatggygtgaattygggaggyggagtttgtagtgagyggagatygygtygttgtattttagtttgggygatagagtaygagttygttttaaaaaaagaaaaaaaagaaagaaaagaaaaga

SEQ ID NO: 14614 - DNA, 201 bp, synthetic construct
  misc_feature 1..201: note = Description of Artificial Sequence: Synthetic polynucleotide
  source 1..201: mol_type = other DNA
gggttggttaaggtyggagttggttttttttgtttgyggggaggtgtggagggagaggygtaggtgggaattagggttgtgtggggygtttgtgggtaagygtgagtttygggtgggagygggttyggtaaatttattttagggtgttttgttttttataaagaaaattttttttggggtttttatgggtttttttgggat

SEQ ID NO: 14615 - DNA, 201 bp, synthetic construct
  misc_feature 1..201: note = Description of Artificial Sequence: Synthetic polynucleotide
  source 1..201: mol_type = other DNA
ttttaagtagttgggattataggtattygttattatgtttggttaattttttgtattttttagtatagatggggttttatygtgttaattaggatggtttygattttttgatttygtgatttgttygttttggttttttaaagtgtygggattataggygtgagttatygtgtttagttatatattatattttttttattt

SEQ ID NO: 14616 - DNA, 201 bp, synthetic construct
  misc_feature 1..201: note = Description of Artificial Sequence: Synthetic polynucleotide
  source 1..201: mol_type = other DNA
aattatggggtgaattttgttatggggatatgtatttggggggaaggttgtgatgggaggggtattygggttaaataygggyggttgttagtgaagagttygtaagatagagtaggagttagggggaatagggagggaggggtattttttttttttttttttgagayggagttttattttgttttttaggttggagtgtag

SEQ ID NO: 14617 - DNA, 201 bp, synthetic construct
  misc_feature 1..201: note = Description of Artificial Sequence: Synthetic polynucleotide
  source 1..201: mol_type = other DNA
tataggagtataaaagggttggyggttttgttygggtatattgttygtttttttatttattygtgtattttagtttattatttttgagttgggygtagtaygtggtttagagaaygggaagggatttaygagtgtttgatatatataattattgttgttggtgattatttttatttatgagtggygtatggatggggttag

SEQ ID NO: 14618 - DNA, 201 bp, synthetic construct
  misc_feature 1..201: note = Description of Artificial Sequence: Synthetic polynucleotide
  source 1..201: mol_type = other DNA
taaaggtttgtttttgtatttaagtatttgagtttttaagagttagttttygggtttttttggagtaaggtttygttyggttttaygtatttgtttygttygtygtgatggtgagttygttgttgggttygtttttgttaattyggtttttggygtatatgyggatgttgtaggtggaggaagggtggatattaatgatgg

SEQ ID NO: 14619 - DNA, 201 bp, synthetic construct
  misc_feature 1..201: note = Description of Artificial Sequence: Synthetic polynucleotide
  source 1..201: mol_type = other DNA
tttggttggttttgggatttgttttttggtggttaagtagtggttatgaaagtttagtygttgttatatttttgaggaatyggygtattttygtttatagyggtagttgggggtatttaygtggttyggggttgttttgatttggtagygtatgggggttgttgtttgggttttttagtgtgttatttgygygtttttygt

SEQ ID NO: 14620 - DNA, 201 bp, synthetic construct
  misc_feature 1..201: note = Description of Artificial Sequence: Synthetic polynucleotide
  source 1..201: mol_type = other DNA
ttyggygtyggtatttattagygtggttagtttggtygaagtttygyggaagggygggattaggygtygtatygtygtgtttagggattggaattggygtygttygtaggttatgaggtttattatggagtttagygtygtattttgygagaggggtggatgtgggggtygtagggattttagayggttygggatygattt

SEQ ID NO: 14621 - DNA, 201 bp, synthetic construct
  misc_feature 1..201: note = Description of Artificial Sequence: Synthetic polynucleotide
  source 1..201: mol_type = other DNA
tggttattttgggagtttgttgttgatgaattgtagtatggttatttgggtygtttattttgtatggttaygttgttyggttattgttgtaggtaygtttygtttygtttaattttttggttggtggggttattygggtgtttgtataygattttttttgagagggttagaggtyggtttaattatttgtaaataatgtta

SEQ ID NO: 14622 - DNA, 201 bp, synthetic construct
  misc_feature 1..201: note = Description of Artificial Sequence: Synthetic polynucleotide
  source 1..201: mol_type = other DNA
ttagtatataggatatttatgygtgtttattattyggtataygggagatttaygygtgtttattgtygggtataggggagatttaygygtgtttattgttyggtataygagagatttaygygtgtttatygtttggtatagggagatttaygygtgtttattgttyggtataggggagatttaygygtgtttattgttygg

SEQ ID NO: 14623 - DNA, 201 bp, synthetic construct
  misc_feature 1..201: note = Description of Artificial Sequence: Synthetic polynucleotide
  source 1..201: mol_type = other DNA
aggggaatagtaatagaagttttatttattaggtatttattgtgtgttaagtattgtgttaagggttttatagaataatagtataagaattttggtygggygtagtggtttatttttgtaattttagtattttgggaggtygaggtgggtggattaygaggttaggagttagagagattagtttagttaatatggtgaaat

SEQ ID NO: 14624 - DNA, 201 bp, synthetic construct
  misc_feature 1..201: note = Description of Artificial Sequence: Synthetic polynucleotide
  source 1..201: mol_type = other DNA
tgtaygtatygtgygygagtygaagtagggygaggtattgttttattygggaagtaygaggggttagggagtttttatttttagttaaagaaaggggtgayggaygtatttggaaaatygggttatttttattygaatattgygttttttyggygggtttaaaaaayggygtattaygagattatattttatatttggttc

SEQ ID NO: 14625 - DNA, 201 bp, synthetic construct
  misc_feature 1..201: note = Description of Artificial Sequence: Synthetic polynucleotide
  source 1..201: mol_type = other DNA
gttygttattaygttyggagaattttttgtatttttagtggagataggtttttattatgttagttaggatggtttygattttttgatttygtgatttgttygtttyggtttygtaaagtgttgggattataggygtgaggtatagygttyggtttygattgttttatttaaagtaatgaaagtatagttggttttaaagga

SEQ ID NO: 14626 - DNA, 201 bp, synthetic construct
  misc_feature 1..201: note = Description of Artificial Sequence: Synthetic polynucleotide
  source 1..201: mol_type = other DNA
tttgyggttagttggattaggtggtyggtagygagayggaataagtagattaggttgagggtgaaggygtaggygattagtagtatggataagaggttgtygtttgttattttttttatygtttggtttagtatttatttattygtttgtagtaagtttagtagtattatttyggtygtygtygttattttattttgtygg

SEQ ID NO: 14627 - DNA, 201 bp, synthetic construct
  misc_feature 1..201: note = Description of Artificial Sequence: Synthetic polynucleotide
  source 1..201: mol_type = other DNA
ttagattgttttttttttgagatagagtttygttttgttatttaggttagagtgyggaggygygattttagtttattgtaagtttygtttttygggtttaygttatttttttgttttagttttgygagtagttgggattataggygtttgttatygygtyggttaatttttttggtatttttagtagagatagggttttat

SEQ ID NO: 14628 - DNA, 201 bp, synthetic construct
  misc_feature 1..201: note = Description of Artificial Sequence: Synthetic polynucleotide
  source 1..201: mol_type = other DNA
atagtttattaaaaatataaaaaaaaaaaaaaaaaaatttgtygggtgtggtggtgtgtgtttgtaattttagttatttgggaggttgaggtaagagaatygattgaattygggaggtagagattgtagtgagtttagattatgttattgtattttagtttggataagagtgagattttattttaaaaataaaaataaaaa

SEQ ID NO: 14629 - DNA, 201 bp, synthetic construct
  misc_feature 1..201: note = Description of Artificial Sequence: Synthetic polynucleotide
  source 1..201: mol_type = other DNA
tgtttttttttgttttgagatggagttttattttattgtttaggttggagtgtagtggtgttattttggtttattgtaatttttatttttygggttttagygatttttttgttttagttttttaagtagttgggattgtaggtgtttataattaygttyggttaatttttgtgtttttagtagagtyggagttttattatg

SEQ ID NO: 14630 - DNA, 201 bp, synthetic construct
  misc_feature 1..201: note = Description of Artificial Sequence: Synthetic polynucleotide
  source 1..201: mol_type = other DNA
tgtttgttattaagtttagttaatttttgtatttttagtagagayggggttttattgtgttggttaggttggtttygaatttttgatttygtgattygttygttttggttttttaaagtgttaggattataagtgtgagttatygygttyggttttttaaatggtatttttgattttttttttttagtttttaaagtaggt

SEQ ID NO: 14631 - DNA, 201 bp, synthetic construct
  misc_feature 1..201: note = Description of Artificial Sequence: Synthetic polynucleotide
  source 1..201: mol_type = other DNA
gttaaggtgggyggattatttgaggttaggagttygagattagtttggttaatatggtgaaattttatttttattaaaaatatggaaaaaattagtygggyggggttygagtttgtaattttagttatttgggagttgaggygygagaatygtttgaagtygggagggggaggttgtaggagtagaggttgtgttattgta

SEQ ID NO: 14632 - DNA, 201 bp, synthetic construct
  misc_feature 1..201: note = Description of Artificial Sequence: Synthetic polynucleotide
  source 1..201: mol_type = other DNA
ggtttgtatggtgygtgattatttttagtggaagttttaatatgggtgtggtttagttttttagggttttttaaggtagaggtggttygggtttttgtagygattttataatatattttaattgtagayggtggagattgygggttgtttttyggtttaagyggttttggggttttygttttgygyggagttattygtgtt

SEQ ID NO: 14633 - DNA, 201 bp, synthetic construct
  misc_feature 1..201: note = Description of Artificial Sequence: Synthetic polynucleotide
  source 1..201: mol_type = other DNA
gygttttgggttattgagagaagtgaaatattgtagatayggtagaggtgtttttttttttttttygtttttagatgtggtttttataygtaggttgatgygttttttttttatttaygtttgttyggttttgttatatatgtygttgtgttgtyggttttgaatgtgtatgagyggttygtgttggggttagyggaggtt

SEQ ID NO: 14634 - DNA, 234 bp, synthetic construct
  misc_feature 1..234: note = Description of Artificial Sequence: Synthetic polynucleotide
  source 1..234: mol_type = other DNA
aggggttatatttatggatttttttttttttggtaggaagatgagtgattatattttygttattattgaattgagygttttgtttgttyggygttagtatygtttgtattattatttygattttatttattatygttyggyggatgggyggaggtttyggtaggtttgtgatatggtgtattattttattattgaagttatttaggaayggyggygggtattgygttagtaggg

SEQ ID NO: 14635 - DNA, 201 bp, synthetic construct
  misc_feature 1..201: note = Description of Artificial Sequence: Synthetic polynucleotide
  source 1..201: mol_type = other DNA
ggggttttttgtttttagtatygttagtttaggtgtgttttttatggygtgatgygtttgtagatttggaaatattataggatttaggtattttayggagygttygttttgtgttagttttagtttagygttttttagatatygtttgatttttyggaggtagttatygatattgygtttattgtatagatgagaaagttg

SEQ ID NO: 14636 - DNA, 201 bp, synthetic construct
  misc_feature 1..201: note = Description of Artificial Sequence: Synthetic polynucleotide
  source 1..201: mol_type = other DNA
tttttagtgagatgaattyggtattttagatggaaatgtagaaattattygttttttgygtygtttaygttgggagttgtagatyggagttgtttttattyggttattttggttttttttttttgttttttttttgagatagtgtttttttttatttttgttatttaggttgtagtgtagtggygyggtttgtgtttattg

SEQ ID NO: 14637 - DNA, 201 bp, synthetic construct
  misc_feature 1..201: note = Description of Artificial Sequence: Synthetic polynucleotide
  source 1..201: mol_type = other DNA
taattttattttgtttttgagatagagtttygttttgtygtttaggttggagtgtagtggygtaatttyggtttattgtaagtttygtttttygggtttaygttattygtttgttttagttttttgaataattgggattataggygttygttattaygttyggttaaatttttgtatttttagtagagayggggttttatc

SEQ ID NO: 14638 - DNA, 201 bp, synthetic construct
  misc_feature 1..201: note = Description of Artificial Sequence: Synthetic polynucleotide
  source 1..201: mol_type = other DNA
atttttagggttgyggatggtagaattaaaagagttaattagtaagtagaatygtttttttyggggttttaaggtttgagtattttttttggggtgttatygtatttttttyggggtgatatgtttggtttagttgtaagttttgtttagaatttgtttgtgtatyggtgtttggaatagttagttggattttatatttat

SEQ ID NO: 14639 - DNA, 201 bp, synthetic construct
  misc_feature 1..201: note = Description of Artificial Sequence: Synthetic polynucleotide
  source 1..201: mol_type = other DNA
ggtttttgtagggagtttatattagtagttttttattttgaggagataygygggtttttttttygaagttygtttaggaggtagatggagygattygattyggaggataggagggtgtttaggggttttggygttatagtttttataggatgattttggagygtttttggatttygagttgttttggttaaggagtygtat

SEQ ID NO: 14640 - DNA, 201 bp, synthetic construct
  misc_feature 1..201: note = Description of Artificial Sequence: Synthetic polynucleotide
  source 1..201: mol_type = other DNA
tatatataggygtggatatttatatggttttyggtagtgttgtaggaggttagtatagagaygtgttgaggagtttgagatgttygtttttttgggttatygygtgtaaaggttgttttygttgtggatttttatatgtgtgatatatatgaataggygaaayggataygtayggtttttatataygtgagttgggttttt

SEQ ID NO: 14641 - DNA, 201 bp, synthetic construct
  misc_feature 1..201: note = Description of Artificial Sequence: Synthetic polynucleotide
  source 1..201: mol_type = other DNA
tttttgtgaaggtattaagtayggtagaygtttttatatygtyggggttygtttttttgtggaygggaagtgggaaygtgaygtggaygtgaygtgggaaygtaaygtgaygtgaygtgaygtgaygtggtatggygygaggatagygyggygggagyggygttttagatttagtagggagggagaygaaaggyggatgga

SEQ ID NO: 14642 - DNA, 201 bp, synthetic construct
  misc_feature 1..201: note = Description of Artificial Sequence: Synthetic polynucleotide
  source 1..201: mol_type = other DNA
gttgggygtggtggtaygtgtttgtagttttagttatttaggaggttgaggtaggagaattttttgaattygggaygtagaggttgtagtgagttgagatygygttattgtattttagtttggtaatagagtgagatttyggtttaaaaaaaaaaaaaaagaaaaaaaaaaaaaaaagaaggagttgaggttttaagaatt

SEQ ID NO: 14643 - DNA, 201 bp, synthetic construct
  misc_feature 1..201: note = Description of Artificial Sequence: Synthetic polynucleotide
  source 1..201: mol_type = other DNA
ttgtattttgtgggtaggggatattttttttagtggttggtgatgattgtgattttatttgtygagttttgtgggagtttyggtagtttttygtaattgtyggttggttgttattgttttagygtttgttttttgattggttagtaaattayggtggtagatagaaaaaagatagtttttttttttagggttgttttataa

SEQ ID NO: 14644 - DNA, 201 bp, synthetic construct
  misc_feature 1..201: note = Description of Artificial Sequence: Synthetic polynucleotide
  source 1..201: mol_type = other DNA
ttttgttggygtattttgttggygtattttgttggygtattttgttggygtattttgttggygtattttgttggygtattttgttggygtattttgttggygtaagttgygttttgggattgggtttgaaaagggaggagttatttattttaagtttttaggttyggggagaattttatagtaagttttttgggagtttga

SEQ ID NO: 14645 - DNA, 686 bp, synthetic construct
  misc_feature 1..686: note = Description of Artificial Sequence: Synthetic polynucleotide
  source 1..686: mol_type = other DNA
gtggtatttgtaggtttttaggattaggtagaggatttagtttttttaggattggggtttyggygttgygttttaggggaggtygaygggggttgggaggygtttagggygggaatttagygtaygggtgaggattttaaaaagtaaggggtaggatgagttaataaggttttgagtaggaaaattatgygataggaagtgtatatattgttttatagtagaaagatyggggaygggattagtttttaagygattttaaatttaaaaggaagtaatttttagatttttatgggygttttaatttgttttgggtgaaggaagataggtaagaatttttaggtttgtgaggattttaygttttagggatagaagtgttagggatttgggaagtgtagatttaatataaggtagagtaaaatttaygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyggggtygggattagatttgtgtattttttygtttygtatttagygtttttgtttttygggtgtttggaggtgagagyggttaggaaggttgaggtatgat

SEQ ID NO: 14646 - DNA, 201 bp, synthetic construct
  misc_feature 1..201: note = Description of Artificial Sequence: Synthetic polynucleotide
  source 1..201: mol_type = other DNA
gttagagtgtagtggtgygatttyggtttattgtaagtttygtttttygggtttaygttatttttttgttttagtttttttagtagttgggataggggtaygtygttaygttyggttagtttttgtatttttagtagagayggggttttattatattagttaggayggtttygattttttgatttygtgatttgttagttt

SEQ ID NO: 14647 - DNA, 201 bp, synthetic construct
  misc_feature 1..201: note = Description of Artificial Sequence: Synthetic polynucleotide
  source 1..201: mol_type = other DNA
gttagagattttgtttttaaaagtaaaaaagaaaaaaaaagtttttttttaagttattatatattttgaataattaatattgaaaattgttggtygggygyggtggtttaygtttgtaattttagtattttgggaggtygaggyggggyggattaygagattagtagaayggygtgaattyggaaggyggagtttgtagtg

SEQ ID NO: 14648 - DNA, 201 bp, synthetic construct
  misc_feature 1..201: note = Description of Artificial Sequence: Synthetic polynucleotide
  source 1..201: mol_type = other DNA
ttgtatttttatttgaggtatygggtttattttattagggagtgttagatagtgggygtaggttagtgggtgygtgtatygtgtgygagtygaagtagggygaggtattgttttatttgggaagygtaaggggttagggagttttttttttgagttaaagaaaggggtgayggaygtattttgaaaatygggttattttta

SEQ ID NO: 14649 - DNA, 201 bp, synthetic construct
  misc_feature 1..201: note = Description of Artificial Sequence: Synthetic polynucleotide
  source 1..201: mol_type = other DNA
aygtatttattgatttgygtttattgtttggtagtttttagtgagatgaattyggtattttagttggaaatgtagaaattattattttttgtgtygtttaygttgggagttgtagatyggagttgtttttattyggttatgttggttttttttttggatataattatttttgtatttatttaatttttatttttatggaat

SEQ ID NO: 14650 - DNA, 201 bp, synthetic construct
  misc_feature 1..201: note = Description of Artificial Sequence: Synthetic polynucleotide
  source 1..201: mol_type = other DNA
tttttatgtgattattgtttgtttgttagygttagttttttttgattttaaattataagtggaagaaagtaygttagaaatttatagaattggttyggygyggtggtttaggtttgtaattttagtattttgggaggtygaggtaggyggattaygaggttaggagatygagattattttggttaatagggtgaaatttyg

SEQ ID NO: 14651 - DNA, 201 bp, synthetic construct
  misc_feature 1..201: note = Description of Artificial Sequence: Synthetic polynucleotide
  source 1..201: mol_type = other DNA
aagttttttttttttttttttttttttttttttgagayggagttttattttttygtttaagttggattgtagtggygttatttyggtttattgtaagtttygttttttgggtttatgttatttttttgttttagtttttygagtagttgggattataggygtttattattaygttyggttaattttttgtatttttagtag

SEQ ID NO: 14652 - DNA, 201 bp, synthetic construct
  misc_feature 1..201: note = Description of Artificial Sequence: Synthetic polynucleotide
  source 1..201: mol_type = other DNA
ygtttggtgtatgttgtggagggygtgggtaatggygtatatygtattaattataaattgtattttgtttttttgttygtaggtggagtttyggtygatgygtttttygtttgttttagggatgtttagagaaagtgtgttyggtttttatgtatygaattyggtttttygttttttttttttttatttttattatttttt

SEQ ID NO: 14653 - DNA, 201 bp, synthetic construct
  misc_feature 1..201: note = Description of Artificial Sequence: Synthetic polynucleotide
  source 1..201: mol_type = other DNA
gattttagggggttttattttagyggttttttttattttttttgtagagaaaaaagagtgtyggygggattatygtttatygtgtgtttaggaggygtttygtaatatggtgtattttaatgtgatttgygatggttgtaatgggtttgtggtaggaattygttataagtgtagygtttgtttagattaygatttgtgtag

SEQ ID NO: 14654 - DNA, 201 bp, synthetic construct
  misc_feature 1..201: note = Description of Artificial Sequence: Synthetic polynucleotide
  source 1..201: mol_type = other DNA
ggtattttatttatttagagatagagtttygttgygaygtttaggttggagtgtatggygtaattttggtttattgtaggtttygtttttygggttttagygatttttttgttttagtttttygagtagttggggttatagttatgtgttattaygtygggttaatttttgtatttttagtagagatagggtttttttata

SEQ ID NO: 14655 - DNA, 201 bp, synthetic construct
  misc_feature 1..201: note = Description of Artificial Sequence: Synthetic polynucleotide
  source 1..201: mol_type = other DNA
ttattatgtttaattaattttttttatttgtagtagagatagggttttattgtgttagttaggatggtttygattttttgattttgtgattygygtgtttyggttttttaaagtgttgggattataggygtgagttatygygttyggtttgtaaatattttttgygttttagtgggttatgtttttattttgttgattgtt

SEQ ID NO: 14656 - DNA, 227 bp, synthetic construct
  misc_feature 1..227: note = Description of Artificial Sequence: Synthetic polynucleotide
  source 1..227: mol_type = other DNA
ttagttttttgagtagttggaattataggtgttygttattaygttyggtttattttttgtatttttagtagagayggggttttattatgttagttaggatygttttgattttttgatttygtgattygtyggtttyggttttttaaagtgttgggattataggygtgagttattaygtttagttttagaaattgaaatgtatattattaagtgaaagaagttaattt

SEQ ID NO: 14657 - DNA, 201 bp, synthetic construct
  misc_feature 1..201: note = Description of Artificial Sequence: Synthetic polynucleotide
  source 1..201: mol_type = other DNA
tttttttttagttttgttgttattttgtagtttgattttagattgttgtgttagtaattagygagatttygagttaggtgtgggatataatttygtggtgygtygttttttaagtyggtyggaaaagygtaatattygggtgggagtgattygattttttaggtgygttygttatttttttttttgattyggaaagggaat

SEQ ID NO: 14658 - DNA, 201 bp, synthetic construct
  misc_feature 1..201: note = Description of Artificial Sequence: Synthetic polynucleotide
  source 1..201: mol_type = other DNA
aggtgygtttgttatttttttttttgattyggaaagggaattttttgattttttgygttttttaagtgaggtaatgtttttttttgtttyggttygygtayggtgtatgtttttattgatttgygtttattgtttggtttttttaagtgagatgaattyggtattttagatggaaatgtagaaattattygttttttgygt

SEQ ID NO: 14659 - DNA, 201 bp, synthetic construct
  misc_feature 1..201: note = Description of Artificial Sequence: Synthetic polynucleotide
  source 1..201: mol_type = other DNA
tgtttttttgttttagtgtttatattgtaaaaaagtgttttttttatygggygyggtggtttaygtttgtaattttagtattttgggaggtagaggygggyggattaygaggttaggagatygaaattattttggttaatayggtgaaatttygtttgtattgtgaatataaaaaattagtygggygtggtggygggtgtt

SEQ ID NO: 14660 - DNA, 201 bp, synthetic construct
  misc_feature 1..201: note = Description of Artificial Sequence: Synthetic polynucleotide
  source 1..201: mol_type = other DNA
gtygggygtggtggygggtatttgtagttttagttattygggaggttgaggtaggagaatggggtgaattygggaggyggagtttgtagtgagtygagatygygttattgtattttagtttgggtgatagagygagattttattttaaaaaaaaataatattaggattgaagtttgttttttaatttttagtgatayggtt

SEQ ID NO: 14661 - DNA, 201 bp, synthetic construct
  misc_feature 1..201: note = Description of Artificial Sequence: Synthetic polynucleotide
  source 1..201: mol_type = other DNA
tgaataagaaagggttattatattttattttgaaatggtttttggagaaagaatggaagtaaattgtataagtgggygtttatttttttttattyggttayggttatygtggtgttyggttaggtttttggtgaygtgaggtaaattttttygttggtaaattagtttatatattttttttattgtagayggttatttaga

SEQ ID NO: 14662 - DNA, 201 bp, synthetic construct
  misc_feature 1..201: note = Description of Artificial Sequence: Synthetic polynucleotide
  source 1..201: mol_type = other DNA
ttaagtatttttttgtgattygtttagaggaatttttggtagtggggatggygttatttttatttgagagatgaggagattgaggtttagaggggggaygyggtttgttygagttatattgattgagaggggtagatttggattygtttgtagtttaagtttttagagattttggtgtggtttgtygggtagttagtttgt

SEQ ID NO: 14663 - DNA, 201 bp, synthetic construct
  misc_feature 1..201: note = Description of Artificial Sequence: Synthetic polynucleotide
  source 1..201: mol_type = other DNA
gtgtgattttggaggggtaagaattatttyggtagttatgggggagtttaygagtgtttgataagaggttaygtttttttgggattttttagaaagttagyggaggggtyggggatagtagttgttttgggtttaaggtgagtagtattgtygtttttgaggatggygtgtaggtgaaggtattgtygattttaggttggg

SEQ ID NO: 14664 - DNA, 201 bp, synthetic construct
  misc_feature 1..201: note = Description of Artificial Sequence: Synthetic polynucleotide
  source 1..201: mol_type = other DNA
ttyggatatttaggttattttygaattttaaggtttttaatygtagttataygtatagaggtttttttgttatgtggggtaatayggttatagggtaagayggttaygggttttagatatttttgggttattattttgtttatygtaggtggatatagttatggaatggaagtaatttttttgattatttayggtagtttt

SEQ ID NO: 14665 - DNA, 201 bp, synthetic construct
  misc_feature 1..201: note = Description of Artificial Sequence: Synthetic polynucleotide
  source 1..201: mol_type = other DNA
gattttttygagtttgtygggagatagttaygttaatggttataaygggtatagygtttaggaaygtagtaatttagttagtygttagttttttttttggygygggtattatttaaygygtttatttggggtttagatgygataaattggtygagggattttgggttttggttgggaygagygtagtaaatttgtygttat

SEQ ID NO: 14666 - DNA, 201 bp, synthetic construct
  misc_feature 1..201: note = Description of Artificial Sequence: Synthetic polynucleotide
  source 1..201: mol_type = other DNA
ttttgaatagtagtaggtagtagagttttagggagagtaggttttygtggtgtagtattayggttttgtgttttatttyggagaagttgayggagatgtgygtttyggggatgggttttaggattagttttttygyggtttggtygttgttygggagyggttgtyggyggatggtgtagtgtagaggtaggatgtyggggg

SEQ ID NO: 14667 - DNA, 201 bp, synthetic construct
  misc_feature 1..201: note = Description of Artificial Sequence: Synthetic polynucleotide
  source 1..201: mol_type = other DNA
atagggttttattttgttagttaggatggtttygattttttgatttygtgattygttagtttyggttttttaaagtgttgggattataggygtgagttatygtattgggttggtagttattttttttaagtagtagttttattttttagtataaattaatgttgtagtttttaaattatttgttgaagtgtttttgaattt

SEQ ID NO: 14668 - DNA, 201 bp, synthetic construct
  misc_feature 1..201: note = Description of Artificial Sequence: Synthetic polynucleotide
  source 1..201: mol_type = other DNA
ttttttttttttttttgagatagaattttgttttgttgtttaggttggagtatagtggtgygatattagtttattgtaaattttatttttygggtttaagygatttttttgttttagttttttgagtatttgggattatagggagtgtttttatatttggttaattttttgtatttttagtagagatagggttttatygtg

SEQ ID NO: 14669 - DNA, 201 bp, synthetic construct
  misc_feature 1..201: note = Description of Artificial Sequence: Synthetic polynucleotide
  source 1..201: mol_type = other DNA
aatagttgggygyggtggtttatatttgtaattttagtattttgggaggttgaggygggtagattaygaggttaggaaatygagattattttggttagtayggtgaaatttygtttttattaaaaatataaaaaaaattagtygggygttgtggyggaygtttgtagttttagttatttttaaggttgaggtaggagaatg

SEQ ID NO: 14670 - DNA, 201 bp, synthetic construct
  misc_feature 1..201: note = Description of Artificial Sequence: Synthetic polynucleotide
  source 1..201: mol_type = other DNA
ttgattyggaaagggaattttttgattttttgygttttttaagtgaggtaatgttttgttttgttttggttggygtayggtgygygtatttattgatttgygtttattgtttggttttttttagtgagatgaattyggtattttagatggaaatgtagaaattattygttttttgtatygtttaygttgggagttgtagat

SEQ ID NO: 14671 - DNA, 201 bp, synthetic construct
  misc_feature 1..201: note = Description of Artificial Sequence: Synthetic polynucleotide
  source 1..201: mol_type = other DNA
tttttattttgttttttagatagaatttygttgtgttatttaggttggagtgtagtggygtgattttggtttattgtaatttttgtttttygggtttaygygatttttttgttttagttttttaagtagttgggattgtaggtgtgtattattatgtttatattaagtttttgtatttttagtagagatggggttttgtta

SEQ ID NO: 14672 - DNA, 201 bp, synthetic construct
  misc_feature 1..201: note = Description of Artificial Sequence: Synthetic polynucleotide
  source 1..201: mol_type = other DNA
tagtgaaatttygtttttattaaaaatataaaaaattagttyggygtggtgaagggtatttgtagtygtagttatttaggaggttgaggtaggagaatggygtgaattygggaggtggagtttgtagtgaatygagattaygttattgtattttagtttgggygatagagtgagattttgttttaaagaaatagaagattt

SEQ ID NO: 14673 - DNA, 201 bp, synthetic construct
  misc_feature 1..201: note = Description of Artificial Sequence: Synthetic polynucleotide
  source 1..201: mol_type = other DNA
ttttgtgaaaaataaaaaaaataagtygggygyggtggtttaygtttgtaattttagtattttgggaggtygaagtaggtagattaygaggttaggagatygagattattttggttaaygyggtgaaatttygtttttattaaaaatataaaatattagtygggygtagtggygggygtttgtagttttagttattyggga

SEQ ID NO: 14674 - DNA, 201 bp, synthetic construct
  misc_feature 1..201: note = Description of Artificial Sequence: Synthetic polynucleotide
  source 1..201: mol_type = other DNA
gagttaaagtgataygtttgtttgggttttttaaagtgttggaattatagatttgagttatygggtttagtttaattattttttttagtttgagtatgagygtyggaagaaaagtttttatttgtatttattttttttagatatagggtttttttttgttatttaggttggagagtagtggygtaattttygttyggttta

SEQ ID NO: 14675 - DNA, 201 bp, synthetic construct
  misc_feature 1..201: note = Description of Artificial Sequence: Synthetic polynucleotide
  source 1..201: mol_type = other DNA
ggagtatgaggtaggagagttatttgaattygggaggtagaggttgttgtgagtygagattatatttttttattttagtttgagtggtagagtaagatttygttttaaaaaaaaaaaaaaaaagttgggggaaggagagaaaaatagagagtttagtggggtaattttttatttagtttttgttatttgttattgttttag

SEQ ID NO: 14676 - DNA, 201 bp, synthetic construct
  misc_feature 1..201: note = Description of Artificial Sequence: Synthetic polynucleotide
  source 1..201: mol_type = other DNA
atatttggtttttgggatttgtatatttttgttttttttgggtggaaagayggtttttttgattagggtttttttgtgttttagagggtaygttttttttygtaagtgtgagtygtatattagtgagtatgtgtttttatttttagggatatyggttattaggtttggggttagatggtaggattttygttttttttttta

SEQ ID NO: 14677 - DNA, 201 bp, synthetic construct
  misc_feature 1..201: note = Description of Artificial Sequence: Synthetic polynucleotide
  source 1..201: mol_type = other DNA
ttataggygttygttattaygttyggttaattttttgtgttttgtttagtagagayggggttttatygtattagttaggatggtttygatttgttgatttygtgattygttygtttyggttttttaaagtgttgggattataggygtgagttattttgygttyggtttttttatttttatattttaaattagagatgattt

SEQ ID NO: 14678 - DNA, 217 bp, synthetic construct
  misc_feature 1..217: note = Description of Artificial Sequence: Synthetic polynucleotide
  source 1..217: mol_type = other DNA
tataggygttttttattaygttyggttaattttttgtatttttagtagagayggggttttatygygttagttaggatggtttygattttttgattgagatygygtttttttgatygygttyggtygattttttttttttttttatttgttttttttttttttattattattaaaagtttattgttttatatttttttttttttaattttatttaaaa

SEQ ID NO: 14679 - DNA, 217 bp, synthetic construct
  misc_feature 1..217: note = Description of Artificial Sequence: Synthetic polynucleotide
  source 1..217: mol_type = other DNA
ggtttatagtttttagtttgagygaygtagaagaygggtgatttttgtatttttatttgaggtatygggtttattttattagggagtgttagatagtgggygtaggttagtgagtgygtgtatygtgygygagtygaagtagggygaggtattgttttatttgggaagggtaaggggttagggagtttttttttttagttaaagaaaggggtgaygg

SEQ ID NO: 14680 - DNA, 201 bp, synthetic construct
  misc_feature 1..201: note = Description of Artificial Sequence: Synthetic polynucleotide
  source 1..201: mol_type = other DNA
gttygttattaygttyggttaaatttttgtatttttagtagagatggggttttattttgttaattaggatggtgtygattttttgatttygtgattygttygttttggttttttaaagtgtygggattataggygtgagttattgygttyggtttggaaattgttttttatgtagttgatttattttaatttttattagta

SEQ ID NO: 14681 - DNA, 201 bp, synthetic construct
  misc_feature 1..201: note = Description of Artificial Sequence: Synthetic polynucleotide
  source 1..201: mol_type = other DNA
tatatgattttgaataagttttgaattatttatatgtgatttttyggttttatatgaggtagaatagtayggtgtggatygggaattttgaygtgggagtygaaagatggggaggttgtgggtayggttttyggagtttygggattgagatatgtaggtattttagaygggtttgttgttataataagtgggaaattttta

SEQ ID NO: 14682 - DNA, 201 bp, synthetic construct
  misc_feature 1..201: note = Description of Artificial Sequence: Synthetic polynucleotide
  source 1..201: mol_type = other DNA
tttagagaagattyggtagtttttttagttttyggtttttgttttygttttttttttttttgtttttaggttttttttttgtagttttttagttttttatygygttttgygtttttggttttttttttttttagtgttttttttatttggygtygttyggtygtaattttggtttttttggggaagaggttyggattttat

SEQ ID NO: 14683 - DNA, 201 bp, synthetic construct
  misc_feature 1..201: note = Description of Artificial Sequence: Synthetic polynucleotide
  source 1..201: mol_type = other DNA
tgtttttatattggaaaaatttaaatatttttaagagtttgattattggtygggygyggtggtttaaygtttgtaattttagtattttgggaggtygaggyggtyggattataaggttaggagatygtgattattttggttaatayggtgaaatttygattttattaaaaaaatataaaaaaattagtygggygyggtggc

SEQ ID NO: 14684 - DNA, 201 bp, synthetic construct
  misc_feature 1..201: note = Description of Artificial Sequence: Synthetic polynucleotide
  source 1..201: mol_type = other DNA
gatttggttgtttagaagygtgtgttatttyggattgagttaagatggtygaataggaatagtttyggtttatagtttttattgtgagygaygtagaagaygggtgatttttgtatttttatttgaggtatygggtttattttattagggagtgttagatagtgggtgtaggttagtgggtgygygtatygtgygtgagtt

SEQ ID NO: 14685 - DNA, 201 bp, synthetic construct
  misc_feature 1..201: note = Description of Artificial Sequence: Synthetic polynucleotide
  source 1..201: mol_type = other DNA
ttttggtygggygtygtggtttaygtttgtaattttagtgagaggtgatagtatgttggtagttttygtagtttttttttattagygygattttygggtgygygtgggttgggttggttygtatttggagyggttagtagtttygggtagtgaggggtttagtatttgggttagtagttgttgtgttygatttttygttag

SEQ ID NO: 14686 - DNA, 201 bp, synthetic construct
  misc_feature 1..201: note = Description of Artificial Sequence: Synthetic polynucleotide
  source 1..201: mol_type = other DNA
tgtggtygggygyggtggtttatttttgtaattttagaattttgggaggtygaggygggyggattaygagattagtagattgagattattttggttaatayggtgaaatttygtttttattaaaaatatagaaaaagtagtygggygtggtggygggtatttgtagttttagttataggttgaggtagaagaatggygtga

SEQ ID NO: 14687 - DNA, 201 bp, synthetic construct
  misc_feature 1..201: note = Description of Artificial Sequence: Synthetic polynucleotide
  source 1..201: mol_type = other DNA
tttyggttttttaaagtgttggggttataggygtgagttatygygttyggttagtygtttttattaaaaatataaaaaattagtttggygtggtggygggygtttgtagttttagttatttyggaggttgaggtaggggaattgtttgaatttatgaggyggaggttttaagtygaggtygtgttattgtattttagtttg

SEQ ID NO: 14688 - DNA, 201 bp, synthetic construct
  misc_feature 1..201: note = Description of Artificial Sequence: Synthetic polynucleotide
  source 1..201: mol_type = other DNA
ggttggagtgtagtggygtgatttyggttygttataatttttattttttagtagtttgttttggttttttaaagtgtygagattgtagtttttgttyggtygttatttygtttgagaagtgaggagygtttttgtttggtygttattttatttaggaagtgaggagygttttttttyggtygttattttatttgggaagtg

SEQ ID NO: 14689 - DNA, 201 bp, synthetic construct
  misc_feature 1..201: note = Description of Artificial Sequence: Synthetic polynucleotide
  source 1..201: mol_type = other DNA
gttttagttgttttttygyggggtagggttygggatttgtagttygttatgtttgagttttttatttttttygtgggtttttgtgyggttygagttttttygaygagygttattttttgttttayggtatttagttttattgattatttaagggttgaggagtgygggygtatagtatygggattggtaggtagttttatt

SEQ ID NO: 14690 - DNA, 286 bp, synthetic construct
  misc_feature 1..286: note = Description of Artificial Sequence: Synthetic polynucleotide
  source 1..286: mol_type = other DNA
gaagaygggtgatttttgtatttttatttgaggtatygggtttattttattagggagtgttagatagtgggygtaggttagtgggtgygygtatygtgygygagtygaagtagggygaggtattgttttatttgggaagygtaaggggttagagagtttttttttygagttaaataaatgggtgayggaygtatttggaaaatygggttatttttattygattattgygttttttagatyggtttaaaaaayggtgtattaygagattatattttatatttggttc

SEQ ID NO: 14691 - DNA, 201 bp, synthetic construct
  misc_feature 1..201: note = Description of Artificial Sequence: Synthetic polynucleotide
  source 1..201: mol_type = other DNA
gttttagttgtttttttgyggggtagggtttgggatttgtagtttgttatgtgtgagtttttttttattgttttaggtttttgtgtagtaggagttttttygaygagtatygttttttgttttatggtattyggttttatygattgtggaayggttgaggagygtgggtataaggtatgggattggtaggtagttttgttt

SEQ ID NO: 14692 - DNA, 201 bp, synthetic construct
  misc_feature 1..201: note = Description of Artificial Sequence: Synthetic polynucleotide
  source 1..201: mol_type = other DNA
ggagtgtaatggtattatttyggtttattgtaattttygtttttygggtttaggygatttttttgttttagtttttygagtatttgggattataggygygygtttttaygtttaattaatttttgtatttttagtagagayggagttttattatgttggttaggttygtttygaatttttgatttygtgatttattygttt

SEQ ID NO: 14693 - DNA, 201 bp, synthetic construct
  misc_feature 1..201: note = Description of Artificial Sequence: Synthetic polynucleotide
  source 1..201: mol_type = other DNA
ttttygttatttttttttttgattyggaaagggaattttttgattttttgygtttttygagtgaggtaatgtttygttttgtttyggttygygtatattgygtatatttattgatttgygtttattgtttggtattttttagtgagatgaattyggtattttagatggaaatgtagaaattattygttttttgygtygttt

SEQ ID NO: 14694 - DNA, 201 bp, synthetic construct
  misc_feature 1..201: note = Description of Artificial Sequence: Synthetic polynucleotide
  source 1..201: mol_type = other DNA
gaygtagaagaygggtgatttttgtatttttatttgaggtatygggtttattttattagggagtgttagatagtgggygtaggttygtgggtgtatgtatygtgtgygagttgaagtagggygaggtattgttttatttyggaagygtagggggttagggagtttttttttttagttaaagaaaggggtgatagayggtat

SEQ ID NO: 14695 - DNA, 201 bp, synthetic construct
  misc_feature 1..201: note = Description of Artificial Sequence: Synthetic polynucleotide
  source 1..201: mol_type = other DNA
tttagttaattttttttatatttttaatagagatagggttttattatgttggttaggatagttttgattttttgatttygtgattygttygtttyggtttygtaaagtgttgggattataggygtgagttatygtattyggttggaagtatatattttaatagttttatatagtagttgttgttagaatttaaatgaagat

SEQ ID NO: 14696 - DNA, 201 bp, synthetic construct
  misc_feature 1..201: note = Description of Artificial Sequence: Synthetic polynucleotide
  source 1..201: mol_type = other DNA
tagaagaygggtgatttttgtatttttatttgaggtatygggtttattttattagggagtgttagatagtgggygtaggttagtgtgtgtgygtatygtgygygagtygaagtagggygaggtattgttttatttgggaagygtaaggggttagggagttttttttttgagttagggaaaggggtgayggatggtatttgg

SEQ ID NO: 14697 - DNA, 201 bp, synthetic construct
  misc_feature 1..201: note = Description of Artificial Sequence: Synthetic polynucleotide
  source 1..201: mol_type = other DNA
ttggtagggtyggtyggttgtttttagtgyggggtttgttaagtttaygtttattyggaattttagttggttygtaagtattatgtatagtttgggttttygtttaygtttttttatttatatttttttgtaagttgagggagygggttttggttttggttagtttagaaaggggtttttatagtgtagyggtgggttgaa

SEQ ID NO: 14698 - DNA, 201 bp, synthetic construct
  misc_feature 1..201: note = Description of Artificial Sequence: Synthetic polynucleotide
  source 1..201: mol_type = other DNA
tttgagattttygtagtttyggggtttgagttgaggggttatyggtagtgtygtgggagttaggttgttttttyggaagttaggttgtttttgagtagagyggaggttttatygtttttyggggggtayggtggtagtttttaggttgtattggggttggatgagttgggggtggagtataaggggttagttttttttttt

SEQ ID NO: 14699 - DNA, 201 bp, synthetic construct
  misc_feature 1..201: note = Description of Artificial Sequence: Synthetic polynucleotide
  source 1..201: mol_type = other DNA
aaatttttygtttgtagggggygggtggggaggtggaggaggggttgggttaaaygttgggggtgtgattyggggttgygggttttygggttttagttttygggtttgtygagtgggygagtggggtgttttattttttgyggttttttttyggtttttatagaatatggagaaggygattttgtygtyggtgaygtttat

SEQ ID NO: 14700 - DNA, 201 bp, synthetic construct
  misc_feature 1..201: note = Description of Artificial Sequence: Synthetic polynucleotide
  source 1..201: mol_type = other DNA
gggygtttgtagttttagttattygggaggttgaggtaggagaatggtatgaattygggaggyggagtttgtagtgagtygagatygygttattgtatttyggtttgggygatagagygagatttygttaaaaaaaaaaaaaaaaagtagttttgtaagattaggtgtttggtagataggtatatttagtaaagttataat

SEQ ID NO: 14701 - DNA, 210 bp, synthetic construct
  misc_feature 1..210: note = Description of Artificial Sequence: Synthetic polynucleotide
  source 1..210: mol_type = other DNA
ttattaaaaatataaaaaaattagtttggygyggtggygggygtttttagttttagttgttygggaggttgaggtaggagaatggygtgaattygggaggyggagtttgyggtgagtygagattttgttatagtattttagttygggygatagagtgagatttygttttagaaaaaaaaaaaaaaaaaaaaaagaagtgggaatttagaa

SEQ ID NO: 14702 - DNA, 201 bp, synthetic construct
  misc_feature 1..201: note = Description of Artificial Sequence: Synthetic polynucleotide
  source 1..201: mol_type = other DNA
tttygggtttaygttattttttygttttagtttttygagtagttgggattataggtattyggttaattttttgtattttttatagagayggggtttttatygtgttagttaggatggttttgattttttgatttygtgattygtttgtttgggttttttaaagtgttgggattataggygtgagttatygygtttagtttg

SEQ ID NO: 14703 - DNA, 201 bp, synthetic construct
  misc_feature 1..201: note = Description of Artificial Sequence: Synthetic polynucleotide
  source 1..201: mol_type = other DNA
gatygttttttygttattgtatttatataatttgttttaaatgggtaatttattaagtatattttgtttttgttttygtygtaggtttttgtyggatygtygtttataagtttttatagttygtgagtttttttagtttggttyggtttattttgtggygtttaygtttatttygggtttttttygatttttttttaattt

SEQ ID NO: 14704 - DNA, 201 bp, synthetic construct
  misc_feature 1..201: note = Description of Artificial Sequence: Synthetic polynucleotide
  source 1..201: mol_type = other DNA
gtagtgtagtggygtaatttyggtttattgtaagtttygtttttygggtttaygttatttttttgttttagttttygggttagttgggattataggygttygttattgtgttaggttaattttttgtatttttagtagagatggggttttattatattagttaggatggtttygattttttgatttygtgatttattygtt

SEQ ID NO: 14705 - DNA, 201 bp, synthetic construct
  misc_feature 1..201: note = Description of Artificial Sequence: Synthetic polynucleotide
  source 1..201: mol_type = other DNA
ttygtgtttttttttttygagtyggygggttatagaygtyggaagaaattttygtatttgtagttggaattgtagtttayggygtttyggttttttttttygttttgtttttttttggttaaataatatattaaagaggygaggtaatgattgttggttagtttttatyggggaaaaatttattgttaggatggtatgaat

SEQ ID NO: 14706 - DNA, 201 bp, synthetic construct
  misc_feature 1..201: note = Description of Artificial Sequence: Synthetic polynucleotide
  source 1..201: mol_type = other DNA
ggaataaatatttttgttttataaagatttagaatttattggatattgataaaatgtttattagaggtyggygtagtggtttatgtttataatttyggygyggtggtttatatttgtaatttygaygtggtggtttatatatgtaattttagtatttygtaaggttaggtggggggattatttgagtttaggagtttatga

SEQ ID NO: 14707 - DNA, 201 bp, synthetic construct
  misc_feature 1..201: note = Description of Artificial Sequence: Synthetic polynucleotide
  source 1..201: mol_type = other DNA
gtggtgtaattttggtttattgtaagttttgtttttygggtttatgttatttttttgttttaggttttygagtagttgggattataggtgtatattattaygttyggttaatttttttgtatttttagtaaagayggggttttattatgttagttaggatggtttygattttttgattttgtgatttattagttttagttt

SEQ ID NO: 14708 - DNA, 201 bp, synthetic construct
  misc_feature 1..201: note = Description of Artificial Sequence: Synthetic polynucleotide
  source 1..201: mol_type = other DNA
gtaaattttttgtaaaattttggttttttagattttagttgggtttttttttttaggtttttagtggtagttgtgttttttgtgtgtttaygtyggttagygtaagttatatatggatttagtgtttattgtatttttgttagttttagggttttagttygttgtttygggagattttagttttggtttaggtattttttt

SEQ ID NO: 14709 - DNA, 201 bp, synthetic construct
  misc_feature 1..201: note = Description of Artificial Sequence: Synthetic polynucleotide
  source 1..201: mol_type = other DNA
ttttaatttttttattaagatggagttttgttttatygtttaggttggagtgtagtggygygattayggtttattataattttygtttttygggtttaagygatttttttgttttagtttttygagtagttgggattataggtatgtgttattatgtttaggtaattttagtatttttagttgagayggggttttattatg

SEQ ID NO: 14710 - DNA, 201 bp, synthetic construct
  misc_feature 1..201: note = Description of Artificial Sequence: Synthetic polynucleotide
  source 1..201: mol_type = other DNA
ttttgttaggygyggtggtttatgtttgtaattttagtattttggaaygtygaggtaggygaattaygaggttaagagatygagattatttttgttaatayggtgaaatttygtttttattaaaaatataaaaaattagtygggygtgggggygggygtttgtagttttagttgttygggaggttgaggtaggagaatygt

SEQ ID NO: 14711 - DNA, 201 bp, synthetic construct
  misc_feature 1..201: note = Description of Artificial Sequence: Synthetic polynucleotide
  source 1..201: mol_type = other DNA
attattttttttttttttgagayggagttttgttttgtygtttaygttggggtgtagtggtaygatttyggtttattgtaagtttygtttttygggtttaygttatttttttgttttaatttttygagtagttgggattataggtatatgttattatattyggttaatttttttgaatttttagtagagaggggttttatt

SEQ ID NO: 14712 - DNA, 201 bp, synthetic construct
  misc_feature 1..201: note = Description of Artificial Sequence: Synthetic polynucleotide
  source 1..201: mol_type = other DNA
ttygygaattygggtggtgttttttttttgtattatttagaygtgtttttaggaaggaygtgttgttatgattygttatggtggtttyggggatggttagyggygggatgatgggtgtgatgtggtttyggggatggttagyggtaggatgatgggtgtgaygtatttgtgttatttgggatttaaatttatttatgattt

SEQ ID NO: 14713 - DNA, 201 bp, synthetic construct
  misc_feature 1..201: note = Description of Artificial Sequence: Synthetic polynucleotide
  source 1..201: mol_type = other DNA
attgggttttatygtgttagttaggatggtttygattttttgattttgtgattagttygtttyggttttttaaagtgttggtattataggygtgagttatygttttyggtaaagttttttttygatggttttagtttgttggataagttaggaataaggttattggttgtaagggaggaggagtttttgtaggtggtagyg

SEQ ID NO: 14714 - DNA, 201 bp, synthetic construct
  misc_feature 1..201: note = Description of Artificial Sequence: Synthetic polynucleotide
  source 1..201: mol_type = other DNA
ggtgatttaaatygtttatgtggaatatatatatatatatatatatatatatatatgtgttttagggayggatatatataaataygtgttttaggggtttygtgtgaggagaggagatttatattattgatttagtaattagggtygattttagagggttggagtatatatttygggttgaygataggygtttggttttgg

SEQ ID NO: 14715 - DNA, 201 bp, synthetic construct
  misc_feature 1..201: note = Description of Artificial Sequence: Synthetic polynucleotide
  source 1..201: mol_type = other DNA
tttyggttygtttttttttattttaggttgttttaatttttttttgaaagtttggygtttattttttattttttgggaaatattttgtygttttggggtgygtttygtgaaggagataygttgggtgaaagttagggattttataattatttttygtttttatttygggtttagtgtaggggttgtygtgaaggtattggt

SEQ ID NO: 14716 - DNA, 201 bp, synthetic construct
  misc_feature 1..201: note = Description of Artificial Sequence: Synthetic polynucleotide
  source 1..201: mol_type = other DNA
aggttgttgggaaggaattggtttttatggaagtgttttagtttttttgttttttyggtttttttttttyggttgttttagtgttttattgaaagtttggygttatatttttatttttygggaaattttatgtttttttggggtgtttttygtggggaagataygtattttgggtgaaagttagggattttatgaatattt

SEQ ID NO: 14717 - DNA, 201 bp, synthetic construct
  misc_feature 1..201: note = Description of Artificial Sequence: Synthetic polynucleotide
  source 1..201: mol_type = other DNA
attaatttaaatatttattaatgatagattggataaagaaaatgtggtggggtggagttaagatggtygaataggaatagtttyggtttatagtttttagygtgagygaygtagaagatgggtgatttttgtatttttaattgaggtaaygggtttattttattggggagtgttggatagttggtgtaggatagtgggtgt

SEQ ID NO: 14718 - DNA, 201 bp, synthetic construct
  misc_feature 1..201: note = Description of Artificial Sequence: Synthetic polynucleotide
  source 1..201: mol_type = other DNA
gttygttattatattyggttaattttttgtatttttaatagagayggggttttatygtgttagtaaggatggtttygattttttggtttygtgattygttygygtyggtttttygaagtgttgggattataggtatgagttatygygttyggttagaagtgtttttatttgtttgggaagttgtttttttttggtatttgt

SEQ ID NO: 14719 - DNA, 201 bp, synthetic construct
  misc_feature 1..201: note = Description of Artificial Sequence: Synthetic polynucleotide
  source 1..201: mol_type = other DNA
ttttttattttaaggaataagtttttaattagattagatatagttataagtaaatataaattatgtttttatgtaattttaagagttattttaggtygggygyggtggtttatgtttgtaattatagtattttyggaggtygtggygggyggattaygaggttaggagattgagattattttggttaatatggtgaaatta

SEQ ID NO: 14720 - DNA, 201 bp, synthetic construct
  misc_feature 1..201: note = Description of Artificial Sequence: Synthetic polynucleotide
  source 1..201: mol_type = other DNA
ggttaattaggggtaygtttttttatgtatatggygggtatttttattttagttggtyggtagtggtatygtatatggtattttatatttgtatttttttygttttggtttagtgtggttagggatgggttttgttagtttgtagygttattygttttgtgtaaggtttagaattgtttatttaygtaagtygggagttyg

SEQ ID NO: 14721 - DNA, 366 bp, synthetic construct
  misc_feature 1..366: note = Description of Artificial Sequence: Synthetic polynucleotide
  source 1..366: mol_type = other DNA
tgagygaygtagaagaygggtgatttttgtatttttatttgaggtatygggtttattttattagggagtgttaggtagtgggygtaggttagtgggtgygygtatygtgggygagtygaagtagggygaggtattgttttatttgggaagygttaggggttagggagtttttttttygagttaaggaaaggggtgatygaygtatttagaaaatygggttatttttattygaatattgygttttttagatyggtttaaaaaatggygtattaygagattatattttatatttggtttggagggttttaygtttayggaattttattgattgttagtatagtagtttgagattaaattgtaaggygg

SEQ ID NO: 14722 - DNA, 201 bp, synthetic construct
  misc_feature 1..201: note = Description of Artificial Sequence: Synthetic polynucleotide
  source 1..201: mol_type = other DNA
ataaaggttttttaagtttatattagatttaygagtttagttggttttatttagtggatttygtatygggggtygtaggtggagttgtttgttagtttygygtagtgtttttatagtttttagtttttgggyggtygatgggatygggygtygtggagtagggggtagygtttattggggaggttyggttttgtaggagtt

SEQ ID NO: 14723 - DNA, 201 bp, synthetic construct
  misc_feature 1..201: note = Description of Artificial Sequence: Synthetic polynucleotide
  source 1..201: mol_type = other DNA
ggtgtygtttgttatttttttttttgattaggaaagggaattttttgattttttgtgttttyggagtgaggtaatgtttygttttgtttyggttygygtgyggtgygttgtatttattgttttgygtttattgtttggtattttttagtgagatgaattyggtattttatatggaaatgtagaaattatttattttttgyg

SEQ ID NO: 14724 - DNA, 201 bp, synthetic construct
  misc_feature 1..201: note = Description of Artificial Sequence: Synthetic polynucleotide
  source 1..201: mol_type = other DNA
gtygttttgtagtttgattttagattgttgtgttagtaattagygagatttygtgggtataggatttttygagttaggtgygggatataatttttaggtgygtygttttttaagtttgttggaaaagtgtagtatttyggttggagtgattygattttttaggtgttgtttgttatttttttttttgattgggaaagggaa

SEQ ID NO: 14725 - DNA, 384 bp, synthetic construct
  misc_feature 1..384: note = Description of Artificial Sequence: Synthetic polynucleotide
  source 1..384: mol_type = other DNA
ttgaattgttttaattttaagyggtttagttttaagttttgygagagtattatyggttagggtttgtagatygtggtygttaattgttttgatttttagaygttgaatgtttaggattgygaggttttygtggaggttttgygttttgttaaaygttattgtaagygttgygttatygagtatattaattyggtttttttttgaagggatagagtttattyggygttgtatttatataaatttgaataaagtaaatttttttaaaagtagygtatgtaagtatygatatttatttaaaatagttttttttttygggaaggttattaggaatttggtttttatttttttttattttttatgggtaatagaggttaaagaaaygaa

SEQ ID NO: 14726 - DNA, 216 bp, synthetic construct
  misc_feature 1..216: note = Description of Artificial Sequence: Synthetic polynucleotide
  source 1..216: mol_type = other DNA
gaagaygggtgatttttgtatttttatttgaggtatygggttaattttattagggagtgttagatagtgggygtaggttagtgggtgygygtatygtgygygagtygaagtagggygaggtattgttttatttgggaagygtaaggggttagggagtttttttttygagttaaagaaaggggtgatggaygtagttggaaaatygggttattttta

SEQ ID NO: 14727 - DNA, 334 bp, synthetic construct
  misc_feature 1..334: note = Description of Artificial Sequence: Synthetic polynucleotide
  source 1..334: mol_type = other DNA
tgatatagaagayggtgatttttgtatttttatttgaggtatygggtttattttattagggagtgttagatagtgggtataggttagtgggtgygygtatygtgygygagtygaagtagggtaaggtaatgttttattygggaagygttaggggttagggagtttttttttttagttaaagaaaggggtgayggaygtatttggaaaatygggttatttttattygaatattgygtttttyggatyggtttaaaaaayggygtattaygagattatatttygtatttggttyggagggttttattygayggagtttygttgattgttagtatag

SEQ ID NO: 14728 - DNA, 201 bp, synthetic construct
  misc_feature 1..201: note = Description of Artificial Sequence: Synthetic polynucleotide
  source 1..201: mol_type = other DNA
gggattttaaggttttgttggtgyggtttaaaggtatyggaygttggggttaagatgattttygygttgttatgaattaggttattggaygygggtttygygtygagtttgtagttttygaggagtttttygggttttttygttttgattatattttttyggatggttgtygggtttttgtttgtttygttttgtatygag

SEQ ID NO: 14729 - DNA, 270 bp, synthetic construct
  misc_feature 1..270: note = Description of Artificial Sequence: Synthetic polynucleotide
  source 1..270: mol_type = other DNA
gttattgtattttagtatgggtgatagagttagtttgaaattttgttttgygtttttttgagaagtgatagtgtatyggtatggtagtttttatagttttygttygtttttggygttttttyggttttggtatttattttggtygygtttgaggagttttttagttygtygttgtattgtggaagtttatttttgggttggttaaggtyggagtyggtttttttagtttgyggggaggtgtggagggagaggtaygggygggaatygggg

SEQ ID NO: 14730 - DNA, 253 bp, synthetic construct
  misc_feature 1..253: note = Description of Artificial Sequence: Synthetic polynucleotide
  source 1..253: mol_type = other DNA
ygtgagygaygtggaagataggtgatttttgtatttttatttgaggtatygggtttattttattagggagtgttagatagtgggygtaggttagtgggtgygygtatygtgygygagtygaagtagggygaggtattgttttatttgggaagygtaaggggttagggagtttygttttygagttaaagaaaggggtgayggaygtatttggaaaatygggttatttttatyggaatattgygttttttygatc

SEQ ID NO: 14731 - DNA, 204 bp, synthetic construct
  misc_feature 1..204: note = Description of Artificial Sequence: Synthetic polynucleotide
  source 1..204: mol_type = other DNA
ttttagtaggggyggtygggtagaggygttttttatttttyggayggggyggttggtygggtaggggggttgattttttttatttttttttyggayggggyggyggtaaagattgagatagtttygttgttygttgaattttattttttyggttaaaattaagttttttaataaagattttgaagtgttgagtttattaattta

SEQ ID NO: 14732 - DNA, 228 bp, synthetic construct
  misc_feature 1..228: note = Description of Artificial Sequence: Synthetic polynucleotide
  source 1..228: mol_type = other DNA
gttattttgtagtttgattttagattgttgtgttagtaatyggygagatttygtgggygtaggatttttygagttaggtgygggatatagttttttgatgygtyggtttttaagttygtaggaaaagygtagtattygggtgggagaggtttgattttttaygtgttgtttgttatttttttttttgattaggaaagggaattttttgattttttgtgtttttygagt

SEQ ID NO: 14733 - DNA, 217 bp, synthetic construct
  misc_feature 1..217: note = Description of Artificial Sequence: Synthetic polynucleotide
  source 1..217: mol_type = other DNA
ygtaggatgtagattgtagaygtttatygtttygtaggtagttttagttygagtggtggtygtgttgggtttgtgttyggggttttttttygtatgttttygttttttagtgtttgygatgaygtgygatttattaattattyggatttagygtatttttatgttaaatagygygtgtttatttgtaaagtataygatagtttttgyggttattggg

SEQ ID NO: 14734 - DNA, 201 bp, synthetic construct
  misc_feature 1..201: note = Description of Artificial Sequence: Synthetic polynucleotide
  source 1..201: mol_type = other DNA
ttatttttgaagttattgagattataagtttattggaaggaattaatttyggatatattttgggtgttygtttgggatattgttatayggtgagtattatyggattygtttgggatattgttatayggtgagtattttyggatttgttttattttttattttgttttatttttttttagaatttaggggttaaatatygga

SEQ ID NO: 14735 - DNA, 204 bp, synthetic construct
  misc_feature 1..204: note = Description of Artificial Sequence: Synthetic polynucleotide
  source 1..204: mol_type = other DNA
aagataataaattggttttaaataaaaagtaagaaaaatgttggggaggagttaagatggttaaataggaatagtttyggtttatagtttttagygtgagygaygyggaaaatgggtgatttttgtatttttatyggaggtatygggtttattttattagggagtgttagatagtgggtataggttagtgggtgtgygtatygt

SEQ ID NO: 14736 - DNA, 223 bp, synthetic construct
  misc_feature 1..223: note = Description of Artificial Sequence: Synthetic polynucleotide
  source 1..223: mol_type = other DNA
tagtgggtatatagaggtagtygggattygtttggaagagttttygttyggggtaaggagtygggattgtgtttaggaggtagtggggagtttyggagagygaagygttttttgygtagattygygtgtttggagtatyggagtttgtagggtaagagagggtttttagaagatttaygaygttttattgggatgtagagggaaayggttatttgtattttta

SEQ ID NO: 14737 - DNA, 201 bp, synthetic construct
  misc_feature 1..201: note = Description of Artificial Sequence: Synthetic polynucleotide
  source 1..201: mol_type = other DNA
tttaaagtattaggattataagtagaattatygygttttttgtttttttttttgtttttgtttttgttttgttgttgttgttgatgttgttatagagtttygtttttgtygtttaggttgggatgtaatggtgtgatttyggtttattgtagttttygtttttyggttttaagtaatttttttgttttagttttgtgagta

SEQ ID NO: 14738 - DNA, 203 bp, synthetic construct
  misc_feature 1..203: note = Description of Artificial Sequence: Synthetic polynucleotide
  source 1..203: mol_type = other DNA
agtataaataaattggtygggyggtagttttagttattygggaggttgaggtagtagaatagygtgaattygggaggyggagtttgtagtgagtygagatygygttattgtattttagtttgggtgatagagtgagattaygttttaaataaaaaaaaaaaaaaaaaaaaaaagtatttttttagatttagtttgatattagg

SEQ ID NO: 14739 - DNA, 201 bp, synthetic construct
  misc_feature 1..201: note = Description of Artificial Sequence: Synthetic polynucleotide
  source 1..201: mol_type = other DNA
ttaygttyggttaatttttttgtattattagtagagaygaggttttatygaggttttatygtgttagtygggatggtttgggttttttgatttygtgattygtttaattyggttttttaaattgttgggattataggtatgagatatygygttyggttgttgtttgattttttttagtagtgttttgtagttttttttgta

SEQ ID NO: 14740 - DNA, 201 bp, synthetic construct
  misc_feature 1..201: note = Description of Artificial Sequence: Synthetic polynucleotide
  source 1..201: mol_type = other DNA
ttttygagtagttgggattataggtgtttgttatttygttyggttaattttttgtatttttagtagagatggggttttatygtgttagttaggatggtttygattttttgatttygtgattygttagtttyggttttttaaagtgttgggattataggygtgagttatygygttyggtttaatttaatttttaataatggt

SEQ ID NO: 14741 - DNA, 201 bp, synthetic construct
  misc_feature 1..201: note = Description of Artificial Sequence: Synthetic polynucleotide
  source 1..201: mol_type = other DNA
aaaagttatagggggygtgaggatagayggygtgtttttttttatatatatggagaygtaggtyggagtaayggtatayggattaygtataygyggyggaygtattaaygtttaygtagaagagaataaaagtygtttttaattgggtataaattttttgtatttaaatatttygatatttataaataaaattagaataga

SEQ ID NO: 14742 - DNA, 201 bp, synthetic construct
  misc_feature 1..201: note = Description of Artificial Sequence: Synthetic polynucleotide
  source 1..201: mol_type = other DNA
tgatttgtttttttyggttttttaaagtgttgggattataggygtgagttatygygttyggtttaggttattttttttttttttttttttttttttgaggyggagtttygttttgtygtttaggttggagtgtagtggygygatttyggtttattgtaagtttygtttttygggtttatatgatttttttgttttagtttt

SEQ ID NO: 14743 - DNA, 201 bp, synthetic construct
  misc_feature 1..201: note = Description of Artificial Sequence: Synthetic polynucleotide
  source 1..201: mol_type = other DNA
ggattataggygtgagttatygygttyggtttaaattatggattttttttttttagtggagtttygtttttgtttaggttggaataggatggtaygaattyggtttattgtaatttttatttttygggtttaagygatttttttgttttagtttttygagtagttgggattataggtatgtgttattatgtttggttagta

SEQ ID NO: 14744 - DNA, 201 bp, synthetic construct
  misc_feature 1..201: note = Description of Artificial Sequence: Synthetic polynucleotide
  source 1..201: mol_type = other DNA
aattttttttttatttttttygtttttttattttataaaatygttattgttattatggtttatttttaatgagttgttgggtatattttttagayggggtygtggtygggtagaggggttttttattttttagtaggggyggtygggtagaagygttttttatttttyggatggggyggttggtygggyggggggttgatt

SEQ ID NO: 14745 - DNA, 201 bp, synthetic construct
  misc_feature 1..201: note = Description of Artificial Sequence: Synthetic polynucleotide
  source 1..201: mol_type = other DNA
gggggttttttaagtttagttttgggttygggtyggggtatagggtagagygggtttttttagtttttgttatgaggttaaggtagtgtatygttygtagygtatatttagaaattaaagtttaggagttggttattatttyggtttatagttgatggaagagtaggtgttttygagaatttatagtgttttttggttagt

SEQ ID NO: 14746 - DNA, 201 bp, synthetic construct
  misc_feature 1..201: note = Description of Artificial Sequence: Synthetic polynucleotide
  source 1..201: mol_type = other DNA
tgggtagtagagtgagattttgttttaaaaaaaaaaaaaaaaagggggggtygggtgyggtggtttaygtttgtaattttagtattttgggagatygaggygggtagattaygaggttaggagatygggattattttagttaaaayggtgaaatttygtttttattaaaaatataaaaaattagtygggygtagtggyggg

SEQ ID NO: 14747 - DNA, 201 bp, synthetic construct
  misc_feature 1..201: note = Description of Artificial Sequence: Synthetic polynucleotide
  source 1..201: mol_type = other DNA
gtgggagttatagggttttaggggaggagygttttaggtygyggtaatagtaggtgtaaaggttttgaggtaggayggggtagggaggtttagagtttatygygtagagattygggaggtyggtaggtayggtgaggattttgatttaaatttaggaaaggggaattatattggggtatgattttttgtatttttygagat

SEQ ID NO: 14748 - DNA, 201 bp, synthetic construct
  misc_feature 1..201: note = Description of Artificial Sequence: Synthetic polynucleotide
  source 1..201: mol_type = other DNA
gggatttttttatgttggttaggttggtttygaatttttgattttaagtgatttatttgtttyggttttttaaagtgatgggattataggtatgagttatygygttyggttaagggtttttttagatgtaattaagttaagatgaggttatattgagttaggtgggttttaaatttaatggttagtgtttttataagtata

SEQ ID NO: 14749 - DNA, 211 bp, synthetic construct
  misc_feature 1..211: note = Description of Artificial Sequence: Synthetic polynucleotide
  source 1..211: mol_type = other DNA
gttttagggtyggaggagtaggagatttgggtagyggggtgggygagtgtygggaggaggtaagaggtygygggggaggaagaygtttttttyggttttgyggggtaggtygygtagggtaggtygtgyggggtaggtggggggtgttaaggaagttygggygtggttatatygtagagaaagttatgggaggtaygttttgagagttggg

SEQ ID NO: 14750 - DNA, 201 bp, synthetic construct
  misc_feature 1..201: note = Description of Artificial Sequence: Synthetic polynucleotide
  source 1..201: mol_type = other DNA
gtagttaaagttatttttttggttgaaagatatttttttyggggggaggagttaagatggtygagtaggaatagtttyggtttatagtttttagygtgagygataaagaagaygggtgatttttgtatttgtatttgaggtattyggtttattttattagggagtgttagatagtgggygtaggttagtgggtgygygtat

SEQ ID NO: 14751 - DNA, 201 bp, synthetic construct
  misc_feature 1..201: note = Description of Artificial Sequence: Synthetic polynucleotide
  source 1..201: mol_type = other DNA
gtttaggatttgtagtttattatgtttgagttttttatttattttatgggtttttgtgtygtttaagtttttyggaygagtgttattttttgttttayggygtttagttttatygattatttaagggttgaggaatgtgagtatayggygtaggattggtaggtagttttatttgtagtttyggtgtgggatttattaggt

SEQ ID NO: 14752 - DNA, 201 bp, synthetic construct
  misc_feature 1..201: note = Description of Artificial Sequence: Synthetic polynucleotide
  source 1..201: mol_type = other DNA
tggtaatattgtgaagaygtaggttttttatgggaaagattgttgttyggaagtttttatataataggtttttattgagattttaaggttgatagtayggygggagtttttgggatttttgggttyggtatagygttatygtagtaggtaggtatygggtggttagaagtygattatttttttaaatggtttgtatatatt

SEQ ID NO: 14753 - DNA, 201 bp, synthetic construct
  misc_feature 1..201: note = Description of Artificial Sequence: Synthetic polynucleotide
  source 1..201: mol_type = other DNA
tttttatgggttgatttggtgattttttatggagaatgygtaggagtyggatattggtattgttaggtggaaaagttttttgttagggtgaaaagttagayggygtttgtttttygtttttggagtgtttttggtttaaygtagtagtttygtagataaaygttatagaaggtagagygttttatagatatgaaggagtgg

SEQ ID NO: 14754 - DNA, 201 bp, synthetic construct
  misc_feature 1..201: note = Description of Artificial Sequence: Synthetic polynucleotide
  source 1..201: mol_type = other DNA
gatttttggattygttgggttgttttygtattyggttttttttttttaagtttgyggtygggtgtggtttttttaattttagygtygattttygtgtttgygygttttttttttattttttttattygyggggttaggggttatayggtatygtygtttgggttttygagtagggagagtygagtgttgattttgttagaa

SEQ ID NO: 14755 - DNA, 201 bp, synthetic construct
  misc_feature 1..201: note = Description of Artificial Sequence: Synthetic polynucleotide
  source 1..201: mol_type = other DNA
ggatattttataaaatttttgaygagttttttttaaaattattaggttggtygggtgyggtggtttatgtttgtaattttagtattttgggaggtygaggygggtagattataaggttaggagatygagattattttggttaatayggtgaaatttygtttttattaaataatataaaaaattagttgggygtggtagygg

SEQ ID NO: 14756 - DNA, 201 bp, synthetic construct
  misc_feature 1..201: note = Description of Artificial Sequence: Synthetic polynucleotide
  source 1..201: mol_type = other DNA
tttttttttatttttttaggggtttgattttttttttaatygtatttttatagaatggtyggttagataggaagtttyggttggygaagtttagttttygygggtataggttggygaattttagagattygggattygggtaggtttygtattygattttttatayggtttygatggagtagtagtagaygtttattyggt

SEQ ID NO: 14757 - DNA, 201 bp, synthetic construct
  misc_feature 1..201: note = Description of Artificial Sequence: Synthetic polynucleotide
  source 1..201: mol_type = other DNA
aaattagttaggtttggtggtaggtatttgtaattttagttattttaggggttgaggtaggagaattgtttgaattygggaggtggaggttgtagtgagtygagattgygtttttgtattttagtttgggggataagagtgagatttygttttaaaaaaaaaaaaaaaaaaaaaaaaaggtygggtggtttatatttgtaa

SEQ ID NO: 14758 - DNA, 201 bp, synthetic construct
  misc_feature 1..201: note = Description of Artificial Sequence: Synthetic polynucleotide
  source 1..201: mol_type = other DNA
tatygttatgatttgygagygygtgttttttatttygttagagttggtagtgtgygttatttattyggtgttyggttattatygttttaygtggayggygyggttggtttttaygtaygygttttyggtggtygaggtygaygtggaygtgttgttgtttatttttatgtttttgygtttttatttgttgggtygggtgat

SEQ ID NO: 14759 - DNA, 201 bp, synthetic construct
  misc_feature 1..201: note = Description of Artificial Sequence: Synthetic polynucleotide
  source 1..201: mol_type = other DNA
ttygyggggttygttygtttttttagtygttgtttttygggyggygttygtyggygtygatttttataatttattttttttagatagagtttttttttgtygtttaggttggagggaagtggtatgattttagtttattgaaatttatttttttygggtttaagygatttttatttttgtttttggagtagttgggattat

SEQ ID NO: 14760 - DNA, 201 bp, synthetic construct
  misc_feature 1..201: note = Description of Artificial Sequence: Synthetic polynucleotide
  source 1..201: mol_type = other DNA
ttattttagttttttgagtagttgggattataggtttgtgttattatgtttagtttattttttattttattttatttttatttttattttttttttgagayggagtttygttttgtygtttaggttggagtgtagtggygggatttyggtttattgtaagtttygtttttygggtttaygttatttttttgttttagtttt

SEQ ID NO: 14761 - DNA, 201 bp, synthetic construct
  misc_feature 1..201: note = Description of Artificial Sequence: Synthetic polynucleotide
  source 1..201: mol_type = other DNA
aaatggtgatttagaggtygtttttattygaygggtttttttagtygaagaygtttagttaatgaattttaagtagatttatggtygggtgtgaagttaayggagtttttatttygtggagaygagtagtataaatttttgtttttaatgtttaatgatatgtaaaatatttaaatttgtaaygtagaattattaagttgt

SEQ ID NO: 14762 - DNA, 201 bp, synthetic construct
  misc_feature 1..201: note = Description of Artificial Sequence: Synthetic polynucleotide
  source 1..201: mol_type = other DNA
ggtaggyggattattttagtttaggagttygagattagtttgggtaatatggtaaaattttatttttataaaaaatataaaaattagtyggttatggtgtygtgtatttgtagttttagttattagggagattgaggtgggagggttatttaagtttgggagaggygggtgtggtggaggttgtagtgagttaagatgtat

SEQ ID NO: 14763 - DNA, 201 bp, synthetic construct
  misc_feature 1..201: note = Description of Artificial Sequence: Synthetic polynucleotide
  source 1..201: mol_type = other DNA
tagattgatagattttttttttttttgagatggagttttgtattgttattygggttggagtgtagtggtgtaatttyggtttatygtaatttttttaattygygtttaagtaatttttttgttttagtttttygagtagttgggattatagggygtgttattaygtttggttaattttttgtatttttagtagagatgggg

SEQ ID NO: 14764 - DNA, 201 bp, synthetic construct
  misc_feature 1..201: note = Description of Artificial Sequence: Synthetic polynucleotide
  source 1..201: mol_type = other DNA
tttygggyggtaaggattttayggtgttggtataygtgttgygtaygttggtatygggtttgggtattttattgtagtttatggttgtagataagggtatygggygtggtttagygggaggattttagtaaggagttggggaaataygtatgtgtttatttagggtyggagtttattgaaggtttatgtgggtagtaygtg

SEQ ID NO: 14765 - DNA, 201 bp, synthetic construct
  misc_feature 1..201: note = Description of Artificial Sequence: Synthetic polynucleotide
  source 1..201: mol_type = other DNA
yggtttattgtaatttttatttttygggtttaagygatttttttgttttagttttttgagtagttaggattataggtatgtattattattttyggttaatygttgaatttttagtagagayggggttttattaygttygtaaggttggtttygaatttttgattttaggtgatgtttttaygtyggttttttaaagtgtta

SEQ ID NO: 14766 - DNA, 201 bp, synthetic construct
  misc_feature 1..201: note = Description of Artificial Sequence: Synthetic polynucleotide
  source 1..201: mol_type = other DNA
yggttttttaaagtgttgagattataggygtgagttatygygttyggtttattttaggtgatttattttttttagttttttaaagtgttgagattataggygtgagttattaygtygggtttattttaggtgatttatttttttyggttttttaaagtgttgagattataggygtgagttatygygttyggtttattttag

SEQ ID NO: 14767 - DNA, 201 bp, synthetic construct
  misc_feature 1..201: note = Description of Artificial Sequence: Synthetic polynucleotide
  source 1..201: mol_type = other DNA
gatttgagaatygtttgtattagtttggttttttgtatagtgtttgygtyggtgtatattttagaggggagttgygttattagatgaattaggattttggyggaggaagggggtgtyggtagggtttttatggtatttgttgtttgtggttgaggggagtttggaagggtattagttttatttatttttggtygagatttt

SEQ ID NO: 14768 - DNA, 201 bp, synthetic construct
  misc_feature 1..201: note = Description of Artificial Sequence: Synthetic polynucleotide
  source 1..201: mol_type = other DNA
ttyggtatatttagagtatattggggttggggtagatggtggtatttgttttggttggaggagttgggagggttggggaagggaygtgtgatttttttttygataaatttggaygagatgttaagtataatatagaggttggyggyggggtttttttttgttttyggtggattaatttattgtgggattttgggtaatttt

SEQ ID NO: 14769 - DNA, 201 bp, synthetic construct
  misc_feature 1..201: note = Description of Artificial Sequence: Synthetic polynucleotide
  source 1..201: mol_type = other DNA
ttaaaaaatatatayggtygggygyggtggtttaygtttgtaattttagtattttgggaggtygaggtgggyggattaygaggttaggagatygagattayggtgaaatttygtttttattaaaaaaatataaaaaattagtygggygtagtggygggygtttgtagttttagttgttygggaggttgaggtaggagaatg

SEQ ID NO: 14770 - DNA, 201 bp, synthetic construct
  misc_feature 1..201: note = Description of Artificial Sequence: Synthetic polynucleotide
  source 1..201: mol_type = other DNA
ayggttatatggtagggtttttgttgtttttatygtygttagtttagtygttygttattttttttagtggtgtttttgttattaatgggttttttataatygattyggtttaygggttgtagatgttgyggattattggygtggggaagtatgagtttatygattyggggtattttagaggtaagttttgttgttaygtgt

SEQ ID NO: 14771 - DNA, 279 bp, synthetic construct
  misc_feature 1..279: note = Description of Artificial Sequence: Synthetic polynucleotide
  source 1..279: mol_type = other DNA
gggtttgggttygttaggtgtagaataaggagaaaggggtagaggggaagagtygggtygaattttagygagggattyggttttttttggaggagaggatygtattygygttaggagtatggatttatttagggagtgtttgggyggagaagtagtttttgttttaggtttttygttgyggtatttaaagaggtygggyggtttagaggttygtaagttaygtttttttttaggtttygttttygtttggttattttttttgttgttagtttttttatt

SEQ ID NO: 14772 - DNA, 201 bp, synthetic construct
  misc_feature 1..201: note = Description of Artificial Sequence: Synthetic polynucleotide
  source 1..201: mol_type = other DNA
ttggttgttatgaaattataaattatgtttatagaaattttagtttgagaaagaatttagatttttttttttttttttttttttttttgagattgagtttygttttgtygtttaggttggagtgtagtgatgttatttyggtttattgygagttttgtttttygggtttaygttattttttggttttagtttttygtgtag

SEQ ID NO: 14773 - DNA, 201 bp, synthetic construct
  misc_feature 1..201: note = Description of Artificial Sequence: Synthetic polynucleotide
  source 1..201: mol_type = other DNA
tygggggyggggyggggyggggyggggyggggygggggggtggggttgaggtaggagaatggygtgaattygggaggyggagtttgtagttagtygagatygtgttattgtattttaattygggygatagygattttattttaaaaaataataataataaaaaagaataaagattttataggtattttttttatagtagag

SEQ ID NO: 14774 - DNA, 201 bp, synthetic construct
  misc_feature 1..201: note = Description of Artificial Sequence: Synthetic polynucleotide
  source 1..201: mol_type = other DNA
ggggttttatygtgttagttaggatggtttyggttttttgatgtygtgatttttttatttaggttttttaaagtgttgggattataggygtgagttatygygttyggtttagttttttatttttaataagtttttaggtgatgtttatgttggtagttttttgagattattatattttaagttttagggtgttagaaaaac

SEQ ID NO: 14775 - DNA, 201 bp, synthetic construct
  misc_feature 1..201: note = Description of Artificial Sequence: Synthetic polynucleotide
  source 1..201: mol_type = other DNA
tgttgttgttgtttttaagttggagttttgttttgttatttaggttgtagtgtagtggtaygatttyggtttattataatttyggtttttygggttttagygatttttttgttttagttatttaagtagttgggtttataggygtatgttattaygtttggttaatttttgtatttttaggagagataggtttttattatg

SEQ ID NO: 14776 - DNA, 201 bp, synthetic construct
  misc_feature 1..201: note = Description of Artificial Sequence: Synthetic polynucleotide
  source 1..201: mol_type = other DNA
aatygagttgtggaatggggtttygtggagtaggttgagtgtgtyggtygtggaygggtygtgggygggattttttagtgtgttattattgaggtattttygtttttttaygtgtttttgtttttttttttagaagtttaatattttygagaggatttaaaatatagagtgattagtttttatgtgtattttttggataaa

SEQ ID NO: 14777 - DNA, 201 bp, synthetic construct
  misc_feature 1..201: note = Description of Artificial Sequence: Synthetic polynucleotide
  source 1..201: mol_type = other DNA
aggggagaygaagaaggagggggtagttygtttaggaggttaggggggtattygtgttyggtttaggtttatygaygtagatattattgatatttaygttygygttgtgttttttgyggygtttgyggtygttaatgttatttattgggyggtataygttatgtgagtataggatttaggttattttygtttgttttggyg

SEQ ID NO: 14778 - DNA, 201 bp, synthetic construct
  misc_feature 1..201: note = Description of Artificial Sequence: Synthetic polynucleotide
  source 1..201: mol_type = other DNA
ttatatattttaygygttttgtttattaygaggtttgtattttttgggtagtaggtgtygygygttttygggtattttgtaggtggagtygtyggygtagygtagtatttygtgtttttgaygtyggtttyggatttagtygtygtygtatttgttatygtttttgggggatataygtayggagtttatttttaatagggg

SEQ ID NO: 14779 - DNA, 201 bp, synthetic construct
  misc_feature 1..201: note = Description of Artificial Sequence: Synthetic polynucleotide
  source 1..201: mol_type = other DNA
tttattataaatataaaaaattagtygggygtggtggygggtatttgtagttttagttattyggaaggttgaggtaggaaaatgatgtgaattygggaggyggagtttgtagtgagtygagatygygttgttgtatttaagtttgggygatagagygagatttygggttaaaaaaaataaaagaatatagggtatggtatt

SEQ ID NO: 14780 - DNA, 201 bp, synthetic construct
  misc_feature 1..201: note = Description of Artificial Sequence: Synthetic polynucleotide
  source 1..201: mol_type = other DNA
tagagtagttgggattataggygtttattgttaygttyggtttatttttttttgtatttttagtagagayggggttttatygtgttagttaggatggtttygattttttgaygtgatttattygtttyggttttttaaagtgttgggattataggygtgagttatygtgttyggtttatttatgtgttttttgggaagggg

SEQ ID NO: 14781 - DNA, 201 bp, synthetic construct
  misc_feature 1..201: note = Description of Artificial Sequence: Synthetic polynucleotide
  source 1..201: mol_type = other DNA
aggygttygttattaygttyggttaattttttgtatttttagtagagayggggttttattatgttagttaggatggtttygattttttgattttgtgattygtttatttygtttttttaaagtgttgggattataggygtgagttatygtgttyggttgtttttyggtatattttttatttttagtatgtggtttttatat

SEQ ID NO: 14782 - DNA, 203 bp, synthetic construct
  misc_feature 1..203: note = Description of Artificial Sequence: Synthetic polynucleotide
  source 1..203: mol_type = other DNA
gttggttatggaaggttatagtttygtagatggtgtyggtggagtttggggtagggtattttgagtttgggaaggtttggggtgaaggttyggaggttggygygtaggaggttaaagtagtagggaggtttggggagagttaggtggggttgtgttttttaygttgtaggtygtgtttatagatggtgaaagaygttgtggaa

SEQ ID NO: 14783 - DNA, 201 bp, synthetic construct
  misc_feature 1..201: note = Description of Artificial Sequence: Synthetic polynucleotide
  source 1..201: mol_type = other DNA
ttttaagtagttgggattataggygtttattattaygttyggttaatgtttttgtttttttagtagagayggggttttatygtgttagttaggatggtttygattttttgatttygtgattttttygtttyggttttttaaagtgttgggattatagtaattattygatggygtgagttatygygttyggttatgtatgat

SEQ ID NO: 14784 - DNA, 201 bp, synthetic construct
  misc_feature 1..201: note = Description of Artificial Sequence: Synthetic polynucleotide
  source 1..201: mol_type = other DNA
tttatttttgtgaaaatttttgtgtttgaaaattattgtaaaatatttggaattattattattatttatttttattttttgagayggagtttygttttgtygtttaggttggagtgtagtggygygatttyggtttattgtaagtttygtttttygggtttaygttatttttttgttttagtttttygagtagttgggatt

SEQ ID NO: 14785 - DNA, 201 bp, synthetic construct
  misc_feature 1..201: note = Description of Artificial Sequence: Synthetic polynucleotide
  source 1..201: mol_type = other DNA
ttggygagagataaggtatttagggaaagaagaaaaaagtttaggaagggattttagtttgttagattyggggtagaagtttttttyggaygagtttttayggagaaatttaaatattaggggtttyggaaggtyggaagtttttaagttgtttaggaaaagattaaagagatataaattataaaagttttgggattttta

SEQ ID NO: 14786 - DNA, 201 bp, synthetic construct
  misc_feature 1..201: note = Description of Artificial Sequence: Synthetic polynucleotide
  source 1..201: mol_type = other DNA
gttattgattttgagttttygtttttttatttataaaattgagattagggtygggtatggtggtttatttttgtaattttaatattttgggaggtygaggygggyggattaygaggtgaggagtttgagattagtttgattaatatggtgaaatttygtttttattaaaaatataaaaattagtygggygtggtggygygt

SEQ ID NO: 14787 - DNA, 201 bp, synthetic construct
  misc_feature 1..201: note = Description of Artificial Sequence: Synthetic polynucleotide
  source 1..201: mol_type = other DNA
gtatgtttattgtagaattatttataatagtaaagatatggatagatyggattaagaaaatgtggtgtatatatatatatgttatggaatattatgtagtygtaaaaagaataaaattyggttttttgtagtaatatggatgtagttggaggttattattyggagtgaattaatataggaatagaaaattaaatattgttt

SEQ ID NO: 14788 - DNA, 201 bp, synthetic construct
  misc_feature 1..201: note = Description of Artificial Sequence: Synthetic polynucleotide
  source 1..201: mol_type = other DNA
ttttagtttygtgatyggttttttgttttgtgttgatatttagtatttttttyggtttttgtttygaggggaaaataaaataggggtttttaggttttatygttggtttattttatygtagtaaatygatygagggttttttgttgygtttttgyggtttgttgttttatttagyggttttgatattyggtatttatttaa

SEQ ID NO: 14789 - DNA, 201 bp, synthetic construct
  misc_feature 1..201: note = Description of Artificial Sequence: Synthetic polynucleotide
  source 1..201: mol_type = other DNA
gygggyggattaygaggttagtagattgagattattttggttaatatggtgaaatttagtttttattaaaaatataaaaaattagtygggtgtggtggtaygygattgtagttttatttattggggaggttgaggtaggagaatygtttgaattygggaggyggaagttgtagtgagtygagatygygttattgtattttc

SEQ ID NO: 14790 - DNA, 201 bp, synthetic construct
  misc_feature 1..201: note = Description of Artificial Sequence: Synthetic polynucleotide
  source 1..201: mol_type = other DNA
ttttattttttagttagttttttgtgtagtgtttagggtttyggtagttaggatagagygagtaaaagaagatggatagtggatagggygtagtggtttaygtttgtaattttagygttttgggagagygaggygggtagattataaggttaagagattaagattattttggttaatatggtgaaattttgtttttattaa

SEQ ID NO: 14791 - DNA, 201 bp, synthetic construct
  misc_feature 1..201: note = Description of Artificial Sequence: Synthetic polynucleotide
  source 1..201: mol_type = other DNA
aaggtaggyggattayggggttaggagttygagattagtttggttaatttggtgaaaattygtttttattaaagatataaaaattagttgagtgttgtggygtaygtttgtaattttagttattggggaggttgaggtaagagaattatttgtaatygggaggyggaggatgtagttagygagatggygttattgtatttt

SEQ ID NO: 14792 - DNA, 201 bp, synthetic construct
  misc_feature 1..201: note = Description of Artificial Sequence: Synthetic polynucleotide
  source 1..201: mol_type = other DNA
atttagggggttgaggtaggagaatygtttgaattygggaggyggagtttgtagtgagtygagattgagttattgtatattttagtttgggtaataagagygagatttagttttagaaaaaataaataaataataaaataaaaagtaggtygggtgygatggtttatatttataatattagtattttgggaggtygaggtg

SEQ ID NO: 14793 - DNA, 3238 bp, synthetic construct
  misc_feature 1..3238: note = Description of Artificial Sequence: Synthetic polynucleotide
  source 1..3238: mol_type = other DNA
tagaaygttaggygtgaaaggtgaygttgaggtagtaygagggaaaaagtagtaggtagygatygttatayggaygatagtgttttttyggtagtttttgygttagattyggggttgtygtggagtttttgatttgaatttagggtgygtgtygygtttayggggggatattttaaagyggtaagaatgttttttgggaagggaataggaygttaggtttgaaaggggattttgaagtagtttaggaaaaaattttttayggattayggtgttttttyggtagtttttttgttaggttygagggggttgttgtgttttaggtttgtatttagggttttayggggggtattttaaagyggtaagtaggtttttaggggaaggggatagtaygttaggtttggagggggaygttgaggtagtttygggaataaagaggggatgttggggttttgttayggataatattgttttttygatagtatttgtggtgggtttgggagygttatggagtttttggtttgtatttaaggtgygtgtttygttttyggggggtattataaagyggtaagaaggttatygggggaagggtatgggaygttagggttgaaagggatagttgaggtagttyggggaaaaaygtggtaggttggggtygttttatggaygatagtgtttttttagtagtttttgygttaggttyggggtggtygtggagtttttggtttgtatygagggtgygggtygtatttatgggggtattttaaagtggtaagaaggtygtygggygaaygttatagaaggttaggttttaatggggatgttgaggtagtatagagagaaaagyggttagtygggttttttttayggatgatagtgtttttttggtagtttttgygttgggttyggggggatygtggagtttttattttgtatttagggtgygtgtttygtttatgggaggtattttaaagyggtaagtaggtttttgggggaaggggatagtattttagatttgaagggggattttgaggtagttygtggaaaaaaayggygaygttgagttttttttataaaygatagtgtttttttggtagttttttygttgggttagggtggttttggagttygtggtttgtatttagggtgygtgtttygtttaagggggtattttaaagyggtaagtagattttygggggaagggagagtaygttaggtttgaaggggaggttgaggyggtttyggggtaaaagtggtgaagttggggtttttttayggatgatatygtttttttggtagtttttgtagtgggtttagaggtgtygtggagtttttggtttgtttttaggttgtgtgtttygtttaygagtggtattataaagtagtaagaaggtttttaggggaagggtataggattttagggttgaaaggtagagttgaggtagatyggtgttattttaaggataatagtgttttgttyggtagtttttgtatygggtttggggtggttgtggagtttttggtttgtattyggggtgygtgtygtgtttaygatgggtatygtaatgyggtaagaagttttygagtggaagggaataggaygtygagtttgaaaggggaygttgaggtagttyggggaaaaaatttttattgagaatagtgttttttyggtagtttttgagtgggatttaggtggayggtggagtttttggtttggatttagggtgtttgttttgtttayggggtgtaygtgaaagtggtaatagggttttygggggaaggggataatatgttaggtttgaagagggaygttgggttagttagaggaaaatagyggttaggttgtggtygttttatagattatagtgttttttyggtagtttttgagtttggtttaggygggggggtttggagtttttgttttgtaatagagtgygtgtttygtttaagtgtgtaygygaaagttgtaagaagggtttygggggaagggaataggatgttaggtttgaaaggggattttgaggtagtttagggaaaaattttttayggaggatagtgatttttygatattttttgygtttggttttgggggttttggagtttttggtttatatttagggtgygtgtttygtttaygggtggtattttaaagtagtaagaaagtttyggggggggaagaataggatgttagatttgaaaggggaygttgaggtagtttaggaaaaaaaggggygaggttggggtttttttayggatgatagtgttttttttatagtttttatgttagtttygggagggtygyggagtttttgttttgtatataatgtgygtgtttygtttayggggggtattttaaagtggtaagaagtttttygygggaaggtaataggaygttaggtttgaatggggaygtttaggtagtttggagaaaaaagtagygaggttggggtgattttaygaatgatagtgttttatyggtagtttttttgtygggtatgygggggttgttgattttttggtttgtatttagggtgagtgttttgtttayggygggtattataaagtagtaagaaggttttygggggaaagggatagtaygttagttttgaagggggaagttgaggtagtttyggggaaaaaaagyggggatgttggggtttttttayggaygatattgtttttttagtagtttttgtagtgggttygggagygttttggagtttttgttttgtatttygggtgygtgttttatttayggggagtattataaagyggtaagaaggttattgggggaagggtataggaygttagggttgaaggggatagtggagatagtttaaggaaaaaagtggygggatggtgtygttttaaggatggttatttttgygtygggttagggatggtygyggagtttttggtttgtatttaggttgtgtgtttygtttatagggggtattttaaagtagtaygaaggtttttaggggaagggaagaggaygttaggtttggaaggtgaygttgaggtagtagggggtaaaaagtggygggtygggtttttttayggatgatagtgttttttyggaagtygttgygtagggttyggygtgtttgtggagtttttggtttgtatttagaatygtgyggygtttaygaygggtattttaaagyggtaagatatttttygttggaagggaataggatgttaggtttgaaaggagaagttgagttagttyggggaaaaa

SEQ ID NO: 14794 - DNA, 201 bp, synthetic construct
  misc_feature 1..201: note = Description of Artificial Sequence: Synthetic polynucleotide
  source 1..201: mol_type = other DNA
ttaaggttattattttaaagtgttttagaaaataatatatagaaggtygggygyggtggtttaygtttgtaattttagtattttgggaggtygaggggggyggattaygaggttaggagatygagattattttggttaatayggtgaaatttygtttttattaaaaatatatatatataaaattagtygggygaggtggta

SEQ ID NO: 14795 - DNA, 201 bp, synthetic construct
  misc_feature 1..201: note = Description of Artificial Sequence: Synthetic polynucleotide
  source 1..201: mol_type = other DNA
ttattatttatttattattttgtttgtaatttgggttattatttattagtaatttgatgattaataygttttattttagtaggtgtgtaaggtgygggggyggatataaagattgyggttttyggagaggayggttagggggtygtttttgtaagtgttttttaaaataattggttatygttttygagtgtttgggygtyg

SEQ ID NO: 14796 - DNA, 201 bp, synthetic construct
  misc_feature 1..201: note = Description of Artificial Sequence: Synthetic polynucleotide
  source 1..201: mol_type = other DNA
ayggtgattagaaatgtattaaattttgaatgtataaaagagagagttttaatatgaaatagtaattttttgagaaygaagatttygtagtgtyggtgttygttgggtygtgtaggtttyggtygttttaygttygtgttygtttttatygtgattttttygttttyggtaygtttagggttaattttygggtttattgta

SEQ ID NO: 14797 - DNA, 201 bp, synthetic construct
  misc_feature 1..201: note = Description of Artificial Sequence: Synthetic polynucleotide
  source 1..201: mol_type = other DNA
tttggggattattttgtttttttgttttgattttttttttttttttttttttttttttgagayggagtttygttttgtygtttaggttggagtgtagtggygygatttyggtttattgtaagttttatttttygggtttatattatttttttgttttagtttttygagtagttgggattataagtattygttattaygttc

SEQ ID NO: 14798 - DNA, 201 bp, synthetic construct
  misc_feature 1..201: note = Description of Artificial Sequence: Synthetic polynucleotide
  source 1..201: mol_type = other DNA
ttttygggayggggggatttttaggtattttygggttttgagttgggtygttagggtygttygttttttgtygttttttttgggtygagtttygttttygygttttgtagtggagtagtygtttttaaaggtgtaygtgattagggtgyggtygggatagygggtattttttygggttttagygtygygtgygttttggtc

SEQ ID NO: 14799 - DNA, 201 bp, synthetic construct
  misc_feature 1..201: note = Description of Artificial Sequence: Synthetic polynucleotide
  source 1..201: mol_type = other DNA
yggygttyggtatgaaattttttttttttttttgagatagagtttygtttttgygtttaatttggagtgaagtggtaygattttggtttatggtaattttygtttygtaggattaagttattattttgatttagtttttygagtagttgggattataggtatttattattatggtyggttaatttttgttttttgtttttt

SEQ ID NO: 14800 - DNA, 201 bp, synthetic construct
  misc_feature 1..201: note = Description of Artificial Sequence: Synthetic polynucleotide
  source 1..201: mol_type = other DNA
aagtagttttttaaaattttaaaaagtaagtatagttttaggaaggagggaggttagtgaaattaaatttttgtygataagtttaaagtaattggtaagaygttgggaaattagatattgaaatattygtttttaatttttaatttgttattatttgaaataaagttattagggatagtygggygyggtggtttaygtttg

SEQ ID NO: 14801 - DNA, 201 bp, synthetic construct
  misc_feature 1..201: note = Description of Artificial Sequence: Synthetic polynucleotide
  source 1..201: mol_type = other DNA
atttattgaagaagttgaagtgtgaagtgtgaaattgaagaattttgaaatgtattgagtagtgaaaagattatgtatataaaaataggttggtygggtgyggaggtaggtagattatttgaggttaggaggygygatttyggtttattgtaagttttatttttygygtttaygttatttttttgttttagttttyggagt

SEQ ID NO: 14802 - DNA, 201 bp, synthetic construct
  misc_feature 1..201: note = Description of Artificial Sequence: Synthetic polynucleotide
  source 1..201: mol_type = other DNA
attttgggaggttaaggtaggyggttgggaggtgtaggttgtagtgagtygagattaygttattgtattttagtttgggtattattgagtattgagtgaaygagatttygtttgtaatttyggtatttygggaggtygaggttggyggattattygyggttaggggttggagatyggttyggttaatatagygaaattttg

SEQ ID NO: 14803 - DNA, 201 bp, synthetic construct
  misc_feature 1..201: note = Description of Artificial Sequence: Synthetic polynucleotide
  source 1..201: mol_type = other DNA
gtggygtaatttyggtttattgtaagtttygttttttaggtttatgttatttttttgttttagttttttgagtagttggtattataggygtygattattaygttyggttaattttttgtattttttgatagagayggggttttatygtgttatttaggatggtttygatattttgattttgtgattygtttgtttyggttt

SEQ ID NO: 14804 - DNA, 201 bp, synthetic construct
  misc_feature 1..201: note = Description of Artificial Sequence: Synthetic polynucleotide
  source 1..201: mol_type = other DNA
gagtgtagtggtgtgattttggtttattgtaagttttgttttttgggattatgttatttttttgttttagttttttgagtggttgggatttataggtgtttgttaatatgtttggttaattttttgtatttttagtagagatggggttttattgtgttagttaggatggttttgatattttgattttgtgatttgtttatt

SEQ ID NO: 14805 - DNA, 208 bp, synthetic construct
  misc_feature 1..208: note = Description of Artificial Sequence: Synthetic polynucleotide
  source 1..208: mol_type = other DNA
ttggttaatatgatgaaattttgtttttattaaaaatataaaaaattagttgggtgtggtggtgggtgtttgtagttttagttatttgggagattgaggttgaatggtgtgaatttgggaggtggagtttgtagtgagttgagattatattattgtattttagtttgggtgatagagtgagattttgttttaaaaataaataaataaa

SEQ ID NO: 14806 - DNA, 201 bp, synthetic construct
  misc_feature 1..201: note = Description of Artificial Sequence: Synthetic polynucleotide
  source 1..201: mol_type = other DNA
atatggtgaaattttgtttttattaaagtataaaaaattagttgggtatagtggtataggtttttagttttagttatttgggaggttgaggtaggagaattgtttgaatttgggaggtggagggtgtagtgagttattgtatgttagtttgggtaatagagttagattttgttttaaaaaaaaaaaaaaaaaagaaagaaa

SEQ ID NO: 14807 - DNA, 201 bp, synthetic construct
  misc_feature 1..201: note = Description of Artificial Sequence: Synthetic polynucleotide
  source 1..201: mol_type = other DNA
gttgaggtgggtgaattatttgaggttaggagtttaagattagtttggttaatatggtgaaattttatttttattaaaaatataaaaattaattgggtattgtggtgtgtgtttgtaattttagttatttgggagattgaggtaggagaattgtttgaattttgttggtagaggttgtaatgagttgagattgtattatgg

SEQ ID NO: 14808 - DNA, 201 bp, synthetic construct
  misc_feature 1..201: note = Description of Artificial Sequence: Synthetic polynucleotide
  source 1..201: mol_type = other DNA
ttttggaggttatatttggataggagttggtttttaattttagttaagagtttatagaggggtttttgtttaattgtatggagtttatggttgataggtgtggtggtaggatgggatgggattggatgggttgtgtatttgtttttatattagtattatattgttttgattattttagtttgtaagatgtttgaaatttat

SEQ ID NO: 14809 - DNA, 201 bp, synthetic construct
  misc_feature 1..201: note = Description of Artificial Sequence: Synthetic polynucleotide
  source 1..201: mol_type = other DNA
aaaattataataaagtttttgtttaattatagattttgatttattggttaggtaggttgtttggtttttgatttgtatttagagggtttttggattttggtgttgtgtgggttagtgttttgggagttggggattggtattggttgtgtttggttgttgagtgtgttttattaattattattttgtttttttaggttaatg

SEQ ID NO: 14810 - DNA, 201 bp, synthetic construct
  misc_feature 1..201: note = Description of Artificial Sequence: Synthetic polynucleotide
  source 1..201: mol_type = other DNA
gaggttttttttatttaggtaaagaagaaagaaggatggttttaggagtttatataatatggttaaaggttgggtagtgtgtagtagaatgtaagatgagtggttaggttatagggtgagattatgaaggatttttttttggttttaaatgttttttaagagtgtttttttattatttttttttttattttttaagaatag

SEQ ID NO: 14811 - DNA, 201 bp, synthetic construct
  misc_feature 1..201: note = Description of Artificial Sequence: Synthetic polynucleotide
  source 1..201: mol_type = other DNA
tttttaagtagttgggattataggtgtttgttattatgtttggttaatttttaatatttttagtagagatggggttttattgtgttagttaggatggttttgattttttgattttgtgatttgtttgttttggttttttaaagtgttgggattataggtttgagttattgtgtttggtttttagtttttatatttgttaaa

SEQ ID NO: 14812 - DNA, 201 bp, synthetic construct
  misc_feature 1..201: note = Description of Artificial Sequence: Synthetic polynucleotide
  source 1..201: mol_type = other DNA
ttaatataaaaattagttgttttagttgggtgtggtggtttaagtttgtaattttagtattttgggaggttgaggtgggtggattatgaggttaggagattgagattattttggttaatatggtgaaattttgtttttattaaaaatatataaaaaatgagttgggtgtggtggtaggtgtttgtagttttagttatttag

SEQ ID NO: 14813 - DNA, 201 bp, synthetic construct
  misc_feature 1..201: note = Description of Artificial Sequence: Synthetic polynucleotide
  source 1..201: mol_type = other DNA
taaattttgttgttgtttattttatgggtttatattgtttttatgagttgtaatatttattgtaaaggtttgtaggtttatttttgagttggtaagattatgaatttattagaagaaattttgaatatatttgaatattagaaggaataaattttggatatgttatttttaagaattgtaatatttattgtaagggtttgt

SEQ ID NO: 14814 - DNA, 201 bp, synthetic construct
  misc_feature 1..201: note = Description of Artificial Sequence: Synthetic polynucleotide
  source 1..201: mol_type = other DNA
ttttgttttagtttttttagtagttgggattataggtgtttgttattgtgtttggttaattttttgtatttttaatagaaatggggttttattgtggttttgattttttgattttgtgatttgttgtttattttggttttttaaagtgttgggattataggtgtgagttattgtgtttggtttttttttttatttttaata

SEQ ID NO: 14815 - DNA, 201 bp, synthetic construct
  misc_feature 1..201: note = Description of Artificial Sequence: Synthetic polynucleotide
  source 1..201: mol_type = other DNA
ggggttttattgtgttagttaggatggttttgattttttgattttgtaatatgtttgttttggttttttaaaatgttgggattataggtgtgagttattgtgtttagttggttttataggtatttatgtatattaatagtttttttttgagatggagttttgttttatttttaggttggagtgtaatggtgttgttttgat

SEQ ID NO: 14816 - DNA, 235 bp, synthetic construct
  misc_feature 1..235: note = Description of Artificial Sequence: Synthetic polynucleotide
  source 1..235: mol_type = other DNA
ttaattttttaggtgttgtttgttatttttttttttgattaggaaagggaattttttgattttttgtgtttttggagtgaggtaatgttttgttttgttttggtttatgtagggtgtgtgtatttattgatttgtgtttattgtttggtattttttagtgagatgaatttggtattttagatggaaatgtagaaattatttattttttgtgttgttttttttgggagttgtagat

SEQ ID NO: 14817 - DNA, 201 bp, synthetic construct
  misc_feature 1..201: note = Description of Artificial Sequence: Synthetic polynucleotide
  source 1..201: mol_type = other DNA
ggtagataaagatatatgattagggttggttgtggtgatttatgtttgtaattttagtattttgggaggttaaggtgaatggattatgaagttaggagattgagattattttggttaatatggtgaaattttgtttttattaaaaatataaaaaattagttgagtgtggtggtgggtgtttgtagtgttagttatttgggg

SEQ ID NO: 14818 - DNA, 201 bp, synthetic construct
  misc_feature 1..201: note = Description of Artificial Sequence: Synthetic polynucleotide
  source 1..201: mol_type = other DNA
taggtgatttttgtatttttatttgaggtattgggtttattttattagggagtgttagatagtgggtgtgggttagtgggtgtgtgtattatgtgtaagttgaagtagggtgaggtattgttttatttgggaagtgtaaggggatagggagttttttttttgagttaaaaaaaggggtgatagatgtatttggataattag

SEQ ID NO: 14819 - DNA, 201 bp, synthetic construct
  misc_feature 1..201: note = Description of Artificial Sequence: Synthetic polynucleotide
  source 1..201: mol_type = other DNA
agagatagaagttgttggagggtgagaggaatgtattagtggaagaagatagaagtggttggttatggagagtatgttagtagaagaatatatttatagatgttggtttgtttgtgggttttttggtaggttattgattggtgggatgaggtggagtttgttttgggtagtaggaggatagtttgggtatttagtggttta

SEQ ID NO: 14820 - DNA, 201 bp, synthetic construct
  misc_feature 1..201: note = Description of Artificial Sequence: Synthetic polynucleotide
  source 1..201: mol_type = other DNA
tttatagaggtaggtaggtttttttgagttgtggtgggttttatttagtttgagttttttggttgttttgtttatttaagtgagtttgggtaatggtgggtgttttttttttagttttgttgttgttttgtagtttgattttagattgttgtgttagtaattagtaagatttggtgggtataggattttttgagttaggtg

SEQ ID NO: 14821 - DNA, 201 bp, synthetic construct
  misc_feature 1..201: note = Description of Artificial Sequence: Synthetic polynucleotide
  source 1..201: mol_type = other DNA
gtttttttttttagttaaagaaaggggtgatagaaggtatttggaaaattgggttatttttattagaatattgtgtttttttgatgggtttaaaaaatggtgtatttggagattatatttggtatttggtttagagggttttatgtttatagagttttgttgattgttagtatagtagtttaagattaaattgtaaggtgg

SEQ ID NO: 14822 - DNA, 201 bp, synthetic construct
  misc_feature 1..201: note = Description of Artificial Sequence: Synthetic polynucleotide
  source 1..201: mol_type = other DNA
tgtttgttatttttttttttgatttggaaagggaattttttgattttttgtgttttttaggtgaggtaatgttttgttttgttttggtttgtgtatggtgtgtgtatttattggtttgtgtttattgtttggtatttttttagtgagatgaatttggtattttagatggaaatgtagaaattatttgttttttgtgttgtt

SEQ ID NO: 14823 - DNA, 201 bp, synthetic construct
  misc_feature 1..201: note = Description of Artificial Sequence: Synthetic polynucleotide
  source 1..201: mol_type = other DNA
gtaagtaaggggtgtgttttagttttgtttgtgttagagtttttttatttttattatttggtaggtttagtgtttgggaataatgatgtatgtggataagtggagggtgagtaaggtgaagaggagttttattgagtaatagaatagtttagaggagatttgtggtgggtagtttttttttgtagttagggtgttttgatg

SEQ ID NO: 14824 - DNA, 201 bp, synthetic construct
  misc_feature 1..201: note = Description of Artificial Sequence: Synthetic polynucleotide
  source 1..201: mol_type = other DNA
ggtagattatttgaggttaggagtttgagattagtttggttaatatggtgaaattttgtttttattaaaaatataaatattagttgggtgtggtggtggttgtttgtaattttagttatttgggaggttgaggtaggagaattgttggattttgggaggtagatgttgtagtgagttaagattatgttattgtattttagt

SEQ ID NO: 14825 - DNA, 201 bp, synthetic construct
  misc_feature 1..201: note = Description of Artificial Sequence: Synthetic polynucleotide
  source 1..201: mol_type = other DNA
ttgtagtatatattattatttttttagtatattattattttttaatttggtttttattgttaataaagttgttggttgtaggaatgagagagtggtagaatgatatttttgttttattttttgggattttttagttgttggtggttttaagtttttaggagttatggtgttttttttttttagatgttagtgttaatagtg

SEQ ID NO: 14826 - DNA, 201 bp, synthetic construct
  misc_feature 1..201: note = Description of Artificial Sequence: Synthetic polynucleotide
  source 1..201: mol_type = other DNA
ggttagaagatggtgagtggaaagtttgggtgtgtggagagattttaagaaggggttgtttagttgtgaattttgtatttgttgtttgtgttttatttggtggttttgaaattaggtttttatttggatttttgtgagttgtatatttttggttagttatttttgttttagagggtttagatattggtagtgttggaagac

SEQ ID NO: 14827 - DNA, 207 bp, synthetic construct
  misc_feature 1..207: note = Description of Artificial Sequence: Synthetic polynucleotide
  source 1..207: mol_type = other DNA
gtttttgtgatttttgtagttagtgaattagtatatttttggggttgaagttatgtgttaggtatgttagtgttattagtttgtttagggttagtttttttgatggtggtggtagtaggtggattttgggttggaatgtgttttttggagggtagagagttaggttagggggttgggtaggggatgagagagtttttttgttttggt

SEQ ID NO: 14828 - DNA, 201 bp, synthetic construct
  misc_feature 1..201: note = Description of Artificial Sequence: Synthetic polynucleotide
  source 1..201: mol_type = other DNA
tttatggggtagttagaagggagatggtttttttttggagttggggtgtttggtagttttggtttttttttgattgtttaggttaatttttgtttttttttgttggtttatggtttattggtttttgggtgtttgttagtgtgtttttttgttggggtgtttttatggatgattagtgtttgtgttttttttttttgatgt

SEQ ID NO: 14829 - DNA, 201 bp, synthetic construct
  misc_feature 1..201: note = Description of Artificial Sequence: Synthetic polynucleotide
  source 1..201: mol_type = other DNA
gaagatgggtgatttttgtatttttatttgaggtattggttttattttattagggagtgttagatagtgggtgtaggttagtgggtgtgtgtattgtgtgtgaagtagggtgaggtattgttttatttgggaagtgtaaggggttagggagttttttttttgagttaaagaaaggggtgatggatgtatttggaaaattgg

SEQ ID NO: 14830 - DNA, 201 bp, synthetic construct
  misc_feature 1..201: note = Description of Artificial Sequence: Synthetic polynucleotide
  source 1..201: mol_type = other DNA
ggggtgtggttttttggagggaattagtgtggagatgtttgtgtgtttggggtgtggttttttggagggagttagtgtggagatgtttgtgtgtttggggtgtggtttattagagggagttagtgtggagatgtttgtgtgtttggggtgtggttttttggagggaattagtgtggagatgttggtgtgtttggggtgtgg

SEQ ID NO: 14831 - DNA, 201 bp, synthetic construct
  misc_feature 1..201: note = Description of Artificial Sequence: Synthetic polynucleotide
  source 1..201: mol_type = other DNA
gatgttttttattttttagatggggtggtggtggggtagagatattttttagtttttagatggggttgtggtttggtagaggtgttttttatattttagatgatgggtggttgggtagagatgttttttattttttagatgggatgatggttaggaagaggtgttttttattttttagattgggtggttgggtagaggggt

SEQ ID NO: 14832 - DNA, 201 bp, synthetic construct
  misc_feature 1..201: note = Description of Artificial Sequence: Synthetic polynucleotide
  source 1..201: mol_type = other DNA
gagtatagtgttggtgggttggtattgttgggggatttggtgtattttttatagttgttgttttgggtggtaagttttttattgtttggggttggtggggtggttagttgtttggagtgtggggtttgttaaggttatgtttatttagaatttgttttggtttattgtgagtagttttagtttttgttttgtgtttttttt

SEQ ID NO: 14833 - DNA, 201 bp, synthetic construct
  misc_feature 1..201: note = Description of Artificial Sequence: Synthetic polynucleotide
  source 1..201: mol_type = other DNA
tttttgagtagttggggttataggtgtttattattatgtttggttaattttttgtatttttagtagagatggggttttattgtgttagttaggatggttttgattttttgatgttgtgatttattgttttggttttttgaaatgttgggattataggtttgagttattgtatttggttatatttatttatttttaattaga

SEQ ID NO: 14834 - DNA, 201 bp, synthetic construct
  misc_feature 1..201: note = Description of Artificial Sequence: Synthetic polynucleotide
  source 1..201: mol_type = other DNA
ttttttttttttttgattggttttgtttttattgttggttttgtttttattgttggtttgggttttatttatgttggagttgttttatttaaggagattgtgtagttggaaagttatatgtgtgagtttagaggtgggttttggttgtagatttgttatggtttttgaagtttttgtgtgtttaggggtgttttttggttg

SEQ ID NO: 14835 - DNA, 201 bp, synthetic construct
  misc_feature 1..201: note = Description of Artificial Sequence: Synthetic polynucleotide
  source 1..201: mol_type = other DNA
gttagttagttattttgagatggagttttgttttgttgtttaggttgtagtgtagaattgtttttttggtttattgtaatttttattttttgggtttaagtgataattttgttttagttttttaagtagttggaattatagatgtgtattattatgtttaattaatttttgtatttttagtagagatggggttttgttata

SEQ ID NO: 14836 - DNA, 201 bp, synthetic construct
  misc_feature 1..201: note = Description of Artificial Sequence: Synthetic polynucleotide
  source 1..201: mol_type = other DNA
gtggttttttttgatttagattgtttttaaatattgaatgttgaattgggttgggtgtggtggtttttatttgttattttagtattttgggaggttgaggtgggtggattatgaggttaggagattgagattattttggttaatatggtgaaattttgtttttattaaaaatataaaaaaaaaaaattagttgggtgtgat

SEQ ID NO: 14837 - DNA, 201 bp, synthetic construct
  misc_feature 1..201: note = Description of Artificial Sequence: Synthetic polynucleotide
  source 1..201: mol_type = other DNA
ttatttttgttttttattttgggggttttatgattttggagtttttatgttttggtatagagtttgtttttttgggattgggttttggttgagtagatattgtttagttgttttttgattagtgttttttgttttgtgtttggttggtattggtggtttgttgagtttagtttggtattttgttggtattggtggtttgtt

SEQ ID NO: 14838 - DNA, 380 bp, synthetic construct
  misc_feature 1..380: note = Description of Artificial Sequence: Synthetic polynucleotide
  source 1..380: mol_type = other DNA
ttttattaaaatataaaaaattggttgggggtggtggtatgtgtttgtagttttagttatatgggaggttgaagtaggggaattgtttgaatttgggaggtggagattgtagtgagttgagattgtgttattgtattttaatggtattttagtttgatgatagagtgagattttgttttaaaaataataataaataaataaataaataaataaaaattagttgggtgtggtggtgtgtgtttgtagttttagttatttgggagattgaggtaggagaattgtgggaatttgggaggtggaggttgtagtgagttgagattgtgttattgttttgtagtatggagatagagttagattttgtttaaaaaaaaaaaaaaaaa

SEQ ID NO: 14839 - DNA, 201 bp, synthetic construct
  misc_feature 1..201: note = Description of Artificial Sequence: Synthetic polynucleotide
  source 1..201: mol_type = other DNA
aggtgggtggattatgaggttaggagattgagattattttggttaatatggtgaaattttgtttttattaaaaatataaaaaattagttgggtgtggtggtgggtatttttagttttagttatttgggaggttgaggtaggagaatggtgtgaatttgggaggtggagtttgtagtgagttgagattgtgttattgtattt

SEQ ID NO: 14840 - DNA, 201 bp, synthetic construct
  misc_feature 1..201: note = Description of Artificial Sequence: Synthetic polynucleotide
  source 1..201: mol_type = other DNA
aaaaattagtttggtgtggtggtatgtgtttgtaattttaattatttgggaggttgtggtaggtgaattatttgaagttgggaggtgaaggttgtagtaatgttgttttttgtattggatgaagtgttttttattaaatttttttattggagagggtgggatttgtgggttttttgggtggtttgattttgatattttgtg

SEQ ID NO: 14841 - DNA, 201 bp, synthetic construct
  misc_feature 1..201: note = Description of Artificial Sequence: Synthetic polynucleotide
  source 1..201: mol_type = other DNA
atggtgaattgtggtgattgtgatgtgtttttttattttttttttggtggattttttttatttgttttttttttaatttttaataagtttttattattgatgatgtgagatgatgatggtatgggattttttattttgttagggttaatgaattttatattatgagttgtatgaggtatgagggagtttttaagggaggaa

SEQ ID NO: 14842 - DNA, 201 bp, synthetic construct
  misc_feature 1..201: note = Description of Artificial Sequence: Synthetic polynucleotide
  source 1..201: mol_type = other DNA
gatgtagaagatgggtgatttttgtatttttatttgaggtattgggtttattttattagggagtgttagatagtgggtataggttagtgggtgtgtatattgtgtgtgagttgaagtagggtgaggtattgttttatttgggaagtgtaaggggttagggagttttttttttgagttaaaggggtgatggatgtatttgga

SEQ ID NO: 14843 - DNA, 201 bp, synthetic construct
  misc_feature 1..201: note = Description of Artificial Sequence: Synthetic polynucleotide
  source 1..201: mol_type = other DNA
taaataattagggataaagagtattatattgttgaatttattttatttttaattttttttttaaattttttataaaaaattagttgggtgtggtggtgggtgtttgtagttttagttatttagagattgaggtaggagaatggtgtgaatttgggaggaggagtttgtagtaagtggagattgtgttattgtattatagtt

SEQ ID NO: 14844 - DNA, 201 bp, synthetic construct
  misc_feature 1..201: note = Description of Artificial Sequence: Synthetic polynucleotide
  source 1..201: mol_type = other DNA
atttttgtgatttatattttatttgtatattttttttttttttgaaaatttttaataaaaatttgttggttttatggtttaggggtattatagaatttattgatatgtgatgttttttttggatgtttggttttaaaattttttttttttgtattttgtttttttattttttaatttggttgatgtttagggaaaatagaa

SEQ ID NO: 14845 - DNA, 201 bp, synthetic construct
  misc_feature 1..201: note = Description of Artificial Sequence: Synthetic polynucleotide
  source 1..201: mol_type = other DNA
ttttggtgaatttttattgttataattttaaaaatttggtttagggaggagtttattttttattttttatataggtgatatatgtagaaatataatttgttgttgtgtttgtgtggttaggattttttttttatatgtaatgatttagttgattagtttaagatatgtttggtttttatgtttgtttgtaggggtattgtt

SEQ ID NO: 14846 - DNA, 201 bp, synthetic construct
  misc_feature 1..201: note = Description of Artificial Sequence: Synthetic polynucleotide
  source 1..201: mol_type = other DNA
ttgggagtagaggttttttggaaggtattatttttagagtgtgtttttgagtaattttgaggatgggttttgggttattattgtgtgttggaaatagtagtgtttaggttgttggaggaggttggtttttttggtaggttttggttgtgtttagagttttgtgggttttggagataaggttttggtttgaggtttttgggg

SEQ ID NO: 14847 - DNA, 201 bp, synthetic construct
  misc_feature 1..201: note = Description of Artificial Sequence: Synthetic polynucleotide
  source 1..201: mol_type = other DNA
gtttgagtaggataaggattttagagtttaagagaattttgatgattagagaagggtttttgaggttattggggatgtatggtttgtattttggtttttgtgggataatggaggtttttttttttttttgtgtttgggtttgggtttttgtagatagatttttatatttagaggtgagaaattagatataattagatattt

SEQ ID NO: 14848 - DNA, 201 bp, synthetic construct
  misc_feature 1..201: note = Description of Artificial Sequence: Synthetic polynucleotide
  source 1..201: mol_type = other DNA
ttatatgttaggttataaaataagtttttagaaatttaagaagattgaaattatattaattattttttaaaaaaaataggtggttgggtgtggtggtttatgtttgtaattttagtattttgggaggttgagatgggtggattatgaggttaggagattgagattattttggttaatatggtgaaattttgtttttattaa

SEQ ID NO: 14849 - DNA, 568 bp, synthetic construct
  misc_feature 1..568: note = Description of Artificial Sequence: Synthetic polynucleotide
  source 1..568: mol_type = other DNA
ttagtatatagatataaaaatgagaggtgatagtgtgttggtagtttttatagtttttgtttttttttggtatttttttggttttggtgtttattttggttgtgtttgaggagttttttagtttgttgttgtattgtgggagtttttttttgggttggataaggttggagttggtttttttagtttgtgggtaggtgtggagagagaggtgtgggtgggaattgtggttgtaggttgtgtttgtgggttagtttgagttttgggtgggtgtgggtttggtaagttttgtatttggagtggttagttggtttgggtagtgaggagtttagtatttgggttagtagttgttgtgtttgattttttgttgggttttagttgtttttttgttgggtagggtttgggatttgtagttttttatgtttgagtttttatttttgttgtgtgtttttgtgtagtttaagtttttttgatgagtgttaatttttgttttatggtgtttagttttattgattgtttaagggttgaggagtgtgggtatatggtgttggattggtaggtagttttattt

SEQ ID NO: 14850 - DNA, 201 bp, synthetic construct
  misc_feature 1..201: note = Description of Artificial Sequence: Synthetic polynucleotide
  source 1..201: mol_type = other DNA
tttattaaaaatataaaaaattagttgggtattatggtgggtgtttgtagttttagttatttgggaggttgaggtaggagaatggtgtgaatttgggaggtggagtttgtagtgagtggagattgtgttgttgtattttagtttgggtgatagagtatgagtttgttttaaaaaaagaaaaaaaagaaagaaaagaaaaga

SEQ ID NO: 14851 - DNA, 201 bp, synthetic construct
  misc_feature 1..201: note = Description of Artificial Sequence: Synthetic polynucleotide
  source 1..201: mol_type = other DNA
gggttggttaaggttggagttggttttttttgtttgtggggaggtgtggagggagaggtgtaggtgggaattagggttgtgtggggtgtttgtgggtaagtgtgagttttgggtgggagtgggtttggtaaatttattttagggtgttttgttttttataaagaaaattttttttggggtttttatgggtttttttgggat

SEQ ID NO: 14852 - DNA, 201 bp, synthetic construct
  misc_feature 1..201: note = Description of Artificial Sequence: Synthetic polynucleotide
  source 1..201: mol_type = other DNA
ttttaagtagttgggattataggtatttgttattatgtttggttaattttttgtattttttagtatagatggggttttattgtgttaattaggatggttttgattttttgattttgtgatttgtttgttttggttttttaaagtgttgggattataggtgtgagttattgtgtttagttatatattatattttttttattt

SEQ ID NO: 14853 - DNA, 201 bp, synthetic construct
  misc_feature 1..201: note = Description of Artificial Sequence: Synthetic polynucleotide
  source 1..201: mol_type = other DNA
aattatggggtgaattttgttatggggatatgtatttggggggaaggttgtgatgggaggggtatttgggttaaatatgggtggttgttagtgaagagtttgtaagatagagtaggagttagggggaatagggagggaggggtattttttttttttttttttgagatggagttttattttgttttttaggttggagtgtag

SEQ ID NO: 14854 - DNA, 201 bp, synthetic construct
  misc_feature 1..201: note = Description of Artificial Sequence: Synthetic polynucleotide
  source 1..201: mol_type = other DNA
tataggagtataaaagggttggtggttttgtttgggtatattgtttgtttttttatttatttgtgtattttagtttattatttttgagttgggtgtagtatgtggtttagagaatgggaagggatttatgagtgtttgatatatataattattgttgttggtgattatttttatttatgagtggtgtatggatggggttag

SEQ ID NO: 14855 - DNA, 201 bp, synthetic construct
  misc_feature 1..201: note = Description of Artificial Sequence: Synthetic polynucleotide
  source 1..201: mol_type = other DNA
taaaggtttgtttttgtatttaagtatttgagtttttaagagttagtttttgggtttttttggagtaaggttttgtttggttttatgtatttgttttgtttgttgtgatggtgagtttgttgttgggtttgtttttgttaatttggtttttggtgtatatgtggatgttgtaggtggaggaagggtggatattaatgatgg

SEQ ID NO: 14856 - DNA, 201 bp, synthetic construct
  misc_feature 1..201: note = Description of Artificial Sequence: Synthetic polynucleotide
  source 1..201: mol_type = other DNA
tttggttggttttgggatttgttttttggtggttaagtagtggttatgaaagtttagttgttgttatatttttgaggaattggtgtatttttgtttatagtggtagttgggggtatttatgtggtttggggttgttttgatttggtagtgtatgggggttgttgtttgggttttttagtgtgttatttgtgtgttttttgt

SEQ ID NO: 14857 - DNA, 201 bp, synthetic construct
  misc_feature 1..201: note = Description of Artificial Sequence: Synthetic polynucleotide
  source 1..201: mol_type = other DNA
tttggtgttggtatttattagtgtggttagtttggttgaagttttgtggaagggtgggattaggtgttgtattgttgtgtttagggattggaattggtgttgtttgtaggttatgaggtttattatggagtttagtgttgtattttgtgagaggggtggatgtgggggttgtagggattttagatggtttgggattgattt

SEQ ID NO: 14858 - DNA, 201 bp, synthetic construct
  misc_feature 1..201: note = Description of Artificial Sequence: Synthetic polynucleotide
  source 1..201: mol_type = other DNA
tggttattttgggagtttgttgttgatgaattgtagtatggttatttgggttgtttattttgtatggttatgttgtttggttattgttgtaggtatgttttgttttgtttaattttttggttggtggggttatttgggtgtttgtatatgattttttttgagagggttagaggttggtttaattatttgtaaataatgtta

SEQ ID NO: 14859 - DNA, 201 bp, synthetic construct
  misc_feature 1..201: note = Description of Artificial Sequence: Synthetic polynucleotide
  source 1..201: mol_type = other DNA
ttagtatataggatatttatgtgtgtttattatttggtatatgggagatttatgtgtgtttattgttgggtataggggagatttatgtgtgtttattgtttggtatatgagagatttatgtgtgtttattgtttggtatagggagatttatgtgtgtttattgtttggtataggggagatttatgtgtgtttattgtttgg

SEQ ID NO: 14860 - DNA, 201 bp, synthetic construct
  misc_feature 1..201: note = Description of Artificial Sequence: Synthetic polynucleotide
  source 1..201: mol_type = other DNA
aggggaatagtaatagaagttttatttattaggtatttattgtgtgttaagtattgtgttaagggttttatagaataatagtataagaattttggttgggtgtagtggtttatttttgtaattttagtattttgggaggttgaggtgggtggattatgaggttaggagttagagagattagtttagttaatatggtgaaat

SEQ ID NO: 14861 - DNA, 201 bp, synthetic construct
  misc_feature 1..201: note = Description of Artificial Sequence: Synthetic polynucleotide
  source 1..201: mol_type = other DNA
tgtatgtattgtgtgtgagttgaagtagggtgaggtattgttttatttgggaagtatgaggggttagggagtttttatttttagttaaagaaaggggtgatggatgtatttggaaaattgggttatttttatttgaatattgtgtttttttggtgggtttaaaaaatggtgtattatgagattatattttatatttggttc

SEQ ID NO: 14862 - DNA, 201 bp, synthetic construct
  misc_feature 1..201: note = Description of Artificial Sequence: Synthetic polynucleotide
  source 1..201: mol_type = other DNA
gtttgttattatgtttggagaattttttgtatttttagtggagataggtttttattatgttagttaggatggttttgattttttgattttgtgatttgtttgttttggttttgtaaagtgttgggattataggtgtgaggtatagtgtttggttttgattgttttatttaaagtaatgaaagtatagttggttttaaagga

SEQ ID NO: 14863 - DNA, 201 bp, synthetic construct
  misc_feature 1..201: note = Description of Artificial Sequence: Synthetic polynucleotide
  source 1..201: mol_type = other DNA
tttgtggttagttggattaggtggttggtagtgagatggaataagtagattaggttgagggtgaaggtgtaggtgattagtagtatggataagaggttgttgtttgttattttttttattgtttggtttagtatttatttatttgtttgtagtaagtttagtagtattattttggttgttgttgttattttattttgttgg

SEQ ID NO: 14864 - DNA, 201 bp, synthetic construct
  misc_feature 1..201: note = Description of Artificial Sequence: Synthetic polynucleotide
  source 1..201: mol_type = other DNA
ttagattgttttttttttgagatagagttttgttttgttatttaggttagagtgtggaggtgtgattttagtttattgtaagttttgttttttgggtttatgttatttttttgttttagttttgtgagtagttgggattataggtgtttgttattgtgttggttaatttttttggtatttttagtagagatagggttttat

SEQ ID NO: 14865 - DNA, 201 bp, synthetic construct
  misc_feature 1..201: note = Description of Artificial Sequence: Synthetic polynucleotide
  source 1..201: mol_type = other DNA
atagtttattaaaaatataaaaaaaaaaaaaaaaaaatttgttgggtgtggtggtgtgtgtttgtaattttagttatttgggaggttgaggtaagagaattgattgaatttgggaggtagagattgtagtgagtttagattatgttattgtattttagtttggataagagtgagattttattttaaaaataaaaataaaaa

SEQ ID NO: 14866 - DNA, 201 bp, synthetic construct
  misc_feature 1..201: note = Description of Artificial Sequence: Synthetic polynucleotide
  source 1..201: mol_type = other DNA
tgtttttttttgttttgagatggagttttattttattgtttaggttggagtgtagtggtgttattttggtttattgtaatttttattttttgggttttagtgatttttttgttttagttttttaagtagttgggattgtaggtgtttataattatgtttggttaatttttgtgtttttagtagagttggagttttattatg

SEQ ID NO: 14867 - DNA, 201 bp, synthetic construct
  misc_feature 1..201: note = Description of Artificial Sequence: Synthetic polynucleotide
  source 1..201: mol_type = other DNA
tgtttgttattaagtttagttaatttttgtatttttagtagagatggggttttattgtgttggttaggttggttttgaatttttgattttgtgatttgtttgttttggttttttaaagtgttaggattataagtgtgagttattgtgtttggttttttaaatggtatttttgattttttttttttagtttttaaagtaggt

SEQ ID NO: 14868 - DNA, 201 bp, synthetic construct
  misc_feature 1..201: note = Description of Artificial Sequence: Synthetic polynucleotide
  source 1..201: mol_type = other DNA
gttaaggtgggtggattatttgaggttaggagtttgagattagtttggttaatatggtgaaattttatttttattaaaaatatggaaaaaattagttgggtggggtttgagtttgtaattttagttatttgggagttgaggtgtgagaattgtttgaagttgggagggggaggttgtaggagtagaggttgtgttattgta

SEQ ID NO: 14869 - DNA, 201 bp, synthetic construct
  misc_feature 1..201: note = Description of Artificial Sequence: Synthetic polynucleotide
  source 1..201: mol_type = other DNA
ggtttgtatggtgtgtgattatttttagtggaagttttaatatgggtgtggtttagttttttagggttttttaaggtagaggtggtttgggtttttgtagtgattttataatatattttaattgtagatggtggagattgtgggttgttttttggtttaagtggttttggggtttttgttttgtgtggagttatttgtgtt

SEQ ID NO: 14870 - DNA, 201 bp, synthetic construct
  misc_feature 1..201: note = Description of Artificial Sequence: Synthetic polynucleotide
  source 1..201: mol_type = other DNA
gtgttttgggttattgagagaagtgaaatattgtagatatggtagaggtgttttttttttttttttgtttttagatgtggtttttatatgtaggttgatgtgttttttttttatttatgtttgtttggttttgttatatatgttgttgtgttgttggttttgaatgtgtatgagtggtttgtgttggggttagtggaggtt

SEQ ID NO: 14871 - DNA, 234 bp, synthetic construct
  misc_feature 1..234: note = Description of Artificial Sequence: Synthetic polynucleotide
  source 1..234: mol_type = other DNA
aggggttatatttatggatttttttttttttggtaggaagatgagtgattatatttttgttattattgaattgagtgttttgtttgtttggtgttagtattgtttgtattattattttgattttatttattattgtttggtggatgggtggaggttttggtaggtttgtgatatggtgtattattttattattgaagttatttaggaatggtggtgggtattgtgttagtaggg

SEQ ID NO: 14872 - DNA, 201 bp, synthetic construct
  misc_feature 1..201: note = Description of Artificial Sequence: Synthetic polynucleotide
  source 1..201: mol_type = other DNA
ggggttttttgtttttagtattgttagtttaggtgtgttttttatggtgtgatgtgtttgtagatttggaaatattataggatttaggtattttatggagtgtttgttttgtgttagttttagtttagtgttttttagatattgtttgattttttggaggtagttattgatattgtgtttattgtatagatgagaaagttg

SEQ ID NO: 14873 - DNA, 201 bp, synthetic construct
  misc_feature 1..201: note = Description of Artificial Sequence: Synthetic polynucleotide
  source 1..201: mol_type = other DNA
tttttagtgagatgaatttggtattttagatggaaatgtagaaattatttgttttttgtgttgtttatgttgggagttgtagattggagttgtttttatttggttattttggttttttttttttgttttttttttgagatagtgtttttttttatttttgttatttaggttgtagtgtagtggtgtggtttgtgtttattg

SEQ ID NO: 14874 - DNA, 201 bp, synthetic construct
  misc_feature 1..201: note = Description of Artificial Sequence: Synthetic polynucleotide
  source 1..201: mol_type = other DNA
taattttattttgtttttgagatagagttttgttttgttgtttaggttggagtgtagtggtgtaattttggtttattgtaagttttgttttttgggtttatgttatttgtttgttttagttttttgaataattgggattataggtgtttgttattatgtttggttaaatttttgtatttttagtagagatggggttttatc

SEQ ID NO: 14875 - DNA, 201 bp, synthetic construct
  misc_feature 1..201: note = Description of Artificial Sequence: Synthetic polynucleotide
  source 1..201: mol_type = other DNA
atttttagggttgtggatggtagaattaaaagagttaattagtaagtagaattgttttttttggggttttaaggtttgagtattttttttggggtgttattgtattttttttggggtgatatgtttggtttagttgtaagttttgtttagaatttgtttgtgtattggtgtttggaatagttagttggattttatatttat

SEQ ID NO: 14876 - DNA, 201 bp, synthetic construct
  misc_feature 1..201: note = Description of Artificial Sequence: Synthetic polynucleotide
  source 1..201: mol_type = other DNA
ggtttttgtagggagtttatattagtagttttttattttgaggagatatgtgggttttttttttgaagtttgtttaggaggtagatggagtgatttgatttggaggataggagggtgtttaggggttttggtgttatagtttttataggatgattttggagtgtttttggattttgagttgttttggttaaggagttgtat

SEQ ID NO: 14877 - DNA, 201 bp, synthetic construct
  misc_feature 1..201: note = Description of Artificial Sequence: Synthetic polynucleotide
  source 1..201: mol_type = other DNA
tatatataggtgtggatatttatatggtttttggtagtgttgtaggaggttagtatagagatgtgttgaggagtttgagatgtttgtttttttgggttattgtgtgtaaaggttgtttttgttgtggatttttatatgtgtgatatatatgaataggtgaaatggatatgtatggtttttatatatgtgagttgggttttt

SEQ ID NO: 14878 - DNA, 201 bp, synthetic construct
  misc_feature 1..201: note = Description of Artificial Sequence: Synthetic polynucleotide
  source 1..201: mol_type = other DNA
tttttgtgaaggtattaagtatggtagatgtttttatattgttggggtttgtttttttgtggatgggaagtgggaatgtgatgtggatgtgatgtgggaatgtaatgtgatgtgatgtgatgtgatgtggtatggtgtgaggatagtgtggtgggagtggtgttttagatttagtagggagggagatgaaaggtggatgga

SEQ ID NO: 14879 - DNA, 201 bp, synthetic construct
  misc_feature 1..201: note = Description of Artificial Sequence: Synthetic polynucleotide
  source 1..201: mol_type = other DNA
gttgggtgtggtggtatgtgtttgtagttttagttatttaggaggttgaggtaggagaattttttgaatttgggatgtagaggttgtagtgagttgagattgtgttattgtattttagtttggtaatagagtgagattttggtttaaaaaaaaaaaaaaagaaaaaaaaaaaaaaaagaaggagttgaggttttaagaatt

SEQ ID NO: 14880 - DNA, 201 bp, synthetic construct
  misc_feature 1..201: note = Description of Artificial Sequence: Synthetic polynucleotide
  source 1..201: mol_type = other DNA
ttgtattttgtgggtaggggatattttttttagtggttggtgatgattgtgattttatttgttgagttttgtgggagttttggtagttttttgtaattgttggttggttgttattgttttagtgtttgttttttgattggttagtaaattatggtggtagatagaaaaaagatagtttttttttttagggttgttttataa

SEQ ID NO: 14881 - DNA, 201 bp, synthetic construct
  misc_feature 1..201: note = Description of Artificial Sequence: Synthetic polynucleotide
  source 1..201: mol_type = other DNA
ttttgttggtgtattttgttggtgtattttgttggtgtattttgttggtgtattttgttggtgtattttgttggtgtattttgttggtgtattttgttggtgtaagttgtgttttgggattgggtttgaaaagggaggagttatttattttaagtttttaggtttggggagaattttatagtaagttttttgggagtttga

SEQ ID NO: 14882 - DNA, 686 bp, synthetic construct
  misc_feature 1..686: note = Description of Artificial Sequence: Synthetic polynucleotide
  source 1..686: mol_type = other DNA
gtggtatttgtaggtttttaggattaggtagaggatttagtttttttaggattggggttttggtgttgtgttttaggggaggttgatgggggttgggaggtgtttagggtgggaatttagtgtatgggtgaggattttaaaaagtaaggggtaggatgagttaataaggttttgagtaggaaaattatgtgataggaagtgtatatattgttttatagtagaaagattggggatgggattagtttttaagtgattttaaatttaaaaggaagtaatttttagatttttatgggtgttttaatttgttttgggtgaaggaagataggtaagaatttttaggtttgtgaggattttatgttttagggatagaagtgttagggatttgggaagtgtagatttaatataaggtagagtaaaatttatgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtggggttgggattagatttgtgtatttttttgttttgtatttagtgtttttgttttttgggtgtttggaggtgagagtggttaggaaggttgaggtatgat

SEQ ID NO: 14883 - DNA, 201 bp, synthetic construct
  misc_feature 1..201: note = Description of Artificial Sequence: Synthetic polynucleotide
  source 1..201: mol_type = other DNA
gttagagtgtagtggtgtgattttggtttattgtaagttttgttttttgggtttatgttatttttttgttttagtttttttagtagttgggataggggtatgttgttatgtttggttagtttttgtatttttagtagagatggggttttattatattagttaggatggttttgattttttgattttgtgatttgttagttt

SEQ ID NO: 14884 - DNA, 201 bp, synthetic construct
  misc_feature 1..201: note = Description of Artificial Sequence: Synthetic polynucleotide
  source 1..201: mol_type = other DNA
gttagagattttgtttttaaaagtaaaaaagaaaaaaaaagtttttttttaagttattatatattttgaataattaatattgaaaattgttggttgggtgtggtggtttatgtttgtaattttagtattttgggaggttgaggtggggtggattatgagattagtagaatggtgtgaatttggaaggtggagtttgtagtg

SEQ ID NO: 14885 - DNA, 201 bp, synthetic construct
  misc_feature 1..201: note = Description of Artificial Sequence: Synthetic polynucleotide
  source 1..201: mol_type = other DNA
ttgtatttttatttgaggtattgggtttattttattagggagtgttagatagtgggtgtaggttagtgggtgtgtgtattgtgtgtgagttgaagtagggtgaggtattgttttatttgggaagtgtaaggggttagggagttttttttttgagttaaagaaaggggtgatggatgtattttgaaaattgggttattttta

SEQ ID NO: 14886 - DNA, 201 bp, synthetic construct
  misc_feature 1..201: note = Description of Artificial Sequence: Synthetic polynucleotide
  source 1..201: mol_type = other DNA
atgtatttattgatttgtgtttattgtttggtagtttttagtgagatgaatttggtattttagttggaaatgtagaaattattattttttgtgttgtttatgttgggagttgtagattggagttgtttttatttggttatgttggttttttttttggatataattatttttgtatttatttaatttttatttttatggaat

SEQ ID NO: 14887 - DNA, 201 bp, synthetic construct
  misc_feature 1..201: note = Description of Artificial Sequence: Synthetic polynucleotide
  source 1..201: mol_type = other DNA
tttttatgtgattattgtttgtttgttagtgttagttttttttgattttaaattataagtggaagaaagtatgttagaaatttatagaattggtttggtgtggtggtttaggtttgtaattttagtattttgggaggttgaggtaggtggattatgaggttaggagattgagattattttggttaatagggtgaaattttg

SEQ ID NO: 14888 - DNA, 201 bp, synthetic construct
  misc_feature 1..201: note = Description of Artificial Sequence: Synthetic polynucleotide
  source 1..201: mol_type = other DNA
aagttttttttttttttttttttttttttttttgagatggagttttatttttttgtttaagttggattgtagtggtgttattttggtttattgtaagttttgttttttgggtttatgttatttttttgttttagttttttgagtagttgggattataggtgtttattattatgtttggttaattttttgtatttttagtag

SEQ ID NO: 14889 - DNA, 201 bp, synthetic construct
  misc_feature 1..201: note = Description of Artificial Sequence: Synthetic polynucleotide
  source 1..201: mol_type = other DNA
tgtttggtgtatgttgtggagggtgtgggtaatggtgtatattgtattaattataaattgtattttgtttttttgtttgtaggtggagttttggttgatgtgttttttgtttgttttagggatgtttagagaaagtgtgtttggtttttatgtattgaatttggttttttgttttttttttttttatttttattatttttt

SEQ ID NO: 14890 - DNA, 201 bp, synthetic construct
  misc_feature 1..201: note = Description of Artificial Sequence: Synthetic polynucleotide
  source 1..201: mol_type = other DNA
gattttagggggttttattttagtggttttttttattttttttgtagagaaaaaagagtgttggtgggattattgtttattgtgtgtttaggaggtgttttgtaatatggtgtattttaatgtgatttgtgatggttgtaatgggtttgtggtaggaatttgttataagtgtagtgtttgtttagattatgatttgtgtag

SEQ ID NO: 14891 - DNA, 201 bp, synthetic construct
  misc_feature 1..201: note = Description of Artificial Sequence: Synthetic polynucleotide
  source 1..201: mol_type = other DNA
ggtattttatttatttagagatagagttttgttgtgatgtttaggttggagtgtatggtgtaattttggtttattgtaggttttgttttttgggttttagtgatttttttgttttagttttttgagtagttggggttatagttatgtgttattatgttgggttaatttttgtatttttagtagagatagggtttttttata

SEQ ID NO: 14892 - DNA, 201 bp, synthetic construct
  misc_feature 1..201: note = Description of Artificial Sequence: Synthetic polynucleotide
  source 1..201: mol_type = other DNA
ttattatgtttaattaattttttttatttgtagtagagatagggttttattgtgttagttaggatggttttgattttttgattttgtgatttgtgtgttttggttttttaaagtgttgggattataggtgtgagttattgtgtttggtttgtaaatattttttgtgttttagtgggttatgtttttattttgttgattgtt

SEQ ID NO: 14893 - DNA, 227 bp, synthetic construct
  misc_feature 1..227: note = Description of Artificial Sequence: Synthetic polynucleotide
  source 1..227: mol_type = other DNA
ttagttttttgagtagttggaattataggtgtttgttattatgtttggtttattttttgtatttttagtagagatggggttttattatgttagttaggattgttttgattttttgattttgtgatttgttggttttggttttttaaagtgttgggattataggtgtgagttattatgtttagttttagaaattgaaatgtatattattaagtgaaagaagttaattt

SEQ ID NO: 14894 - DNA, 201 bp, synthetic construct
  misc_feature 1..201: note = Description of Artificial Sequence: Synthetic polynucleotide
  source 1..201: mol_type = other DNA
tttttttttagttttgttgttattttgtagtttgattttagattgttgtgttagtaattagtgagattttgagttaggtgtgggatataattttgtggtgtgttgttttttaagttggttggaaaagtgtaatatttgggtgggagtgatttgattttttaggtgtgtttgttatttttttttttgatttggaaagggaat

SEQ ID NO: 14895 - DNA, 201 bp, synthetic construct
  misc_feature 1..201: note = Description of Artificial Sequence: Synthetic polynucleotide
  source 1..201: mol_type = other DNA
aggtgtgtttgttatttttttttttgatttggaaagggaattttttgattttttgtgttttttaagtgaggtaatgtttttttttgttttggtttgtgtatggtgtatgtttttattgatttgtgtttattgtttggtttttttaagtgagatgaatttggtattttagatggaaatgtagaaattatttgttttttgtgt

SEQ ID NO: 14896 - DNA, 201 bp, synthetic construct
  misc_feature 1..201: note = Description of Artificial Sequence: Synthetic polynucleotide
  source 1..201: mol_type = other DNA
tgtttttttgttttagtgtttatattgtaaaaaagtgttttttttattgggtgtggtggtttatgtttgtaattttagtattttgggaggtagaggtgggtggattatgaggttaggagattgaaattattttggttaatatggtgaaattttgtttgtattgtgaatataaaaaattagttgggtgtggtggtgggtgtt

SEQ ID NO: 14897 - DNA, 201 bp, synthetic construct
  misc_feature 1..201: note = Description of Artificial Sequence: Synthetic polynucleotide
  source 1..201: mol_type = other DNA
gttgggtgtggtggtgggtatttgtagttttagttatttgggaggttgaggtaggagaatggggtgaatttgggaggtggagtttgtagtgagttgagattgtgttattgtattttagtttgggtgatagagtgagattttattttaaaaaaaaataatattaggattgaagtttgttttttaatttttagtgatatggtt

SEQ ID NO: 14898 - DNA, 201 bp, synthetic construct
  misc_feature 1..201: note = Description of Artificial Sequence: Synthetic polynucleotide
  source 1..201: mol_type = other DNA
tgaataagaaagggttattatattttattttgaaatggtttttggagaaagaatggaagtaaattgtataagtgggtgtttatttttttttatttggttatggttattgtggtgtttggttaggtttttggtgatgtgaggtaaatttttttgttggtaaattagtttatatattttttttattgtagatggttatttaga

SEQ ID NO: 14899 - DNA, 201 bp, synthetic construct
  misc_feature 1..201: note = Description of Artificial Sequence: Synthetic polynucleotide
  source 1..201: mol_type = other DNA
ttaagtatttttttgtgatttgtttagaggaatttttggtagtggggatggtgttatttttatttgagagatgaggagattgaggtttagaggggggatgtggtttgtttgagttatattgattgagaggggtagatttggatttgtttgtagtttaagtttttagagattttggtgtggtttgttgggtagttagtttgt

SEQ ID NO: 14900 - DNA, 201 bp, synthetic construct
  misc_feature 1..201: note = Description of Artificial Sequence: Synthetic polynucleotide
  source 1..201: mol_type = other DNA
gtgtgattttggaggggtaagaattattttggtagttatgggggagtttatgagtgtttgataagaggttatgtttttttgggattttttagaaagttagtggaggggttggggatagtagttgttttgggtttaaggtgagtagtattgttgtttttgaggatggtgtgtaggtgaaggtattgttgattttaggttggg

SEQ ID NO: 14901 - DNA, 201 bp, synthetic construct
  misc_feature 1..201: note = Description of Artificial Sequence: Synthetic polynucleotide
  source 1..201: mol_type = other DNA
tttggatatttaggttatttttgaattttaaggtttttaattgtagttatatgtatagaggtttttttgttatgtggggtaatatggttatagggtaagatggttatgggttttagatatttttgggttattattttgtttattgtaggtggatatagttatggaatggaagtaatttttttgattatttatggtagtttt

SEQ ID NO: 14902 - DNA, 201 bp, synthetic construct
  misc_feature 1..201: note = Description of Artificial Sequence: Synthetic polynucleotide
  source 1..201: mol_type = other DNA
gatttttttgagtttgttgggagatagttatgttaatggttataatgggtatagtgtttaggaatgtagtaatttagttagttgttagttttttttttggtgtgggtattatttaatgtgtttatttggggtttagatgtgataaattggttgagggattttgggttttggttgggatgagtgtagtaaatttgttgttat

SEQ ID NO: 14903 - DNA, 201 bp, synthetic construct
  misc_feature 1..201: note = Description of Artificial Sequence: Synthetic polynucleotide
  source 1..201: mol_type = other DNA
ttttgaatagtagtaggtagtagagttttagggagagtaggtttttgtggtgtagtattatggttttgtgttttattttggagaagttgatggagatgtgtgttttggggatgggttttaggattagtttttttgtggtttggttgttgtttgggagtggttgttggtggatggtgtagtgtagaggtaggatgttggggg

SEQ ID NO: 14904 - DNA, 201 bp, synthetic construct
  misc_feature 1..201: note = Description of Artificial Sequence: Synthetic polynucleotide
  source 1..201: mol_type = other DNA
atagggttttattttgttagttaggatggttttgattttttgattttgtgatttgttagttttggttttttaaagtgttgggattataggtgtgagttattgtattgggttggtagttattttttttaagtagtagttttattttttagtataaattaatgttgtagtttttaaattatttgttgaagtgtttttgaattt

SEQ ID NO: 14905 - DNA, 201 bp, synthetic construct
  misc_feature 1..201: note = Description of Artificial Sequence: Synthetic polynucleotide
  source 1..201: mol_type = other DNA
ttttttttttttttttgagatagaattttgttttgttgtttaggttggagtatagtggtgtgatattagtttattgtaaattttattttttgggtttaagtgatttttttgttttagttttttgagtatttgggattatagggagtgtttttatatttggttaattttttgtatttttagtagagatagggttttattgtg

SEQ ID NO: 14906 - DNA, 201 bp, synthetic construct
  misc_feature 1..201: note = Description of Artificial Sequence: Synthetic polynucleotide
  source 1..201: mol_type = other DNA
aatagttgggtgtggtggtttatatttgtaattttagtattttgggaggttgaggtgggtagattatgaggttaggaaattgagattattttggttagtatggtgaaattttgtttttattaaaaatataaaaaaaattagttgggtgttgtggtggatgtttgtagttttagttatttttaaggttgaggtaggagaatg

SEQ ID NO: 14907 - DNA, 201 bp, synthetic construct
  misc_feature 1..201: note = Description of Artificial Sequence: Synthetic polynucleotide
  source 1..201: mol_type = other DNA
ttgatttggaaagggaattttttgattttttgtgttttttaagtgaggtaatgttttgttttgttttggttggtgtatggtgtgtgtatttattgatttgtgtttattgtttggttttttttagtgagatgaatttggtattttagatggaaatgtagaaattatttgttttttgtattgtttatgttgggagttgtagat

SEQ ID NO: 14908 - DNA, 201 bp, synthetic construct
  misc_feature 1..201: note = Description of Artificial Sequence: Synthetic polynucleotide
  source 1..201: mol_type = other DNA
tttttattttgttttttagatagaattttgttgtgttatttaggttggagtgtagtggtgtgattttggtttattgtaatttttgttttttgggtttatgtgatttttttgttttagttttttaagtagttgggattgtaggtgtgtattattatgtttatattaagtttttgtatttttagtagagatggggttttgtta

SEQ ID NO: 14909 - DNA, 201 bp, synthetic construct
  misc_feature 1..201: note = Description of Artificial Sequence: Synthetic polynucleotide
  source 1..201: mol_type = other DNA
tagtgaaattttgtttttattaaaaatataaaaaattagtttggtgtggtgaagggtatttgtagttgtagttatttaggaggttgaggtaggagaatggtgtgaatttgggaggtggagtttgtagtgaattgagattatgttattgtattttagtttgggtgatagagtgagattttgttttaaagaaatagaagattt

SEQ ID NO: 14910 - DNA, 201 bp, synthetic construct
  misc_feature 1..201: note = Description of Artificial Sequence: Synthetic polynucleotide
  source 1..201: mol_type = other DNA
ttttgtgaaaaataaaaaaaataagttgggtgtggtggtttatgtttgtaattttagtattttgggaggttgaagtaggtagattatgaggttaggagattgagattattttggttaatgtggtgaaattttgtttttattaaaaatataaaatattagttgggtgtagtggtgggtgtttgtagttttagttatttggga

SEQ ID NO: 14911 - DNA, 201 bp, synthetic construct
  misc_feature 1..201: note = Description of Artificial Sequence: Synthetic polynucleotide
  source 1..201: mol_type = other DNA
gagttaaagtgatatgtttgtttgggttttttaaagtgttggaattatagatttgagttattgggtttagtttaattattttttttagtttgagtatgagtgttggaagaaaagtttttatttgtatttattttttttagatatagggtttttttttgttatttaggttggagagtagtggtgtaatttttgtttggttta

SEQ ID NO: 14912 - DNA, 201 bp, synthetic construct
  misc_feature 1..201: note = Description of Artificial Sequence: Synthetic polynucleotide
  source 1..201: mol_type = other DNA
ggagtatgaggtaggagagttatttgaatttgggaggtagaggttgttgtgagttgagattatatttttttattttagtttgagtggtagagtaagattttgttttaaaaaaaaaaaaaaaaagttgggggaaggagagaaaaatagagagtttagtggggtaattttttatttagtttttgttatttgttattgttttag

SEQ ID NO: 14913 - DNA, 201 bp, synthetic construct
  misc_feature 1..201: note = Description of Artificial Sequence: Synthetic polynucleotide
  source 1..201: mol_type = other DNA
atatttggtttttgggatttgtatatttttgttttttttgggtggaaagatggtttttttgattagggtttttttgtgttttagagggtatgtttttttttgtaagtgtgagttgtatattagtgagtatgtgtttttatttttagggatattggttattaggtttggggttagatggtaggatttttgttttttttttta

SEQ ID NO: 14914 - DNA, 201 bp, synthetic construct
  misc_feature 1..201: note = Description of Artificial Sequence: Synthetic polynucleotide
  source 1..201: mol_type = other DNA
ttataggtgtttgttattatgtttggttaattttttgtgttttgtttagtagagatggggttttattgtattagttaggatggttttgatttgttgattttgtgatttgtttgttttggttttttaaagtgttgggattataggtgtgagttattttgtgtttggtttttttatttttatattttaaattagagatgattt

SEQ ID NO: 14915 - DNA, 217 bp, synthetic construct
  misc_feature 1..217: note = Description of Artificial Sequence: Synthetic polynucleotide
  source 1..217: mol_type = other DNA
tataggtgttttttattatgtttggttaattttttgtatttttagtagagatggggttttattgtgttagttaggatggttttgattttttgattgagattgtgtttttttgattgtgtttggttgattttttttttttttttatttgttttttttttttttattattattaaaagtttattgttttatatttttttttttttaattttatttaaaa

SEQ ID NO: 14916 - DNA, 217 bp, synthetic construct
  misc_feature 1..217: note = Description of Artificial Sequence: Synthetic polynucleotide
  source 1..217: mol_type = other DNA
ggtttatagtttttagtttgagtgatgtagaagatgggtgatttttgtatttttatttgaggtattgggtttattttattagggagtgttagatagtgggtgtaggttagtgagtgtgtgtattgtgtgtgagttgaagtagggtgaggtattgttttatttgggaagggtaaggggttagggagtttttttttttagttaaagaaaggggtgatgg

SEQ ID NO: 14917 - DNA, 201 bp, synthetic construct
  misc_feature 1..201: note = Description of Artificial Sequence: Synthetic polynucleotide
  source 1..201: mol_type = other DNA
gtttgttattatgtttggttaaatttttgtatttttagtagagatggggttttattttgttaattaggatggtgttgattttttgattttgtgatttgtttgttttggttttttaaagtgttgggattataggtgtgagttattgtgtttggtttggaaattgttttttatgtagttgatttattttaatttttattagta

SEQ ID NO: 14918 - DNA, 201 bp, synthetic construct
  misc_feature 1..201: note = Description of Artificial Sequence: Synthetic polynucleotide
  source 1..201: mol_type = other DNA
tatatgattttgaataagttttgaattatttatatgtgattttttggttttatatgaggtagaatagtatggtgtggattgggaattttgatgtgggagttgaaagatggggaggttgtgggtatggtttttggagttttgggattgagatatgtaggtattttagatgggtttgttgttataataagtgggaaattttta

SEQ ID NO: 14919 - DNA, 201 bp, synthetic construct
  misc_feature 1..201: note = Description of Artificial Sequence: Synthetic polynucleotide
  source 1..201: mol_type = other DNA
tttagagaagatttggtagtttttttagtttttggtttttgtttttgttttttttttttttgtttttaggttttttttttgtagttttttagttttttattgtgttttgtgtttttggttttttttttttttagtgttttttttatttggtgttgtttggttgtaattttggtttttttggggaagaggtttggattttat

SEQ ID NO: 14920 - DNA, 201 bp, synthetic construct
  misc_feature 1..201: note = Description of Artificial Sequence: Synthetic polynucleotide
  source 1..201: mol_type = other DNA
tgtttttatattggaaaaatttaaatatttttaagagtttgattattggttgggtgtggtggtttaatgtttgtaattttagtattttgggaggttgaggtggttggattataaggttaggagattgtgattattttggttaatatggtgaaattttgattttattaaaaaaatataaaaaaattagttgggtgtggtggc

SEQ ID NO: 14921 - DNA, 201 bp, synthetic construct
  misc_feature 1..201: note = Description of Artificial Sequence: Synthetic polynucleotide
  source 1..201: mol_type = other DNA
gatttggttgtttagaagtgtgtgttattttggattgagttaagatggttgaataggaatagttttggtttatagtttttattgtgagtgatgtagaagatgggtgatttttgtatttttatttgaggtattgggtttattttattagggagtgttagatagtgggtgtaggttagtgggtgtgtgtattgtgtgtgagtt

SEQ ID NO: 14922 - DNA, 201 bp, synthetic construct
  misc_feature 1..201: note = Description of Artificial Sequence: Synthetic polynucleotide
  source 1..201: mol_type = other DNA
ttttggttgggtgttgtggtttatgtttgtaattttagtgagaggtgatagtatgttggtagtttttgtagtttttttttattagtgtgatttttgggtgtgtgtgggttgggttggtttgtatttggagtggttagtagttttgggtagtgaggggtttagtatttgggttagtagttgttgtgtttgattttttgttag

SEQ ID NO: 14923 - DNA, 201 bp, synthetic construct
  misc_feature 1..201: note = Description of Artificial Sequence: Synthetic polynucleotide
  source 1..201: mol_type = other DNA
tgtggttgggtgtggtggtttatttttgtaattttagaattttgggaggttgaggtgggtggattatgagattagtagattgagattattttggttaatatggtgaaattttgtttttattaaaaatatagaaaaagtagttgggtgtggtggtgggtatttgtagttttagttataggttgaggtagaagaatggtgtga

SEQ ID NO: 14924 - DNA, 201 bp, synthetic construct
  misc_feature 1..201: note = Description of Artificial Sequence: Synthetic polynucleotide
  source 1..201: mol_type = other DNA
ttttggttttttaaagtgttggggttataggtgtgagttattgtgtttggttagttgtttttattaaaaatataaaaaattagtttggtgtggtggtgggtgtttgtagttttagttattttggaggttgaggtaggggaattgtttgaatttatgaggtggaggttttaagttgaggttgtgttattgtattttagtttg

SEQ ID NO: 14925 - DNA, 201 bp, synthetic construct
  misc_feature 1..201: note = Description of Artificial Sequence: Synthetic polynucleotide
  source 1..201: mol_type = other DNA
ggttggagtgtagtggtgtgattttggtttgttataatttttattttttagtagtttgttttggttttttaaagtgttgagattgtagtttttgtttggttgttattttgtttgagaagtgaggagtgtttttgtttggttgttattttatttaggaagtgaggagtgtttttttttggttgttattttatttgggaagtg

SEQ ID NO: 14926 - DNA, 201 bp, synthetic construct
  misc_feature 1..201: note = Description of Artificial Sequence: Synthetic polynucleotide
  source 1..201: mol_type = other DNA
gttttagttgtttttttgtggggtagggtttgggatttgtagtttgttatgtttgagttttttattttttttgtgggtttttgtgtggtttgagtttttttgatgagtgttattttttgttttatggtatttagttttattgattatttaagggttgaggagtgtgggtgtatagtattgggattggtaggtagttttatt

SEQ ID NO: 14927 - DNA, 286 bp, synthetic construct
  misc_feature 1..286: note = Description of Artificial Sequence: Synthetic polynucleotide
  source 1..286: mol_type = other DNA
gaagatgggtgatttttgtatttttatttgaggtattgggtttattttattagggagtgttagatagtgggtgtaggttagtgggtgtgtgtattgtgtgtgagttgaagtagggtgaggtattgttttatttgggaagtgtaaggggttagagagttttttttttgagttaaataaatgggtgatggatgtatttggaaaattgggttatttttatttgattattgtgttttttagattggtttaaaaaatggtgtattatgagattatattttatatttggttc

SEQ ID NO: 14928 - DNA, 201 bp, synthetic construct
  misc_feature 1..201: note = Description of Artificial Sequence: Synthetic polynucleotide
  source 1..201: mol_type = other DNA
gttttagttgtttttttgtggggtagggtttgggatttgtagtttgttatgtgtgagtttttttttattgttttaggtttttgtgtagtaggagtttttttgatgagtattgttttttgttttatggtatttggttttattgattgtggaatggttgaggagtgtgggtataaggtatgggattggtaggtagttttgttt

SEQ ID NO: 14929 - DNA, 201 bp, synthetic construct
  misc_feature 1..201: note = Description of Artificial Sequence: Synthetic polynucleotide
  source 1..201: mol_type = other DNA
ggagtgtaatggtattattttggtttattgtaatttttgttttttgggtttaggtgatttttttgttttagttttttgagtatttgggattataggtgtgtgtttttatgtttaattaatttttgtatttttagtagagatggagttttattatgttggttaggtttgttttgaatttttgattttgtgatttatttgttt

SEQ ID NO: 14930 - DNA, 201 bp, synthetic construct
  misc_feature 1..201: note = Description of Artificial Sequence: Synthetic polynucleotide
  source 1..201: mol_type = other DNA
tttttgttatttttttttttgatttggaaagggaattttttgattttttgtgttttttgagtgaggtaatgttttgttttgttttggtttgtgtatattgtgtatatttattgatttgtgtttattgtttggtattttttagtgagatgaatttggtattttagatggaaatgtagaaattatttgttttttgtgttgttt

SEQ ID NO: 14931 - DNA, 201 bp, synthetic construct
  misc_feature 1..201: note = Description of Artificial Sequence: Synthetic polynucleotide
  source 1..201: mol_type = other DNA
gatgtagaagatgggtgatttttgtatttttatttgaggtattgggtttattttattagggagtgttagatagtgggtgtaggtttgtgggtgtatgtattgtgtgtgagttgaagtagggtgaggtattgttttattttggaagtgtagggggttagggagtttttttttttagttaaagaaaggggtgatagatggtat

SEQ ID NO: 14932 - DNA, 201 bp, synthetic construct
  misc_feature 1..201: note = Description of Artificial Sequence: Synthetic polynucleotide
  source 1..201: mol_type = other DNA
tttagttaattttttttatatttttaatagagatagggttttattatgttggttaggatagttttgattttttgattttgtgatttgtttgttttggttttgtaaagtgttgggattataggtgtgagttattgtatttggttggaagtatatattttaatagttttatatagtagttgttgttagaatttaaatgaagat

SEQ ID NO: 14933 - DNA, 201 bp, synthetic construct
  misc_feature 1..201: note = Description of Artificial Sequence: Synthetic polynucleotide
  source 1..201: mol_type = other DNA
tagaagatgggtgatttttgtatttttatttgaggtattgggtttattttattagggagtgttagatagtgggtgtaggttagtgtgtgtgtgtattgtgtgtgagttgaagtagggtgaggtattgttttatttgggaagtgtaaggggttagggagttttttttttgagttagggaaaggggtgatggatggtatttgg

SEQ ID NO: 14934 - DNA, 201 bp, synthetic construct
  misc_feature 1..201: note = Description of Artificial Sequence: Synthetic polynucleotide
  source 1..201: mol_type = other DNA
ttggtagggttggttggttgtttttagtgtggggtttgttaagtttatgtttatttggaattttagttggtttgtaagtattatgtatagtttgggtttttgtttatgtttttttatttatatttttttgtaagttgagggagtgggttttggttttggttagtttagaaaggggtttttatagtgtagtggtgggttgaa

SEQ ID NO: 14935 - DNA, 201 bp, synthetic construct
  misc_feature 1..201: note = Description of Artificial Sequence: Synthetic polynucleotide
  source 1..201: mol_type = other DNA
tttgagatttttgtagttttggggtttgagttgaggggttattggtagtgttgtgggagttaggttgtttttttggaagttaggttgtttttgagtagagtggaggttttattgttttttggggggtatggtggtagtttttaggttgtattggggttggatgagttgggggtggagtataaggggttagttttttttttt

SEQ ID NO: 14936 - DNA, 201 bp, synthetic construct
  misc_feature 1..201: note = Description of Artificial Sequence: Synthetic polynucleotide
  source 1..201: mol_type = other DNA
aaattttttgtttgtagggggtgggtggggaggtggaggaggggttgggttaaatgttgggggtgtgatttggggttgtgggtttttgggttttagtttttgggtttgttgagtgggtgagtggggtgttttattttttgtggtttttttttggtttttatagaatatggagaaggtgattttgttgttggtgatgtttat

SEQ ID NO: 14937 - DNA, 201 bp, synthetic construct
  misc_feature 1..201: note = Description of Artificial Sequence: Synthetic polynucleotide
  source 1..201: mol_type = other DNA
gggtgtttgtagttttagttatttgggaggttgaggtaggagaatggtatgaatttgggaggtggagtttgtagtgagttgagattgtgttattgtattttggtttgggtgatagagtgagattttgttaaaaaaaaaaaaaaaaagtagttttgtaagattaggtgtttggtagataggtatatttagtaaagttataat

SEQ ID NO: 14938 - DNA, 210 bp, synthetic construct
  misc_feature 1..210: note = Description of Artificial Sequence: Synthetic polynucleotide
  source 1..210: mol_type = other DNA
ttattaaaaatataaaaaaattagtttggtgtggtggtgggtgtttttagttttagttgtttgggaggttgaggtaggagaatggtgtgaatttgggaggtggagtttgtggtgagttgagattttgttatagtattttagtttgggtgatagagtgagattttgttttagaaaaaaaaaaaaaaaaaaaaaagaagtgggaatttagaa

SEQ ID NO: 14939 - DNA, 201 bp, synthetic construct
  misc_feature 1..201: note = Description of Artificial Sequence: Synthetic polynucleotide
  source 1..201: mol_type = other DNA
ttttgggtttatgttatttttttgttttagttttttgagtagttgggattataggtatttggttaattttttgtattttttatagagatggggtttttattgtgttagttaggatggttttgattttttgattttgtgatttgtttgtttgggttttttaaagtgttgggattataggtgtgagttattgtgtttagtttg

SEQ ID NO: 14940 - DNA, 201 bp, synthetic construct
  misc_feature 1..201: note = Description of Artificial Sequence: Synthetic polynucleotide
  source 1..201: mol_type = other DNA
gattgtttttttgttattgtatttatataatttgttttaaatgggtaatttattaagtatattttgtttttgtttttgttgtaggtttttgttggattgttgtttataagtttttatagtttgtgagtttttttagtttggtttggtttattttgtggtgtttatgtttattttgggttttttttgatttttttttaattt

SEQ ID NO: 14941 - DNA, 201 bp, synthetic construct
  misc_feature 1..201: note = Description of Artificial Sequence: Synthetic polynucleotide
  source 1..201: mol_type = other DNA
gtagtgtagtggtgtaattttggtttattgtaagttttgttttttgggtttatgttatttttttgttttagtttttgggttagttgggattataggtgtttgttattgtgttaggttaattttttgtatttttagtagagatggggttttattatattagttaggatggttttgattttttgattttgtgatttatttgtt

SEQ ID NO: 14942 - DNA, 201 bp, synthetic construct
  misc_feature 1..201: note = Description of Artificial Sequence: Synthetic polynucleotide
  source 1..201: mol_type = other DNA
tttgtgttttttttttttgagttggtgggttatagatgttggaagaaatttttgtatttgtagttggaattgtagtttatggtgttttggtttttttttttgttttgtttttttttggttaaataatatattaaagaggtgaggtaatgattgttggttagtttttattggggaaaaatttattgttaggatggtatgaat

SEQ ID NO: 14943 - DNA, 201 bp, synthetic construct
  misc_feature 1..201: note = Description of Artificial Sequence: Synthetic polynucleotide
  source 1..201: mol_type = other DNA
ggaataaatatttttgttttataaagatttagaatttattggatattgataaaatgtttattagaggttggtgtagtggtttatgtttataattttggtgtggtggtttatatttgtaattttgatgtggtggtttatatatgtaattttagtattttgtaaggttaggtggggggattatttgagtttaggagtttatga

SEQ ID NO: 14944 - DNA, 201 bp, synthetic construct
  misc_feature 1..201: note = Description of Artificial Sequence: Synthetic polynucleotide
  source 1..201: mol_type = other DNA
gtggtgtaattttggtttattgtaagttttgttttttgggtttatgttatttttttgttttaggtttttgagtagttgggattataggtgtatattattatgtttggttaatttttttgtatttttagtaaagatggggttttattatgttagttaggatggttttgattttttgattttgtgatttattagttttagttt

SEQ ID NO: 14945 - DNA, 201 bp, synthetic construct
  misc_feature 1..201: note = Description of Artificial Sequence: Synthetic polynucleotide
  source 1..201: mol_type = other DNA
gtaaattttttgtaaaattttggttttttagattttagttgggtttttttttttaggtttttagtggtagttgtgttttttgtgtgtttatgttggttagtgtaagttatatatggatttagtgtttattgtatttttgttagttttagggttttagtttgttgttttgggagattttagttttggtttaggtattttttt

SEQ ID NO: 14946 - DNA, 201 bp, synthetic construct
  misc_feature 1..201: note = Description of Artificial Sequence: Synthetic polynucleotide
  source 1..201: mol_type = other DNA
ttttaatttttttattaagatggagttttgttttattgtttaggttggagtgtagtggtgtgattatggtttattataatttttgttttttgggtttaagtgatttttttgttttagttttttgagtagttgggattataggtatgtgttattatgtttaggtaattttagtatttttagttgagatggggttttattatg

SEQ ID NO: 14947 - DNA, 201 bp, synthetic construct
  misc_feature 1..201: note = Description of Artificial Sequence: Synthetic polynucleotide
  source 1..201: mol_type = other DNA
ttttgttaggtgtggtggtttatgtttgtaattttagtattttggaatgttgaggtaggtgaattatgaggttaagagattgagattatttttgttaatatggtgaaattttgtttttattaaaaatataaaaaattagttgggtgtgggggtgggtgtttgtagttttagttgtttgggaggttgaggtaggagaattgt

SEQ ID NO: 14948 - DNA, 201 bp, synthetic construct
  misc_feature 1..201: note = Description of Artificial Sequence: Synthetic polynucleotide
  source 1..201: mol_type = other DNA
attattttttttttttttgagatggagttttgttttgttgtttatgttggggtgtagtggtatgattttggtttattgtaagttttgttttttgggtttatgttatttttttgttttaattttttgagtagttgggattataggtatatgttattatatttggttaatttttttgaatttttagtagagaggggttttatt

SEQ ID NO: 14949 - DNA, 201 bp, synthetic construct
  misc_feature 1..201: note = Description of Artificial Sequence: Synthetic polynucleotide
  source 1..201: mol_type = other DNA
tttgtgaatttgggtggtgttttttttttgtattatttagatgtgtttttaggaaggatgtgttgttatgatttgttatggtggttttggggatggttagtggtgggatgatgggtgtgatgtggttttggggatggttagtggtaggatgatgggtgtgatgtatttgtgttatttgggatttaaatttatttatgattt

SEQ ID NO: 14950 - DNA, 201 bp, synthetic construct
  misc_feature 1..201: note = Description of Artificial Sequence: Synthetic polynucleotide
  source 1..201: mol_type = other DNA
attgggttttattgtgttagttaggatggttttgattttttgattttgtgattagtttgttttggttttttaaagtgttggtattataggtgtgagttattgtttttggtaaagtttttttttgatggttttagtttgttggataagttaggaataaggttattggttgtaagggaggaggagtttttgtaggtggtagtg

SEQ ID NO: 14951 - DNA, 201 bp, synthetic construct
  misc_feature 1..201: note = Description of Artificial Sequence: Synthetic polynucleotide
  source 1..201: mol_type = other DNA
ggtgatttaaattgtttatgtggaatatatatatatatatatatatatatatatatgtgttttagggatggatatatataaatatgtgttttaggggttttgtgtgaggagaggagatttatattattgatttagtaattagggttgattttagagggttggagtatatattttgggttgatgataggtgtttggttttgg

SEQ ID NO: 14952 - DNA, 201 bp, synthetic construct
  misc_feature 1..201: note = Description of Artificial Sequence: Synthetic polynucleotide
  source 1..201: mol_type = other DNA
ttttggtttgtttttttttattttaggttgttttaatttttttttgaaagtttggtgtttattttttattttttgggaaatattttgttgttttggggtgtgttttgtgaaggagatatgttgggtgaaagttagggattttataattattttttgtttttattttgggtttagtgtaggggttgttgtgaaggtattggt

SEQ ID NO: 14953 - DNA, 201 bp, synthetic construct
  misc_feature 1..201: note = Description of Artificial Sequence: Synthetic polynucleotide
  source 1..201: mol_type = other DNA
aggttgttgggaaggaattggtttttatggaagtgttttagtttttttgtttttttggttttttttttttggttgttttagtgttttattgaaagtttggtgttatatttttattttttgggaaattttatgtttttttggggtgttttttgtggggaagatatgtattttgggtgaaagttagggattttatgaatattt

SEQ ID NO: 14954 - DNA, 201 bp, synthetic construct
  misc_feature 1..201: note = Description of Artificial Sequence: Synthetic polynucleotide
  source 1..201: mol_type = other DNA
attaatttaaatatttattaatgatagattggataaagaaaatgtggtggggtggagttaagatggttgaataggaatagttttggtttatagtttttagtgtgagtgatgtagaagatgggtgatttttgtatttttaattgaggtaatgggtttattttattggggagtgttggatagttggtgtaggatagtgggtgt

SEQ ID NO: 14955 - DNA, 201 bp, synthetic construct
  misc_feature 1..201: note = Description of Artificial Sequence: Synthetic polynucleotide
  source 1..201: mol_type = other DNA
gtttgttattatatttggttaattttttgtatttttaatagagatggggttttattgtgttagtaaggatggttttgattttttggttttgtgatttgtttgtgttggttttttgaagtgttgggattataggtatgagttattgtgtttggttagaagtgtttttatttgtttgggaagttgtttttttttggtatttgt

SEQ ID NO: 14956 - DNA, 201 bp, synthetic construct
  misc_feature 1..201: note = Description of Artificial Sequence: Synthetic polynucleotide
  source 1..201: mol_type = other DNA
ttttttattttaaggaataagtttttaattagattagatatagttataagtaaatataaattatgtttttatgtaattttaagagttattttaggttgggtgtggtggtttatgtttgtaattatagtatttttggaggttgtggtgggtggattatgaggttaggagattgagattattttggttaatatggtgaaatta

SEQ ID NO: 14957 - DNA, 201 bp, synthetic construct
  misc_feature 1..201: note = Description of Artificial Sequence: Synthetic polynucleotide
  source 1..201: mol_type = other DNA
ggttaattaggggtatgtttttttatgtatatggtgggtatttttattttagttggttggtagtggtattgtatatggtattttatatttgtattttttttgttttggtttagtgtggttagggatgggttttgttagtttgtagtgttatttgttttgtgtaaggtttagaattgtttatttatgtaagttgggagtttg

SEQ ID NO: 14958 - DNA, 366 bp, synthetic construct
  misc_feature 1..366: note = Description of Artificial Sequence: Synthetic polynucleotide
  source 1..366: mol_type = other DNA
tgagtgatgtagaagatgggtgatttttgtatttttatttgaggtattgggtttattttattagggagtgttaggtagtgggtgtaggttagtgggtgtgtgtattgtgggtgagttgaagtagggtgaggtattgttttatttgggaagtgttaggggttagggagttttttttttgagttaaggaaaggggtgattgatgtatttagaaaattgggttatttttatttgaatattgtgttttttagattggtttaaaaaatggtgtattatgagattatattttatatttggtttggagggttttatgtttatggaattttattgattgttagtatagtagtttgagattaaattgtaaggtgg

SEQ ID NO: 14959 - DNA, 201 bp, synthetic construct
  misc_feature 1..201: note = Description of Artificial Sequence: Synthetic polynucleotide
  source 1..201: mol_type = other DNA
ataaaggttttttaagtttatattagatttatgagtttagttggttttatttagtggattttgtattgggggttgtaggtggagttgtttgttagttttgtgtagtgtttttatagtttttagtttttgggtggttgatgggattgggtgttgtggagtagggggtagtgtttattggggaggtttggttttgtaggagtt

SEQ ID NO: 14960 - DNA, 201 bp, synthetic construct
  misc_feature 1..201: note = Description of Artificial Sequence: Synthetic polynucleotide
  source 1..201: mol_type = other DNA
ggtgttgtttgttatttttttttttgattaggaaagggaattttttgattttttgtgtttttggagtgaggtaatgttttgttttgttttggtttgtgtgtggtgtgttgtatttattgttttgtgtttattgtttggtattttttagtgagatgaatttggtattttatatggaaatgtagaaattatttattttttgtg

SEQ ID NO: 14961 - DNA, 201 bp, synthetic construct
  misc_feature 1..201: note = Description of Artificial Sequence: Synthetic polynucleotide
  source 1..201: mol_type = other DNA
gttgttttgtagtttgattttagattgttgtgttagtaattagtgagattttgtgggtataggattttttgagttaggtgtgggatataatttttaggtgtgttgttttttaagtttgttggaaaagtgtagtattttggttggagtgatttgattttttaggtgttgtttgttatttttttttttgattgggaaagggaa

SEQ ID NO: 14962 - DNA, 384 bp, synthetic construct
  misc_feature 1..384: note = Description of Artificial Sequence: Synthetic polynucleotide
  source 1..384: mol_type = other DNA
ttgaattgttttaattttaagtggtttagttttaagttttgtgagagtattattggttagggtttgtagattgtggttgttaattgttttgatttttagatgttgaatgtttaggattgtgaggtttttgtggaggttttgtgttttgttaaatgttattgtaagtgttgtgttattgagtatattaatttggtttttttttgaagggatagagtttatttggtgttgtatttatataaatttgaataaagtaaatttttttaaaagtagtgtatgtaagtattgatatttatttaaaatagtttttttttttgggaaggttattaggaatttggtttttatttttttttattttttatgggtaatagaggttaaagaaatgaa

SEQ ID NO: 14963 - DNA, 216 bp, synthetic construct
  misc_feature 1..216: note = Description of Artificial Sequence: Synthetic polynucleotide
  source 1..216: mol_type = other DNA
gaagatgggtgatttttgtatttttatttgaggtattgggttaattttattagggagtgttagatagtgggtgtaggttagtgggtgtgtgtattgtgtgtgagttgaagtagggtgaggtattgttttatttgggaagtgtaaggggttagggagttttttttttgagttaaagaaaggggtgatggatgtagttggaaaattgggttattttta

SEQ ID NO: 14964 - DNA, 334 bp, synthetic construct
  misc_feature 1..334: note = Description of Artificial Sequence: Synthetic polynucleotide
  source 1..334: mol_type = other DNA
tgatatagaagatggtgatttttgtatttttatttgaggtattgggtttattttattagggagtgttagatagtgggtataggttagtgggtgtgtgtattgtgtgtgagttgaagtagggtaaggtaatgttttatttgggaagtgttaggggttagggagtttttttttttagttaaagaaaggggtgatggatgtatttggaaaattgggttatttttatttgaatattgtgttttttggattggtttaaaaaatggtgtattatgagattatattttgtatttggtttggagggttttatttgatggagttttgttgattgttagtatag

SEQ ID NO: 14965 - DNA, 201 bp, synthetic construct
  misc_feature 1..201: note = Description of Artificial Sequence: Synthetic polynucleotide
  source 1..201: mol_type = other DNA
gggattttaaggttttgttggtgtggtttaaaggtattggatgttggggttaagatgatttttgtgttgttatgaattaggttattggatgtgggttttgtgttgagtttgtagtttttgaggagttttttgggtttttttgttttgattatatttttttggatggttgttgggtttttgtttgttttgttttgtattgag

SEQ ID NO: 14966 - DNA, 270 bp, synthetic construct
  misc_feature 1..270: note = Description of Artificial Sequence: Synthetic polynucleotide
  source 1..270: mol_type = other DNA
gttattgtattttagtatgggtgatagagttagtttgaaattttgttttgtgtttttttgagaagtgatagtgtattggtatggtagtttttatagtttttgtttgtttttggtgtttttttggttttggtatttattttggttgtgtttgaggagttttttagtttgttgttgtattgtggaagtttatttttgggttggttaaggttggagttggtttttttagtttgtggggaggtgtggagggagaggtatgggtgggaattgggg

SEQ ID NO: 14967 - DNA, 253 bp, synthetic construct
  misc_feature 1..253: note = Description of Artificial Sequence: Synthetic polynucleotide
  source 1..253: mol_type = other DNA
tgtgagtgatgtggaagataggtgatttttgtatttttatttgaggtattgggtttattttattagggagtgttagatagtgggtgtaggttagtgggtgtgtgtattgtgtgtgagttgaagtagggtgaggtattgttttatttgggaagtgtaaggggttagggagttttgtttttgagttaaagaaaggggtgatggatgtatttggaaaattgggttatttttattggaatattgtgtttttttgatc

SEQ ID NO: 14968 - DNA, 204 bp, synthetic construct
  misc_feature 1..204: note = Description of Artificial Sequence: Synthetic polynucleotide
  source 1..204: mol_type = other DNA
ttttagtaggggtggttgggtagaggtgttttttattttttggatggggtggttggttgggtaggggggttgattttttttattttttttttggatggggtggtggtaaagattgagatagttttgttgtttgttgaattttatttttttggttaaaattaagttttttaataaagattttgaagtgttgagtttattaattta

SEQ ID NO: 14969 - DNA, 228 bp, synthetic construct
  misc_feature 1..228: note = Description of Artificial Sequence: Synthetic polynucleotide
  source 1..228: mol_type = other DNA
gttattttgtagtttgattttagattgttgtgttagtaattggtgagattttgtgggtgtaggattttttgagttaggtgtgggatatagttttttgatgtgttggtttttaagtttgtaggaaaagtgtagtatttgggtgggagaggtttgattttttatgtgttgtttgttatttttttttttgattaggaaagggaattttttgattttttgtgttttttgagt

SEQ ID NO: 14970 - DNA, 217 bp, synthetic construct
  misc_feature 1..217: note = Description of Artificial Sequence: Synthetic polynucleotide
  source 1..217: mol_type = other DNA
tgtaggatgtagattgtagatgtttattgttttgtaggtagttttagtttgagtggtggttgtgttgggtttgtgtttggggtttttttttgtatgtttttgttttttagtgtttgtgatgatgtgtgatttattaattatttggatttagtgtatttttatgttaaatagtgtgtgtttatttgtaaagtatatgatagtttttgtggttattggg

SEQ ID NO: 14971 - DNA, 201 bp, synthetic construct
  misc_feature 1..201: note = Description of Artificial Sequence: Synthetic polynucleotide
  source 1..201: mol_type = other DNA
ttatttttgaagttattgagattataagtttattggaaggaattaattttggatatattttgggtgtttgtttgggatattgttatatggtgagtattattggatttgtttgggatattgttatatggtgagtatttttggatttgttttattttttattttgttttatttttttttagaatttaggggttaaatattgga

SEQ ID NO: 14972 - DNA, 204 bp, synthetic construct
  misc_feature 1..204: note = Description of Artificial Sequence: Synthetic polynucleotide
  source 1..204: mol_type = other DNA
aagataataaattggttttaaataaaaagtaagaaaaatgttggggaggagttaagatggttaaataggaatagttttggtttatagtttttagtgtgagtgatgtggaaaatgggtgatttttgtatttttattggaggtattgggtttattttattagggagtgttagatagtgggtataggttagtgggtgtgtgtattgt

SEQ ID NO: 14973 - DNA, 223 bp, synthetic construct
  misc_feature 1..223: note = Description of Artificial Sequence: Synthetic polynucleotide
  source 1..223: mol_type = other DNA
tagtgggtatatagaggtagttgggatttgtttggaagagtttttgtttggggtaaggagttgggattgtgtttaggaggtagtggggagttttggagagtgaagtgttttttgtgtagatttgtgtgtttggagtattggagtttgtagggtaagagagggtttttagaagatttatgatgttttattgggatgtagagggaaatggttatttgtattttta

SEQ ID NO: 14974 - DNA, 201 bp, synthetic construct
  misc_feature 1..201: note = Description of Artificial Sequence: Synthetic polynucleotide
  source 1..201: mol_type = other DNA
tttaaagtattaggattataagtagaattattgtgttttttgtttttttttttgtttttgtttttgttttgttgttgttgttgatgttgttatagagttttgtttttgttgtttaggttgggatgtaatggtgtgattttggtttattgtagtttttgttttttggttttaagtaatttttttgttttagttttgtgagta

SEQ ID NO: 14975 - DNA, 203 bp, synthetic construct
  misc_feature 1..203: note = Description of Artificial Sequence: Synthetic polynucleotide
  source 1..203: mol_type = other DNA
agtataaataaattggttgggtggtagttttagttatttgggaggttgaggtagtagaatagtgtgaatttgggaggtggagtttgtagtgagttgagattgtgttattgtattttagtttgggtgatagagtgagattatgttttaaataaaaaaaaaaaaaaaaaaaaaaagtatttttttagatttagtttgatattagg

SEQ ID NO: 14976 - DNA, 201 bp, synthetic construct
  misc_feature 1..201: note = Description of Artificial Sequence: Synthetic polynucleotide
  source 1..201: mol_type = other DNA
ttatgtttggttaatttttttgtattattagtagagatgaggttttattgaggttttattgtgttagttgggatggtttgggttttttgattttgtgatttgtttaatttggttttttaaattgttgggattataggtatgagatattgtgtttggttgttgtttgattttttttagtagtgttttgtagttttttttgta

SEQ ID NO: 14977 - DNA, 201 bp, synthetic construct
  misc_feature 1..201: note = Description of Artificial Sequence: Synthetic polynucleotide
  source 1..201: mol_type = other DNA
tttttgagtagttgggattataggtgtttgttattttgtttggttaattttttgtatttttagtagagatggggttttattgtgttagttaggatggttttgattttttgattttgtgatttgttagttttggttttttaaagtgttgggattataggtgtgagttattgtgtttggtttaatttaatttttaataatggt

SEQ ID NO: 14978 - DNA, 201 bp, synthetic construct
  misc_feature 1..201: note = Description of Artificial Sequence: Synthetic polynucleotide
  source 1..201: mol_type = other DNA
aaaagttatagggggtgtgaggatagatggtgtgtttttttttatatatatggagatgtaggttggagtaatggtatatggattatgtatatgtggtggatgtattaatgtttatgtagaagagaataaaagttgtttttaattgggtataaattttttgtatttaaatattttgatatttataaataaaattagaataga

SEQ ID NO: 14979 - DNA, 201 bp, synthetic construct
  misc_feature 1..201: note = Description of Artificial Sequence: Synthetic polynucleotide
  source 1..201: mol_type = other DNA
tgatttgttttttttggttttttaaagtgttgggattataggtgtgagttattgtgtttggtttaggttattttttttttttttttttttttttttgaggtggagttttgttttgttgtttaggttggagtgtagtggtgtgattttggtttattgtaagttttgttttttgggtttatatgatttttttgttttagtttt

SEQ ID NO: 14980 - DNA, 201 bp, synthetic construct
  misc_feature 1..201: note = Description of Artificial Sequence: Synthetic polynucleotide
  source 1..201: mol_type = other DNA
ggattataggtgtgagttattgtgtttggtttaaattatggattttttttttttagtggagttttgtttttgtttaggttggaataggatggtatgaatttggtttattgtaatttttattttttgggtttaagtgatttttttgttttagttttttgagtagttgggattataggtatgtgttattatgtttggttagta

SEQ ID NO: 14981 - DNA, 201 bp, synthetic construct
  misc_feature 1..201: note = Description of Artificial Sequence: Synthetic polynucleotide
  source 1..201: mol_type = other DNA
aattttttttttattttttttgtttttttattttataaaattgttattgttattatggtttatttttaatgagttgttgggtatattttttagatggggttgtggttgggtagaggggttttttattttttagtaggggtggttgggtagaagtgttttttattttttggatggggtggttggttgggtggggggttgatt

SEQ ID NO: 14982 - DNA, 201 bp, synthetic construct
  misc_feature 1..201: note = Description of Artificial Sequence: Synthetic polynucleotide
  source 1..201: mol_type = other DNA
gggggttttttaagtttagttttgggtttgggttggggtatagggtagagtgggtttttttagtttttgttatgaggttaaggtagtgtattgtttgtagtgtatatttagaaattaaagtttaggagttggttattattttggtttatagttgatggaagagtaggtgtttttgagaatttatagtgttttttggttagt

SEQ ID NO: 14983 - DNA, 201 bp, synthetic construct
  misc_feature 1..201: note = Description of Artificial Sequence: Synthetic polynucleotide
  source 1..201: mol_type = other DNA
tgggtagtagagtgagattttgttttaaaaaaaaaaaaaaaaagggggggttgggtgtggtggtttatgtttgtaattttagtattttgggagattgaggtgggtagattatgaggttaggagattgggattattttagttaaaatggtgaaattttgtttttattaaaaatataaaaaattagttgggtgtagtggtggg

SEQ ID NO: 14984 - DNA, 201 bp, synthetic construct
  misc_feature 1..201: note = Description of Artificial Sequence: Synthetic polynucleotide
  source 1..201: mol_type = other DNA
gtgggagttatagggttttaggggaggagtgttttaggttgtggtaatagtaggtgtaaaggttttgaggtaggatggggtagggaggtttagagtttattgtgtagagatttgggaggttggtaggtatggtgaggattttgatttaaatttaggaaaggggaattatattggggtatgattttttgtattttttgagat

SEQ ID NO: 14985 - DNA, 201 bp, synthetic construct
  misc_feature 1..201: note = Description of Artificial Sequence: Synthetic polynucleotide
  source 1..201: mol_type = other DNA
gggatttttttatgttggttaggttggttttgaatttttgattttaagtgatttatttgttttggttttttaaagtgatgggattataggtatgagttattgtgtttggttaagggtttttttagatgtaattaagttaagatgaggttatattgagttaggtgggttttaaatttaatggttagtgtttttataagtata

SEQ ID NO: 14986 - DNA, 211 bp, synthetic construct
  misc_feature 1..211: note = Description of Artificial Sequence: Synthetic polynucleotide
  source 1..211: mol_type = other DNA
gttttagggttggaggagtaggagatttgggtagtggggtgggtgagtgttgggaggaggtaagaggttgtgggggaggaagatgttttttttggttttgtggggtaggttgtgtagggtaggttgtgtggggtaggtggggggtgttaaggaagtttgggtgtggttatattgtagagaaagttatgggaggtatgttttgagagttggg

SEQ ID NO: 14987 - DNA, 201 bp, synthetic construct
  misc_feature 1..201: note = Description of Artificial Sequence: Synthetic polynucleotide
  source 1..201: mol_type = other DNA
gtagttaaagttatttttttggttgaaagatattttttttggggggaggagttaagatggttgagtaggaatagttttggtttatagtttttagtgtgagtgataaagaagatgggtgatttttgtatttgtatttgaggtatttggtttattttattagggagtgttagatagtgggtgtaggttagtgggtgtgtgtat

SEQ ID NO: 14988 - DNA, 201 bp, synthetic construct
  misc_feature 1..201: note = Description of Artificial Sequence: Synthetic polynucleotide
  source 1..201: mol_type = other DNA
gtttaggatttgtagtttattatgtttgagttttttatttattttatgggtttttgtgttgtttaagttttttggatgagtgttattttttgttttatggtgtttagttttattgattatttaagggttgaggaatgtgagtatatggtgtaggattggtaggtagttttatttgtagttttggtgtgggatttattaggt

SEQ ID NO: 14989 - DNA, 201 bp, synthetic construct
  misc_feature 1..201: note = Description of Artificial Sequence: Synthetic polynucleotide
  source 1..201: mol_type = other DNA
tggtaatattgtgaagatgtaggttttttatgggaaagattgttgtttggaagtttttatataataggtttttattgagattttaaggttgatagtatggtgggagtttttgggatttttgggtttggtatagtgttattgtagtaggtaggtattgggtggttagaagttgattatttttttaaatggtttgtatatatt

SEQ ID NO: 14990 - DNA, 201 bp, synthetic construct
  misc_feature 1..201: note = Description of Artificial Sequence: Synthetic polynucleotide
  source 1..201: mol_type = other DNA
tttttatgggttgatttggtgattttttatggagaatgtgtaggagttggatattggtattgttaggtggaaaagttttttgttagggtgaaaagttagatggtgtttgttttttgtttttggagtgtttttggtttaatgtagtagttttgtagataaatgttatagaaggtagagtgttttatagatatgaaggagtgg

SEQ ID NO: 14991 - DNA, 201 bp, synthetic construct
  misc_feature 1..201: note = Description of Artificial Sequence: Synthetic polynucleotide
  source 1..201: mol_type = other DNA
gatttttggatttgttgggttgtttttgtatttggttttttttttttaagtttgtggttgggtgtggtttttttaattttagtgttgatttttgtgtttgtgtgttttttttttattttttttatttgtggggttaggggttatatggtattgttgtttgggtttttgagtagggagagttgagtgttgattttgttagaa

SEQ ID NO: 14992 - DNA, 201 bp, synthetic construct
  misc_feature 1..201: note = Description of Artificial Sequence: Synthetic polynucleotide
  source 1..201: mol_type = other DNA
ggatattttataaaatttttgatgagttttttttaaaattattaggttggttgggtgtggtggtttatgtttgtaattttagtattttgggaggttgaggtgggtagattataaggttaggagattgagattattttggttaatatggtgaaattttgtttttattaaataatataaaaaattagttgggtgtggtagtgg

SEQ ID NO: 14993 - DNA, 201 bp, synthetic construct
  misc_feature 1..201: note = Description of Artificial Sequence: Synthetic polynucleotide
  source 1..201: mol_type = other DNA
tttttttttatttttttaggggtttgattttttttttaattgtatttttatagaatggttggttagataggaagttttggttggtgaagtttagtttttgtgggtataggttggtgaattttagagatttgggatttgggtaggttttgtatttgattttttatatggttttgatggagtagtagtagatgtttatttggt

SEQ ID NO: 14994 - DNA, 201 bp, synthetic construct
  misc_feature 1..201: note = Description of Artificial Sequence: Synthetic polynucleotide
  source 1..201: mol_type = other DNA
aaattagttaggtttggtggtaggtatttgtaattttagttattttaggggttgaggtaggagaattgtttgaatttgggaggtggaggttgtagtgagttgagattgtgtttttgtattttagtttgggggataagagtgagattttgttttaaaaaaaaaaaaaaaaaaaaaaaaaggttgggtggtttatatttgtaa

SEQ ID NO: 14995 - DNA, 201 bp, synthetic construct
  misc_feature 1..201: note = Description of Artificial Sequence: Synthetic polynucleotide
  source 1..201: mol_type = other DNA
tattgttatgatttgtgagtgtgtgttttttattttgttagagttggtagtgtgtgttatttatttggtgtttggttattattgttttatgtggatggtgtggttggtttttatgtatgtgtttttggtggttgaggttgatgtggatgtgttgttgtttatttttatgtttttgtgtttttatttgttgggttgggtgat

SEQ ID NO: 14996 - DNA, 201 bp, synthetic construct
  misc_feature 1..201: note = Description of Artificial Sequence: Synthetic polynucleotide
  source 1..201: mol_type = other DNA
tttgtggggtttgtttgtttttttagttgttgttttttgggtggtgtttgttggtgttgatttttataatttattttttttagatagagtttttttttgttgtttaggttggagggaagtggtatgattttagtttattgaaatttattttttttgggtttaagtgatttttatttttgtttttggagtagttgggattat

SEQ ID NO: 14997 - DNA, 201 bp, synthetic construct
  misc_feature 1..201: note = Description of Artificial Sequence: Synthetic polynucleotide
  source 1..201: mol_type = other DNA
ttattttagttttttgagtagttgggattataggtttgtgttattatgtttagtttattttttattttattttatttttatttttattttttttttgagatggagttttgttttgttgtttaggttggagtgtagtggtgggattttggtttattgtaagttttgttttttgggtttatgttatttttttgttttagtttt

SEQ ID NO: 14998 - DNA, 201 bp, synthetic construct
  misc_feature 1..201: note = Description of Artificial Sequence: Synthetic polynucleotide
  source 1..201: mol_type = other DNA
aaatggtgatttagaggttgtttttatttgatgggtttttttagttgaagatgtttagttaatgaattttaagtagatttatggttgggtgtgaagttaatggagtttttattttgtggagatgagtagtataaatttttgtttttaatgtttaatgatatgtaaaatatttaaatttgtaatgtagaattattaagttgt

SEQ ID NO: 14999 - DNA, 201 bp, synthetic construct
  misc_feature 1..201: note = Description of Artificial Sequence: Synthetic polynucleotide
  source 1..201: mol_type = other DNA
ggtaggtggattattttagtttaggagtttgagattagtttgggtaatatggtaaaattttatttttataaaaaatataaaaattagttggttatggtgttgtgtatttgtagttttagttattagggagattgaggtgggagggttatttaagtttgggagaggtgggtgtggtggaggttgtagtgagttaagatgtat

SEQ ID NO: 15000 - DNA, 201 bp, synthetic construct
  misc_feature 1..201: note = Description of Artificial Sequence: Synthetic polynucleotide
  source 1..201: mol_type = other DNA
tagattgatagattttttttttttttgagatggagttttgtattgttatttgggttggagtgtagtggtgtaattttggtttattgtaatttttttaatttgtgtttaagtaatttttttgttttagttttttgagtagttgggattatagggtgtgttattatgtttggttaattttttgtatttttagtagagatgggg

SEQ ID NO: 15001 - DNA, 201 bp, synthetic construct
  misc_feature 1..201: note = Description of Artificial Sequence: Synthetic polynucleotide
  source 1..201: mol_type = other DNA
ttttgggtggtaaggattttatggtgttggtatatgtgttgtgtatgttggtattgggtttgggtattttattgtagtttatggttgtagataagggtattgggtgtggtttagtgggaggattttagtaaggagttggggaaatatgtatgtgtttatttagggttggagtttattgaaggtttatgtgggtagtatgtg

SEQ ID NO: 15002 - DNA, 201 bp, synthetic construct
  misc_feature 1..201: note = Description of Artificial Sequence: Synthetic polynucleotide
  source 1..201: mol_type = other DNA
tggtttattgtaatttttattttttgggtttaagtgatttttttgttttagttttttgagtagttaggattataggtatgtattattatttttggttaattgttgaatttttagtagagatggggttttattatgtttgtaaggttggttttgaatttttgattttaggtgatgtttttatgttggttttttaaagtgtta

SEQ ID NO: 15003 - DNA, 201 bp, synthetic construct
  misc_feature 1..201: note = Description of Artificial Sequence: Synthetic polynucleotide
  source 1..201: mol_type = other DNA
tggttttttaaagtgttgagattataggtgtgagttattgtgtttggtttattttaggtgatttattttttttagttttttaaagtgttgagattataggtgtgagttattatgttgggtttattttaggtgatttattttttttggttttttaaagtgttgagattataggtgtgagttattgtgtttggtttattttag

SEQ ID NO: 15004 - DNA, 201 bp, synthetic construct
  misc_feature 1..201: note = Description of Artificial Sequence: Synthetic polynucleotide
  source 1..201: mol_type = other DNA
gatttgagaattgtttgtattagtttggttttttgtatagtgtttgtgttggtgtatattttagaggggagttgtgttattagatgaattaggattttggtggaggaagggggtgttggtagggtttttatggtatttgttgtttgtggttgaggggagtttggaagggtattagttttatttatttttggttgagatttt

SEQ ID NO: 15005 - DNA, 201 bp, synthetic construct
  misc_feature 1..201: note = Description of Artificial Sequence: Synthetic polynucleotide
  source 1..201: mol_type = other DNA
tttggtatatttagagtatattggggttggggtagatggtggtatttgttttggttggaggagttgggagggttggggaagggatgtgtgattttttttttgataaatttggatgagatgttaagtataatatagaggttggtggtggggtttttttttgtttttggtggattaatttattgtgggattttgggtaatttt

SEQ ID NO: 15006 - DNA, 201 bp, synthetic construct
  misc_feature 1..201: note = Description of Artificial Sequence: Synthetic polynucleotide
  source 1..201: mol_type = other DNA
ttaaaaaatatatatggttgggtgtggtggtttatgtttgtaattttagtattttgggaggttgaggtgggtggattatgaggttaggagattgagattatggtgaaattttgtttttattaaaaaaatataaaaaattagttgggtgtagtggtgggtgtttgtagttttagttgtttgggaggttgaggtaggagaatg

SEQ ID NO: 15007 - DNA, 201 bp, synthetic construct
  misc_feature 1..201: note = Description of Artificial Sequence: Synthetic polynucleotide
  source 1..201: mol_type = other DNA
atggttatatggtagggtttttgttgtttttattgttgttagtttagttgtttgttattttttttagtggtgtttttgttattaatgggttttttataattgatttggtttatgggttgtagatgttgtggattattggtgtggggaagtatgagtttattgatttggggtattttagaggtaagttttgttgttatgtgt

SEQ ID NO: 15008 - DNA, 279 bp, synthetic construct
  misc_feature 1..279: note = Description of Artificial Sequence: Synthetic polynucleotide
  source 1..279: mol_type = other DNA
gggtttgggtttgttaggtgtagaataaggagaaaggggtagaggggaagagttgggttgaattttagtgagggatttggttttttttggaggagaggattgtatttgtgttaggagtatggatttatttagggagtgtttgggtggagaagtagtttttgttttaggttttttgttgtggtatttaaagaggttgggtggtttagaggtttgtaagttatgtttttttttaggttttgtttttgtttggttattttttttgttgttagtttttttatt

SEQ ID NO: 15009 - DNA, 201 bp, synthetic construct
  misc_feature 1..201: note = Description of Artificial Sequence: Synthetic polynucleotide
  source 1..201: mol_type = other DNA
ttggttgttatgaaattataaattatgtttatagaaattttagtttgagaaagaatttagatttttttttttttttttttttttttttgagattgagttttgttttgttgtttaggttggagtgtagtgatgttattttggtttattgtgagttttgttttttgggtttatgttattttttggttttagttttttgtgtag

SEQ ID NO: 15010 - DNA, 201 bp, synthetic construct
  misc_feature 1..201: note = Description of Artificial Sequence: Synthetic polynucleotide
  source 1..201: mol_type = other DNA
ttgggggtggggtggggtggggtggggtggggtgggggggtggggttgaggtaggagaatggtgtgaatttgggaggtggagtttgtagttagttgagattgtgttattgtattttaatttgggtgatagtgattttattttaaaaaataataataataaaaaagaataaagattttataggtattttttttatagtagag

SEQ ID NO: 15011 - DNA, 201 bp, synthetic construct
  misc_feature 1..201: note = Description of Artificial Sequence: Synthetic polynucleotide
  source 1..201: mol_type = other DNA
ggggttttattgtgttagttaggatggttttggttttttgatgttgtgatttttttatttaggttttttaaagtgttgggattataggtgtgagttattgtgtttggtttagttttttatttttaataagtttttaggtgatgtttatgttggtagttttttgagattattatattttaagttttagggtgttagaaaaac

SEQ ID NO: 15012 - DNA, 201 bp, synthetic construct
  misc_feature 1..201: note = Description of Artificial Sequence: Synthetic polynucleotide
  source 1..201: mol_type = other DNA
tgttgttgttgtttttaagttggagttttgttttgttatttaggttgtagtgtagtggtatgattttggtttattataattttggttttttgggttttagtgatttttttgttttagttatttaagtagttgggtttataggtgtatgttattatgtttggttaatttttgtatttttaggagagataggtttttattatg

SEQ ID NO: 15013 - DNA, 201 bp, synthetic construct
  misc_feature 1..201: note = Description of Artificial Sequence: Synthetic polynucleotide
  source 1..201: mol_type = other DNA
aattgagttgtggaatggggttttgtggagtaggttgagtgtgttggttgtggatgggttgtgggtgggattttttagtgtgttattattgaggtatttttgtttttttatgtgtttttgtttttttttttagaagtttaatatttttgagaggatttaaaatatagagtgattagtttttatgtgtattttttggataaa

SEQ ID NO: 15014 - DNA, 201 bp, synthetic construct
  misc_feature 1..201: note = Description of Artificial Sequence: Synthetic polynucleotide
  source 1..201: mol_type = other DNA
aggggagatgaagaaggagggggtagtttgtttaggaggttaggggggtatttgtgtttggtttaggtttattgatgtagatattattgatatttatgtttgtgttgtgttttttgtggtgtttgtggttgttaatgttatttattgggtggtatatgttatgtgagtataggatttaggttatttttgtttgttttggtg

SEQ ID NO: 15015 - DNA, 201 bp, synthetic construct
  misc_feature 1..201: note = Description of Artificial Sequence: Synthetic polynucleotide
  source 1..201: mol_type = other DNA
ttatatattttatgtgttttgtttattatgaggtttgtattttttgggtagtaggtgttgtgtgtttttgggtattttgtaggtggagttgttggtgtagtgtagtattttgtgtttttgatgttggttttggatttagttgttgttgtatttgttattgtttttgggggatatatgtatggagtttatttttaatagggg

SEQ ID NO: 15016 - DNA, 201 bp, synthetic construct
  misc_feature 1..201: note = Description of Artificial Sequence: Synthetic polynucleotide
  source 1..201: mol_type = other DNA
tttattataaatataaaaaattagttgggtgtggtggtgggtatttgtagttttagttatttggaaggttgaggtaggaaaatgatgtgaatttgggaggtggagtttgtagtgagttgagattgtgttgttgtatttaagtttgggtgatagagtgagattttgggttaaaaaaaataaaagaatatagggtatggtatt

SEQ ID NO: 15017 - DNA, 201 bp, synthetic construct
  misc_feature 1..201: note = Description of Artificial Sequence: Synthetic polynucleotide
  source 1..201: mol_type = other DNA
tagagtagttgggattataggtgtttattgttatgtttggtttatttttttttgtatttttagtagagatggggttttattgtgttagttaggatggttttgattttttgatgtgatttatttgttttggttttttaaagtgttgggattataggtgtgagttattgtgtttggtttatttatgtgttttttgggaagggg

SEQ ID NO: 15018 - DNA, 201 bp, synthetic construct
  misc_feature 1..201: note = Description of Artificial Sequence: Synthetic polynucleotide
  source 1..201: mol_type = other DNA
aggtgtttgttattatgtttggttaattttttgtatttttagtagagatggggttttattatgttagttaggatggttttgattttttgattttgtgatttgtttattttgtttttttaaagtgttgggattataggtgtgagttattgtgtttggttgttttttggtatattttttatttttagtatgtggtttttatat

SEQ ID NO: 15019 - DNA, 203 bp, synthetic construct
  misc_feature 1..203: note = Description of Artificial Sequence: Synthetic polynucleotide
  source 1..203: mol_type = other DNA
gttggttatggaaggttatagttttgtagatggtgttggtggagtttggggtagggtattttgagtttgggaaggtttggggtgaaggtttggaggttggtgtgtaggaggttaaagtagtagggaggtttggggagagttaggtggggttgtgttttttatgttgtaggttgtgtttatagatggtgaaagatgttgtggaa

SEQ ID NO: 15020 - DNA, 201 bp, synthetic construct
  misc_feature 1..201: note = Description of Artificial Sequence: Synthetic polynucleotide
  source 1..201: mol_type = other DNA
ttttaagtagttgggattataggtgtttattattatgtttggttaatgtttttgtttttttagtagagatggggttttattgtgttagttaggatggttttgattttttgattttgtgatttttttgttttggttttttaaagtgttgggattatagtaattatttgatggtgtgagttattgtgtttggttatgtatgat

SEQ ID NO: 15021 - DNA, 201 bp, synthetic construct
  misc_feature 1..201: note = Description of Artificial Sequence: Synthetic polynucleotide
  source 1..201: mol_type = other DNA
tttatttttgtgaaaatttttgtgtttgaaaattattgtaaaatatttggaattattattattatttatttttattttttgagatggagttttgttttgttgtttaggttggagtgtagtggtgtgattttggtttattgtaagttttgttttttgggtttatgttatttttttgttttagttttttgagtagttgggatt

SEQ ID NO: 15022 - DNA, 201 bp, synthetic construct
  misc_feature 1..201: note = Description of Artificial Sequence: Synthetic polynucleotide
  source 1..201: mol_type = other DNA
ttggtgagagataaggtatttagggaaagaagaaaaaagtttaggaagggattttagtttgttagatttggggtagaagttttttttggatgagtttttatggagaaatttaaatattaggggttttggaaggttggaagtttttaagttgtttaggaaaagattaaagagatataaattataaaagttttgggattttta

SEQ ID NO: 15023 - DNA, 201 bp, synthetic construct
  misc_feature 1..201: note = Description of Artificial Sequence: Synthetic polynucleotide
  source 1..201: mol_type = other DNA
gttattgattttgagtttttgtttttttatttataaaattgagattagggttgggtatggtggtttatttttgtaattttaatattttgggaggttgaggtgggtggattatgaggtgaggagtttgagattagtttgattaatatggtgaaattttgtttttattaaaaatataaaaattagttgggtgtggtggtgtgt

SEQ ID NO: 15024 - DNA, 201 bp, synthetic construct
  misc_feature 1..201: note = Description of Artificial Sequence: Synthetic polynucleotide
  source 1..201: mol_type = other DNA
gtatgtttattgtagaattatttataatagtaaagatatggatagattggattaagaaaatgtggtgtatatatatatatgttatggaatattatgtagttgtaaaaagaataaaatttggttttttgtagtaatatggatgtagttggaggttattatttggagtgaattaatataggaatagaaaattaaatattgttt

SEQ ID NO: 15025 - DNA, 201 bp, synthetic construct
  misc_feature 1..201: note = Description of Artificial Sequence: Synthetic polynucleotide
  source 1..201: mol_type = other DNA
ttttagttttgtgattggttttttgttttgtgttgatatttagtattttttttggtttttgttttgaggggaaaataaaataggggtttttaggttttattgttggtttattttattgtagtaaattgattgagggttttttgttgtgtttttgtggtttgttgttttatttagtggttttgatatttggtatttatttaa

SEQ ID NO: 15026 - DNA, 201 bp, synthetic construct
  misc_feature 1..201: note = Description of Artificial Sequence: Synthetic polynucleotide
  source 1..201: mol_type = other DNA
gtgggtggattatgaggttagtagattgagattattttggttaatatggtgaaatttagtttttattaaaaatataaaaaattagttgggtgtggtggtatgtgattgtagttttatttattggggaggttgaggtaggagaattgtttgaatttgggaggtggaagttgtagtgagttgagattgtgttattgtattttc

SEQ ID NO: 15027 - DNA, 201 bp, synthetic construct
  misc_feature 1..201: note = Description of Artificial Sequence: Synthetic polynucleotide
  source 1..201: mol_type = other DNA
ttttattttttagttagttttttgtgtagtgtttagggttttggtagttaggatagagtgagtaaaagaagatggatagtggatagggtgtagtggtttatgtttgtaattttagtgttttgggagagtgaggtgggtagattataaggttaagagattaagattattttggttaatatggtgaaattttgtttttattaa

SEQ ID NO: 15028 - DNA, 201 bp, synthetic construct
  misc_feature 1..201: note = Description of Artificial Sequence: Synthetic polynucleotide
  source 1..201: mol_type = other DNA
aaggtaggtggattatggggttaggagtttgagattagtttggttaatttggtgaaaatttgtttttattaaagatataaaaattagttgagtgttgtggtgtatgtttgtaattttagttattggggaggttgaggtaagagaattatttgtaattgggaggtggaggatgtagttagtgagatggtgttattgtatttt

SEQ ID NO: 15029 - DNA, 201 bp, synthetic construct
  misc_feature 1..201: note = Description of Artificial Sequence: Synthetic polynucleotide
  source 1..201: mol_type = other DNA
atttagggggttgaggtaggagaattgtttgaatttgggaggtggagtttgtagtgagttgagattgagttattgtatattttagtttgggtaataagagtgagatttagttttagaaaaaataaataaataataaaataaaaagtaggttgggtgtgatggtttatatttataatattagtattttgggaggttgaggtg

SEQ ID NO: 15030 - DNA, 3238 bp, synthetic construct
  misc_feature 1..3238: note = Description of Artificial Sequence: Synthetic polynucleotide
  source 1..3238: mol_type = other DNA
tagaatgttaggtgtgaaaggtgatgttgaggtagtatgagggaaaaagtagtaggtagtgattgttatatggatgatagtgtttttttggtagtttttgtgttagatttggggttgttgtggagtttttgatttgaatttagggtgtgtgttgtgtttatggggggatattttaaagtggtaagaatgttttttgggaagggaataggatgttaggtttgaaaggggattttgaagtagtttaggaaaaaattttttatggattatggtgtttttttggtagtttttttgttaggtttgagggggttgttgtgttttaggtttgtatttagggttttatggggggtattttaaagtggtaagtaggtttttaggggaaggggatagtatgttaggtttggagggggatgttgaggtagttttgggaataaagaggggatgttggggttttgttatggataatattgtttttttgatagtatttgtggtgggtttgggagtgttatggagtttttggtttgtatttaaggtgtgtgttttgtttttggggggtattataaagtggtaagaaggttattgggggaagggtatgggatgttagggttgaaagggatagttgaggtagtttggggaaaaatgtggtaggttggggttgttttatggatgatagtgtttttttagtagtttttgtgttaggtttggggtggttgtggagtttttggtttgtattgagggtgtgggttgtatttatgggggtattttaaagtggtaagaaggttgttgggtgaatgttatagaaggttaggttttaatggggatgttgaggtagtatagagagaaaagtggttagttgggttttttttatggatgatagtgtttttttggtagtttttgtgttgggtttggggggattgtggagtttttattttgtatttagggtgtgtgttttgtttatgggaggtattttaaagtggtaagtaggtttttgggggaaggggatagtattttagatttgaagggggattttgaggtagtttgtggaaaaaaatggtgatgttgagttttttttataaatgatagtgtttttttggtagtttttttgttgggttagggtggttttggagtttgtggtttgtatttagggtgtgtgttttgtttaagggggtattttaaagtggtaagtagatttttgggggaagggagagtatgttaggtttgaaggggaggttgaggtggttttggggtaaaagtggtgaagttggggtttttttatggatgatattgtttttttggtagtttttgtagtgggtttagaggtgttgtggagtttttggtttgtttttaggttgtgtgttttgtttatgagtggtattataaagtagtaagaaggtttttaggggaagggtataggattttagggttgaaaggtagagttgaggtagattggtgttattttaaggataatagtgttttgtttggtagtttttgtattgggtttggggtggttgtggagtttttggtttgtatttggggtgtgtgttgtgtttatgatgggtattgtaatgtggtaagaagtttttgagtggaagggaataggatgttgagtttgaaaggggatgttgaggtagtttggggaaaaaatttttattgagaatagtgtttttttggtagtttttgagtgggatttaggtggatggtggagtttttggtttggatttagggtgtttgttttgtttatggggtgtatgtgaaagtggtaatagggtttttgggggaaggggataatatgttaggtttgaagagggatgttgggttagttagaggaaaatagtggttaggttgtggttgttttatagattatagtgtttttttggtagtttttgagtttggtttaggtgggggggtttggagtttttgttttgtaatagagtgtgtgttttgtttaagtgtgtatgtgaaagttgtaagaagggttttgggggaagggaataggatgttaggtttgaaaggggattttgaggtagtttagggaaaaattttttatggaggatagtgattttttgatattttttgtgtttggttttgggggttttggagtttttggtttatatttagggtgtgtgttttgtttatgggtggtattttaaagtagtaagaaagttttggggggggaagaataggatgttagatttgaaaggggatgttgaggtagtttaggaaaaaaaggggtgaggttggggtttttttatggatgatagtgttttttttatagtttttatgttagttttgggagggttgtggagtttttgttttgtatataatgtgtgtgttttgtttatggggggtattttaaagtggtaagaagttttttgtgggaaggtaataggatgttaggtttgaatggggatgtttaggtagtttggagaaaaaagtagtgaggttggggtgattttatgaatgatagtgttttattggtagtttttttgttgggtatgtgggggttgttgattttttggtttgtatttagggtgagtgttttgtttatggtgggtattataaagtagtaagaaggtttttgggggaaagggatagtatgttagttttgaagggggaagttgaggtagttttggggaaaaaaagtggggatgttggggtttttttatggatgatattgtttttttagtagtttttgtagtgggtttgggagtgttttggagtttttgttttgtattttgggtgtgtgttttatttatggggagtattataaagtggtaagaaggttattgggggaagggtataggatgttagggttgaaggggatagtggagatagtttaaggaaaaaagtggtgggatggtgttgttttaaggatggttatttttgtgttgggttagggatggttgtggagtttttggtttgtatttaggttgtgtgttttgtttatagggggtattttaaagtagtatgaaggtttttaggggaagggaagaggatgttaggtttggaaggtgatgttgaggtagtagggggtaaaaagtggtgggttgggtttttttatggatgatagtgtttttttggaagttgttgtgtagggtttggtgtgtttgtggagtttttggtttgtatttagaattgtgtggtgtttatgatgggtattttaaagtggtaagatattttttgttggaagggaataggatgttaggtttgaaaggagaagttgagttagtttggggaaaaa

SEQ ID NO: 15031 - DNA, 201 bp, synthetic construct
  misc_feature 1..201: note = Description of Artificial Sequence: Synthetic polynucleotide
  source 1..201: mol_type = other DNA
ttaaggttattattttaaagtgttttagaaaataatatatagaaggttgggtgtggtggtttatgtttgtaattttagtattttgggaggttgaggggggtggattatgaggttaggagattgagattattttggttaatatggtgaaattttgtttttattaaaaatatatatatataaaattagttgggtgaggtggta

SEQ ID NO: 15032 - DNA, 201 bp, synthetic construct
  misc_feature 1..201: note = Description of Artificial Sequence: Synthetic polynucleotide
  source 1..201: mol_type = other DNA
ttattatttatttattattttgtttgtaatttgggttattatttattagtaatttgatgattaatatgttttattttagtaggtgtgtaaggtgtgggggtggatataaagattgtggtttttggagaggatggttagggggttgtttttgtaagtgttttttaaaataattggttattgtttttgagtgtttgggtgttg

SEQ ID NO: 15033 - DNA, 201 bp, synthetic construct
  misc_feature 1..201: note = Description of Artificial Sequence: Synthetic polynucleotide
  source 1..201: mol_type = other DNA
atggtgattagaaatgtattaaattttgaatgtataaaagagagagttttaatatgaaatagtaattttttgagaatgaagattttgtagtgttggtgtttgttgggttgtgtaggttttggttgttttatgtttgtgtttgtttttattgtgatttttttgtttttggtatgtttagggttaatttttgggtttattgta

SEQ ID NO: 15034 - DNA, 201 bp, synthetic construct
  misc_feature 1..201: note = Description of Artificial Sequence: Synthetic polynucleotide
  source 1..201: mol_type = other DNA
tttggggattattttgtttttttgttttgattttttttttttttttttttttttttttgagatggagttttgttttgttgtttaggttggagtgtagtggtgtgattttggtttattgtaagttttattttttgggtttatattatttttttgttttagttttttgagtagttgggattataagtatttgttattatgttc

SEQ ID NO: 15035 - DNA, 201 bp, synthetic construct
  misc_feature 1..201: note = Description of Artificial Sequence: Synthetic polynucleotide
  source 1..201: mol_type = other DNA
tttttgggatggggggatttttaggtatttttgggttttgagttgggttgttagggttgtttgttttttgttgttttttttgggttgagttttgtttttgtgttttgtagtggagtagttgtttttaaaggtgtatgtgattagggtgtggttgggatagtgggtatttttttgggttttagtgttgtgtgtgttttggtc

SEQ ID NO: 15036 - DNA, 201 bp, synthetic construct
  misc_feature 1..201: note = Description of Artificial Sequence: Synthetic polynucleotide
  source 1..201: mol_type = other DNA
tggtgtttggtatgaaattttttttttttttttgagatagagttttgtttttgtgtttaatttggagtgaagtggtatgattttggtttatggtaatttttgttttgtaggattaagttattattttgatttagttttttgagtagttgggattataggtatttattattatggttggttaatttttgttttttgtttttt

SEQ ID NO: 15037 - DNA, 201 bp, synthetic construct
  misc_feature 1..201: note = Description of Artificial Sequence: Synthetic polynucleotide
  source 1..201: mol_type = other DNA
aagtagttttttaaaattttaaaaagtaagtatagttttaggaaggagggaggttagtgaaattaaatttttgttgataagtttaaagtaattggtaagatgttgggaaattagatattgaaatatttgtttttaatttttaatttgttattatttgaaataaagttattagggatagttgggtgtggtggtttatgtttg

SEQ ID NO: 15038 - DNA, 201 bp, synthetic construct
  misc_feature 1..201: note = Description of Artificial Sequence: Synthetic polynucleotide
  source 1..201: mol_type = other DNA
atttattgaagaagttgaagtgtgaagtgtgaaattgaagaattttgaaatgtattgagtagtgaaaagattatgtatataaaaataggttggttgggtgtggaggtaggtagattatttgaggttaggaggtgtgattttggtttattgtaagttttattttttgtgtttatgttatttttttgttttagtttttggagt

SEQ ID NO: 15039 - DNA, 201 bp, synthetic construct
  misc_feature 1..201: note = Description of Artificial Sequence: Synthetic polynucleotide
  source 1..201: mol_type = other DNA
attttgggaggttaaggtaggtggttgggaggtgtaggttgtagtgagttgagattatgttattgtattttagtttgggtattattgagtattgagtgaatgagattttgtttgtaattttggtattttgggaggttgaggttggtggattatttgtggttaggggttggagattggtttggttaatatagtgaaattttg

SEQ ID NO: 15040 - DNA, 201 bp, synthetic construct
  misc_feature 1..201: note = Description of Artificial Sequence: Synthetic polynucleotide
  source 1..201: mol_type = other DNA
gtggtgtaattttggtttattgtaagttttgttttttaggtttatgttatttttttgttttagttttttgagtagttggtattataggtgttgattattatgtttggttaattttttgtattttttgatagagatggggttttattgtgttatttaggatggttttgatattttgattttgtgatttgtttgttttggttt

SEQ ID NO: 15041 - DNA, 201 bp, synthetic construct
  misc_feature 1..201: note = Description of Artificial Sequence: Synthetic polynucleotide
  source 1..201: mol_type = other DNA
ggtgggygggttaygaggttaggatatygagattattttggttaatayggtgaaatttygtttttattaaaaatatagaaaattagtygggtatgttggygggtatttgtaagttttagttattygggaggttgaggtaggagaatggygtgatttygggaggyggagtttgtagtgagtygagattaygttattgtattt

SEQ ID NO: 15042 - DNA, 208 bp, synthetic construct
  misc_feature 1..208: note = Description of Artificial Sequence: Synthetic polynucleotide
  source 1..208: mol_type = other DNA
tttatttatttatttttgagatagagtttygttttgtygtttaggttggagtgtagtggtgtgatttyggtttattgtaagtttygtttttygggtttaygttattyggttttagtttttygagtagttgggattataggygttygttattaygttyggttaattttttatatttttagtagagatagggttttattatgttagttag

SEQ ID NO: 15043 - DNA, 201 bp, synthetic construct
  misc_feature 1..201: note = Description of Artificial Sequence: Synthetic polynucleotide
  source 1..201: mol_type = other DNA
ttttttttttttttttttttttttttgagayggagtttggttttgttgtttaggttggygtgtagtggtttattgtatttttygtttttygggtttaagygatttttttattttagttttttaagtagttggggttaaaggtttgtgttattatgttyggttaattttttgtattttagtagagayggggttttatygtgt

SEQ ID NO: 15044 - DNA, 201 bp, synthetic construct
  misc_feature 1..201: note = Description of Artificial Sequence: Synthetic polynucleotide
  source 1..201: mol_type = other DNA
tygtggtgtaattttagtttattgtaatttttgtyggtagggtttaagtaatttttttgttttagtttttygagtagttgggattataggtaygtattaygatgttyggttaatttttgtatttttagtagagatggggttttattatgttgattaggttggttttgaatttttgattttaggtgattygtttatttyggt

SEQ ID NO: 15045 - DNA, 201 bp, synthetic construct
  misc_feature 1..201: note = Description of Artificial Sequence: Synthetic polynucleotide
  source 1..201: mol_type = other DNA
gtgggttttaaatattttataagttagagtaattagaatagtatggtattggtataaagataggtatatagtttgttyggtttygtttygttttgtygtygygtttgttagttatgagttttatgtagttaaataaaggtttttttgtggatttttggttgaggttaagaatyggtttttgtttaaatatgatttttagaa

SEQ ID NO: 15046 - DNA, 201 bp, synthetic construct
  misc_feature 1..201: note = Description of Artificial Sequence: Synthetic polynucleotide
  source 1..201: mol_type = other DNA
tattgatttggaagaayggaatgatagttagtgaggtatatttagtaatygagtayggttagtgtyggttttyggttttygagatattgatttaygtagygttaggattyggggattttttaggtgtaaattagaggttaaatagtttgtttggttaatgggttagaatttgtggttgaatagaggttttgttgtggtttt

SEQ ID NO: 15047 - DNA, 201 bp, synthetic construct
  misc_feature 1..201: note = Description of Artificial Sequence: Synthetic polynucleotide
  source 1..201: mol_type = other DNA
ttatttttgggggatgagaggagggatggtgagaggatatttttaaagaatatttggggtyggggaagaattttttatgatttygttttataatttggtygtttattttgtattttgttgtaygttgttyggtttttggttatgttatgtgaatttttggagttattttttttttttttttatttggatggagagggtttt

SEQ ID NO: 15048 - DNA, 201 bp, synthetic construct
  misc_feature 1..201: note = Description of Artificial Sequence: Synthetic polynucleotide
  source 1..201: mol_type = other DNA
tttaatagatatgaaaattgaaggtygggygtagtggtttaagtttgtaattttagtattttgggaggtygaggygggyggattaygaggttaggagatygagattattttggttaatatagtgaaatttygtttttattaaaaatattaaaaattagtygggygtggtggygggygtttgtagttttagttatttgggag

SEQ ID NO: 15049 - DNA, 201 bp, synthetic construct
  misc_feature 1..201: note = Description of Artificial Sequence: Synthetic polynucleotide
  source 1..201: mol_type = other DNA
ttgaatagttgggattataggygtttgttatygygttyggtttattttttgtgtgtttttagtagagayggggttttatygtgttagttaggatggtttygattttttgatttygtgattygttygtttyggttttttaaagtgttgggattataggtttgagttatygygttyggttaaaataattaatttttgtgttaa

SEQ ID NO: 15050 - DNA, 201 bp, synthetic construct
  misc_feature 1..201: note = Description of Artificial Sequence: Synthetic polynucleotide
  source 1..201: mol_type = other DNA
ayggatttttgyggtgagtgttatagtttttaaaggtggygtgttyggagtttgttttttttgatgttyggatgtgttyggagttttttttggtgggttygtggttttgtyggtttaggagtgaatttgtagatttttgyggtgagtgttatagtttataaaggtagtgtggatttatagagtgaatagtagtaagattta

SEQ ID NO: 15051 - DNA, 201 bp, synthetic construct
  misc_feature 1..201: note = Description of Artificial Sequence: Synthetic polynucleotide
  source 1..201: mol_type = other DNA
tattaaaaataaagaaggaggtygggygyggtggtttaygtttgtaattttagtattttgggaggtygaggtgggyggyggattaygaggttaggagatygagattayggtgaaatttygtttttattaaaaatataaaaaattagtygggygyggtggygggygtttgtagttttagttattgggaaggttgaggtagga

SEQ ID NO: 15052 - DNA, 201 bp, synthetic construct
  misc_feature 1..201: note = Description of Artificial Sequence: Synthetic polynucleotide
  source 1..201: mol_type = other DNA
gttaagatagygttattgtattttagtttgggaatagagygagatttygttttaaaaaaaaattattgatatatataaatatttgtgaaattggttgggygyggtggtttaygtttgtaattttagtattttggggggtygaggygggygtattataaggttaggagatygagattattttggttaatayggtgaaatttt

SEQ ID NO: 15053 - DNA, 235 bp, synthetic construct
  misc_feature 1..235: note = Description of Artificial Sequence: Synthetic polynucleotide
  source 1..235: mol_type = other DNA
gtttatagtttttagagagagygaygtagaagatgggtgatttttgtatttttatttgaggtatygggtttattttattagggagtgttagatagtgggygtaggttagtgggtgygygtattttgygtgagtygaagtagggygaggtattgttttatttyggaagtataaggggttagggagtttttttttttagttaaagaaaggggtgatagayggtatttggaaaattgg

SEQ ID NO: 15054 - DNA, 201 bp, synthetic construct
  misc_feature 1..201: note = Description of Artificial Sequence: Synthetic polynucleotide
  source 1..201: mol_type = other DNA
tttygagtagttggygttataggygtttattattaygttyggttaattttttgtatttttagtagagatagggttttattatgttagttaggatggtttygattttttgatttygtgattygttygttttggttttttaaagtgttgggattataggtatgagttatygyggtyggttttaattatgtatttttatttatt

SEQ ID NO: 15055 - DNA, 201 bp, synthetic construct
  misc_feature 1..201: note = Description of Artificial Sequence: Synthetic polynucleotide
  source 1..201: mol_type = other DNA
ttgattatttaggtgygtttgttatttttttttttgattyggaaagggaattttttgtttttttgygttttttaagtgaggtaatgtttygttttgtttyggtttgygtatggtgtaygtatttattgattygygtttattgtttggtattttttagtgagatgaattyggtattttagatggaaatgtagaaattatttg

SEQ ID NO: 15056 - DNA, 201 bp, synthetic construct
  misc_feature 1..201: note = Description of Artificial Sequence: Synthetic polynucleotide
  source 1..201: mol_type = other DNA
tgggtygttgggtgttygggttgtttttttattgtttaggataaattttatttygttttatyggtygatggtttgtyggggagttygygggygagtyggygtttgtaggtgtgtttttttgttgatatgtttttygtgattagtygtttttgtttttttttattgatgygtttttttygttttttagtagtttttgttttt

SEQ ID NO: 15057 - DNA, 201 bp, synthetic construct
  misc_feature 1..201: note = Description of Artificial Sequence: Synthetic polynucleotide
  source 1..201: mol_type = other DNA
tatttggttyggagggttttatgtttatygagttttgttgattgttagtatagtagtttgagattaaattgtaaggtagtagygaggttgggggaggggygttygttattgtttaggttygtttaggtaaataaagtagtygggaagttygaattgggtggagtttattatagtttaaggaggtttgtttgtttttgtagg

SEQ ID NO: 15058 - DNA, 201 bp, synthetic construct
  misc_feature 1..201: note = Description of Artificial Sequence: Synthetic polynucleotide
  source 1..201: mol_type = other DNA
tygttttgtagtttgattttagattgttgtgttagtaattagygagattttgtgggygtaggattttttgagttaggtgtyggatataatttttaggtgygtygttttttaagttygtyggaaaagygtagtattttggtgggagtgattygattttttaggtgttttttgttatttttttttttgattaggaaagggaat

SEQ ID NO: 15059 - DNA, 201 bp, synthetic construct
  misc_feature 1..201: note = Description of Artificial Sequence: Synthetic polynucleotide
  source 1..201: mol_type = other DNA
agygaygtagaagaygggtgatttttgtatttttatttgaggtatygggtttattttattaagggagtgttagatagtgggygtaggttagtgggtgygygtatygtgygygagtygaagtagggygaggtattgttttatttgggaagtataaggggttagggagtttttttttygagttaaagaaaggggtgayggayg

SEQ ID NO: 15060 - DNA, 201 bp, synthetic construct
  misc_feature 1..201: note = Description of Artificial Sequence: Synthetic polynucleotide
  source 1..201: mol_type = other DNA
tattaggatattttggttgtagagaggagttatttatygygagttttttttgagttgttttattatttagtaaagtttttttttattttgtttatttttygtttgtttaygtaygttattgttttygggygttgaatttgttaaatggtggaggtgaaagagttttaatataaatagagttgaaataygttttttgtttgt

SEQ ID NO: 15061 - DNA, 201 bp, synthetic construct
  misc_feature 1..201: note = Description of Artificial Sequence: Synthetic polynucleotide
  source 1..201: mol_type = other DNA
gttggagtgtaatggtatgattttggtttattgtaatatttgtttttygggatttagtaatttttttgttttagtttttygagtagttgagattataggygattattattaygttyggttgatatttgtatttttagtagagayggggttttattatgttggttaggttggtttygaatttttgattttaggtgatttgtt

SEQ ID NO: 15062 - DNA, 201 bp, synthetic construct
  misc_feature 1..201: note = Description of Artificial Sequence: Synthetic polynucleotide
  source 1..201: mol_type = other DNA
tattgttggtattagtatttggaagaggggaatatygtggtttttgaaaatttggagtygttagtaattgaggagttttaaggagtgagaygggggtgtygttttattatttttttatttttgtagtyggtagttttgttagyggtgggggtygggttgaggggtggtggtatattaggggggtggtggtatatattatag

SEQ ID NO: 15063 - DNA, 201 bp, synthetic construct
  misc_feature 1..201: note = Description of Artificial Sequence: Synthetic polynucleotide
  source 1..201: mol_type = other DNA
gtttttyggtattattagtatttgggttttttggagyggaagtggttggtyggggatatgtagtttatagaggtttagatgaaaatttggttttaaaatygttagatgaaataygaayggtaaatgtaggatttatagttgaatagtttttttttggggtttttttaygygttygggttttttatttatygttttttggtt

SEQ ID NO: 15064 - DNA, 207 bp, synthetic construct
  misc_feature 1..207: note = Description of Artificial Sequence: Synthetic polynucleotide
  source 1..207: mol_type = other DNA
attagagtagaggggtttttttattttttgtttagttttttgatttggttttttattttttaggaaatatatttyggttygaggtttatttgttgtygtygtygtyggaggagttggttttgaaygagttggtgaygttgaygtgtttggtaygtggttttagttttaaggatgtgttggttygttggttgtaggggttataggagt

SEQ ID NO: 15065 - DNA, 201 bp, synthetic construct
  misc_feature 1..201: note = Description of Artificial Sequence: Synthetic polynucleotide
  source 1..201: mol_type = other DNA
atattaggggaagaagatataagygttggttatttataggagtattttagtagaaggataygttgataggtattyggaagttagtaggtygtggattagygggaggaggyggaggttggtttgggtagttaggggagagtyggggttgtygagtattttaattttaggggaaaattattttttttttggttgttttatggg

SEQ ID NO: 15066 - DNA, 201 bp, synthetic construct
  misc_feature 1..201: note = Description of Artificial Sequence: Synthetic polynucleotide
  source 1..201: mol_type = other DNA
tygattttttaggtgygttygttatttttttttttgattyggaaagggaattttttgattttttgygttttttaagtgaggtagtgtttygttttgtttygygtayggtgtaygtatttattgatttgygtttattgtttggtattttttagtgagatgaaatyggtattttagatggaaatgtagaaattattygttttt

SEQ ID NO: 15067 - DNA, 201 bp, synthetic construct
  misc_feature 1..201: note = Description of Artificial Sequence: Synthetic polynucleotide
  source 1..201: mol_type = other DNA
ttaygttttaggtatatygatattttygtattggttttttttaggaggttaygttttaggtataygggtatttttatattgattttttttagtaggttaygttttaggtataygggtatttttatattgatttttttygggaggttaygttttaggtataygggtatttttatattggttttttttaggaggttaygtttt

SEQ ID NO: 15068 - DNA, 201 bp, synthetic construct
  misc_feature 1..201: note = Description of Artificial Sequence: Synthetic polynucleotide
  source 1..201: mol_type = other DNA
gtttttttgttyggtygtttagtttgggaagtgaggagygtttttttttggtygttatttygtttaggaagtgaggagygtttttgttyggttatttatygtttgggatgtggggagtatttttgttaggtygygattttatttgggaattgaggagtgtttttgtttygttattattttatttgggaggtgaggagygtt

SEQ ID NO: 15069 - DNA, 201 bp, synthetic construct
  misc_feature 1..201: note = Description of Artificial Sequence: Synthetic polynucleotide
  source 1..201: mol_type = other DNA
gagggagaygyggggygggaattggggttgttygyggtaggttagagtaagttttgggtggatatggttttggygggttttatatttygagtagttggtygttttattagtttygggtagtgaggggtttattattygggatagtagttgtggagggtgygtygagttttttagtagtgttagttygtyggygttgtgttc

SEQ ID NO: 15070 - DNA, 201 bp, synthetic construct
  misc_feature 1..201: note = Description of Artificial Sequence: Synthetic polynucleotide
  source 1..201: mol_type = other DNA
tttgattaaaaataaataaatatggtygggtgyggtggtttaggtttgtaattttagtatttygggaggtygaggyggtggattataaygttaggagatygagattattttggttaatayggtgaaattttatttttattgaaaatataaaaaattagtygggygtggtggtgggtatttgtagttttagttatttaggag

SEQ ID NO: 15071 - DNA, 201 bp, synthetic construct
  misc_feature 1..201: note = Description of Artificial Sequence: Synthetic polynucleotide
  source 1..201: mol_type = other DNA
yggttagggggtatttttagaygtatagaagtttyggaggttatggtaagtttgtaatygggattygtttttaggtttataygtgtagttttttagttgygtaatttttttaaatggagtagttttggygtgggtggggttygggtyggtagtgggggyggggtyggtagtgggggyggggttagttgggggaggaggggg

SEQ ID NO: 15072 - DNA, 201 bp, synthetic construct
  misc_feature 1..201: note = Description of Artificial Sequence: Synthetic polynucleotide
  source 1..201: mol_type = other DNA
tatggygaaattttatttttattaaaaatataaaaattagttgggygtggtagtgtaygtttgtaattttagttatttgggaggttgaggtaggattatygtttgaattyggaaggtggaggttgtagtgaattaagagagyggttttgtattatagtttgaaygatagagtaagattttattttaaaataattaattaat

SEQ ID NO: 15073 - DNA, 201 bp, synthetic construct
  misc_feature 1..201: note = Description of Artificial Sequence: Synthetic polynucleotide
  source 1..201: mol_type = other DNA
attaygttyggttaattttttttttttgtatttttagtagagayggggttttatygtgttagttaggatggtttygattttttgattttataattygttygtttyggttttttaaagtgttgggatgataggtgggagttatygygttyggtttaatttagygttygatatttgaagaygatttgggttagaggagatygt

SEQ ID NO: 15074 - DNA, 201 bp, synthetic construct
  misc_feature 1..201: note = Description of Artificial Sequence: Synthetic polynucleotide
  source 1..201: mol_type = other DNA
agygagtygtygatgttagygagatgttaggttggatttagtaagtygtygatgttagttagaygtagagtagagaaygttggttaaagagtagttaggyggtgtttgttyggtygaagtttagtttyggagaggtaggttttgtattaggaygtggaggtttyggggttatgaaatttttagggtgagagataaaggtag

SEQ ID NO: 15075 - DNA, 380 bp, synthetic construct
  misc_feature 1..380: note = Description of Artificial Sequence: Synthetic polynucleotide
  source 1..380: mol_type = other DNA
tttttttttttttttttagayggagtttagttttgtttttatgttgtagggtagtggygyggtttyggtttattgtaattttygtttttygggttttygygatttttttgttttagtttttygagtagttgggattataggtataygttattaygtttagttaatttttgtttgtttgtttatttatttattattatttttgagayggagtttygttttgttattaggttggagtgttattggagtgtaatggtaygatttyggtttattgtaattttygtttttygggtttaagtaatttttttgttttagtttttygtgtaattgggattataggtaygtgttattatttttagttaattttttgtattttagtagag

SEQ ID NO: 15076 - DNA, 201 bp, synthetic construct
  misc_feature 1..201: note = Description of Artificial Sequence: Synthetic polynucleotide
  source 1..201: mol_type = other DNA
gagtgtaatggygygatttyggtttattgtaagtttygtttttygggtttaygttatttttttgttttagttttttaagtagttgggattagaggtgttygtygttaygtttagttaattttttgtatttttagtagagayggggttttatygtattagttaggatggtttygattttttgatttygtgattygttygttt

SEQ ID NO: 15077 - DNA, 201 bp, synthetic construct
  misc_feature 1..201: note = Description of Artificial Sequence: Synthetic polynucleotide
  source 1..201: mol_type = other DNA
tatagggtgtygaaattaagttatttagggagttygtagattttatttttttyggtgagagagtttggtggggagtattttatttaatgtagggaatagygttattgyggtttttatttttyggttttaagtgatttatttgtygtagttttttaagtagttgggattataggygygtgttattaygtygggttagttttt

SEQ ID NO: 15078 - DNA, 201 bp, synthetic construct
  misc_feature 1..201: note = Description of Artificial Sequence: Synthetic polynucleotide
  source 1..201: mol_type = other DNA
ttttttttttgggggtttttttatgttttatgtagtttatggtgtggggtttattggttttggyggggtggaaggttttatgtygtygtygttttaygtygtyggtggtgggggtttgttgggggttgggaggaaggtaaataggaagggtttatyggggagagggtgggggagtaygttatagtygtygtagttygtygt

SEQ ID NO: 15079 - DNA, 201 bp, synthetic construct
  misc_feature 1..201: note = Description of Artificial Sequence: Synthetic polynucleotide
  source 1..201: mol_type = other DNA
tttaggtgygttygttatttttttgattyggaaagggaattttttgattttttgygttttttaagtgaggtaatgttttattttgtttyggtttaygtayggtgtgygtatttattgatttgtgtttattgtttggtattttttagtgagatgaattyggtattttagatggaaatgtagaaattattygttttttgygtc

SEQ ID NO: 15080 - DNA, 201 bp, synthetic construct
  misc_feature 1..201: note = Description of Artificial Sequence: Synthetic polynucleotide
  source 1..201: mol_type = other DNA
ggttgtagtgtagtggygygattttygtttattgtaagttttttttttygggtttaygttatttttttgttttagtttttgagtagttgagattataggygttygttattatattyggttaattttttgtaaaaaatttaaaaaaaaaattaaagataaaatgggttyggtagtatgatattttttatttttaattatttg

SEQ ID NO: 15081 - DNA, 201 bp, synthetic construct
  misc_feature 1..201: note = Description of Artificial Sequence: Synthetic polynucleotide
  source 1..201: mol_type = other DNA
ttttgttttttttaagygtyggttaggttgagaaataaagggatagagtataaaagagggaaattttaaagtygggtattygggggagatattatatgtyggtaggttttgtgatgtttttgagtygtaaaattagtaagtttttattagggatttttaaaaggggagggagtgtaygaatagggtgtgggttatagagat

SEQ ID NO: 15082 - DNA, 201 bp, synthetic construct
  misc_feature 1..201: note = Description of Artificial Sequence: Synthetic polynucleotide
  source 1..201: mol_type = other DNA
agtagtgtttttataaataggygtgaaaatygagtatgttttgggttggttagttgaattattgygtgtagagagggagttttggtygtataggtatagyggyggattatgtttttatatatgtygtttgtatagaaaatggagaataagtttttttttgggtygggtttttaagattataataataagagttygttaaag

SEQ ID NO: 15083 - DNA, 201 bp, synthetic construct
  misc_feature 1..201: note = Description of Artificial Sequence: Synthetic polynucleotide
  source 1..201: mol_type = other DNA
ttttaggggttttaaatyggagttttatttttaggatttataaaattttagatatagttaggatttgttagggagattagtttttttyggtagtttgggygttgttgtttttaatatatagtgataattyggaatttatttttagagttatttagaaataygttttggagatggtgtttttygaaagatttttatttttaa

SEQ ID NO: 15084 - DNA, 201 bp, synthetic construct
  misc_feature 1..201: note = Description of Artificial Sequence: Synthetic polynucleotide
  source 1..201: mol_type = other DNA
ggatgtttggttatatttgattttttatttttgggtatggaggtttgtttgtagaggttygggttygggtataaagggagagagaggtttttattgtttygtaggggtygaaatgtagatygtgtattttyggtgatttyggggatttttttttgattattaggatttttttggattttagggtttttgttttgtttaggt

SEQ ID NO: 15085 - DNA, 201 bp, synthetic construct
  misc_feature 1..201: note = Description of Artificial Sequence: Synthetic polynucleotide
  source 1..201: mol_type = other DNA
ttagtagagayggggttttatygtgttagttaggatggtttygattttttgatttygtgattygttygtttyggttttttaaagtgttgggattataggygtgagttatygygttyggttatttattttttttaagagatggttgatatgattttaatttttttaaatttttgaagatttgttttgtgatttagtatgtga

SEQ ID NO: 15086 - DNA, 568 bp, synthetic construct
  misc_feature 1..568: note = Description of Artificial Sequence: Synthetic polynucleotide
  source 1..568: mol_type = other DNA
aggtggagttgtttgttagttyggygtygtgtgttygtattttttagtttttgggtagtygatgggattgggygtygtggaataggggttggygttygtyggggaggtttgggttgtataggagygtayggygggggtggaggtttaggtatggagggttgtaggtttygagttttgttyggyggggaggtagttaaggtttagygagaagtygagtatagtagttgttggtttaggtgttaagttttttattgttygggtyggttggtygtttygagtgyggggtttgttaagtttaygtttattyggaattygagttggttygtaagygtagtttgtagttayggttttygtttaygtttttttttttatatttattygtaagttgagggagtyggttttagttttgtttagtttagaaaggggtttttatagtgtagygaygggttgaagggttttttaaaygyggttagagtgggygttaaggtygaggaggtgtygagagggagygagggttgtgagggttgttagtaygttgttattttttatttttgtgtttgtatattaa

SEQ ID NO: 15087 - DNA, 201 bp, synthetic construct
  misc_feature 1..201: note = Description of Artificial Sequence: Synthetic polynucleotide
  source 1..201: mol_type = other DNA
ttttttttttttttttttttttttttttttttgagayggattygtgttttgtygtttaggttggagtgtagyggygygattttygtttattgtaagtttygtttttygggtttaygttatttttttgttttagtttttygagtagttgggattataggtatttattatgatgtttagttaattttttgtatttttagtaga

SEQ ID NO: 15088 - DNA, 201 bp, synthetic construct
  misc_feature 1..201: note = Description of Artificial Sequence: Synthetic polynucleotide
  source 1..201: mol_type = other DNA
attttagagaagtttatgggagttttagggagagttttttttgtgaagggtagggtattttggaatgggtttgtygagttygtttttattyggaatttaygtttgtttataagygttttatatagttttggtttttatttgygtttttttttttatattttttygtaagtagagggagttaatttyggttttggttagttt

SEQ ID NO: 15089 - DNA, 201 bp, synthetic construct
  misc_feature 1..201: note = Description of Artificial Sequence: Synthetic polynucleotide
  source 1..201: mol_type = other DNA
ggataaagaaaatgtggtatatggttgggtayggtggtttaygtttgtaatttyggtattttgagaggttaaggygggtagattaygaggttaggagatygagattattttggttaataygatgaaattttatttgtattaaaaaatataaaaaattagttaggtatggtggygggtgtttgtagttttagttatttggga

SEQ ID NO: 15090 - DNA, 201 bp, synthetic construct
  misc_feature 1..201: note = Description of Artificial Sequence: Synthetic polynucleotide
  source 1..201: mol_type = other DNA
ttgtattttagtttgggggatagagtgagatttygttttaaaaaagaaagaaaaaaatgtttttttttttttgttttttttgatttttattttgttttgygggttttttattaataatygttygtgtttgattygggtgttttttttattataattttttttttaggtgtatgtttttataataaagtttattttatggtt

SEQ ID NO: 15091 - DNA, 201 bp, synthetic construct
  misc_feature 1..201: note = Description of Artificial Sequence: Synthetic polynucleotide
  source 1..201: mol_type = other DNA
ttagttttatttatgygttatttatggataagggtaattattagtagtagtgattatgtgtgttaggtattygtaggttttttttygttttttgaattaygtgttaygtttagtttagggatgataaattgaggtgtaygagtaggtgagaagaygaatagtgtattygggtaaggtygttagtttttttgtgtttttgtg

SEQ ID NO: 15092 - DNA, 201 bp, synthetic construct
  misc_feature 1..201: note = Description of Artificial Sequence: Synthetic polynucleotide
  source 1..201: mol_type = other DNA
ttattattgatatttattttttttttatttatagtattygtatgtaygttaagaatyggattggtaagagygagtttagtaaygagtttattattayggyggaygaggtaggtaygtgggatygggyggaattttgttttagaggagttygggagttaatttttgagggtttagatgtttaaatgtagaagtagatttttg

SEQ ID NO: 15093 - DNA, 201 bp, synthetic construct
  misc_feature 1..201: note = Description of Artificial Sequence: Synthetic polynucleotide
  source 1..201: mol_type = other DNA
gygggaggygygtaagtgatatattgaggggtttaggtagtagtttttataygttgttaggttagagtagtttygggttaygtgggtgtttttagttgtygttgtaggyggaggtaygtyggttttttaaggatgtgatagyggttggatttttatgattattgtttggttattagagggtaagttttagggttagttaag

SEQ ID NO: 15094 - DNA, 201 bp, synthetic construct
  misc_feature 1..201: note = Description of Artificial Sequence: Synthetic polynucleotide
  source 1..201: mol_type = other DNA
gggtyggtttygggtygtttggggtttttgygatttttatatttatttttttygtagggtgyggygttgggttttatggtgggttttatgatttaygggyggygttaattttagtttttggataygaygatgyggygtttgatttygttttttygygaggtttyggttaagttaattaygttggtggatgtygaygtygag

SEQ ID NO: 15095 - DNA, 201 bp, synthetic construct
  misc_feature 1..201: note = Description of Artificial Sequence: Synthetic polynucleotide
  source 1..201: mol_type = other DNA
taatattgtttgtaaatgattgaatyggtttttgatttttttagagaagatygtgtatagatattyggatgattttattagttaggaaattgagyggggygggaygtatttgtagtagtggtyggatagygtgattatgtaggatggayggtttagatggttatgttgtagtttattagtagtaggtttttaaggtgatta

SEQ ID NO: 15096 - DNA, 201 bp, synthetic construct
  misc_feature 1..201: note = Description of Artificial Sequence: Synthetic polynucleotide
  source 1..201: mol_type = other DNA
tyggatagtaaataygygtgggttttttttgtgtyggatagtaaataygygtgggtttttttgtgttaaayggtaaataygygtgggtttttygtgtgtygaatagtaaataygygtgggttttttttgtgttygatagtaaataygygtgggtttttygtgtgtyggatgataaataygtatgggtgttttgtgtgttgg

SEQ ID NO: 15097 - DNA, 201 bp, synthetic construct
  misc_feature 1..201: note = Description of Artificial Sequence: Synthetic polynucleotide
  source 1..201: mol_type = other DNA
gttttattatgttggttaggttggtttttttaatttttgatttygtgatttatttatttyggttttttaaagtgttgggattataggagtgagttattgygttyggttgagatttttatgttattattttatgaagtttttggtataatgtttgatatatagtaggtatttgataagtggagtttttattgttgttttttt

SEQ ID NO: 15098 - DNA, 201 bp, synthetic construct
  misc_feature 1..201: note = Description of Artificial Sequence: Synthetic polynucleotide
  source 1..201: mol_type = other DNA
gagttaggtgtgggatatagtttygtggtgygtygttttttaagttygtyggaaaagygtagtattygggtgggagtgattygattttttaggtgygttygttatttttttttttgattaggaatgggaattttttgatttttygtgtttttygagtgaggtaatgtttygttttgtttyggttygygtayggtgygtgta

SEQ ID NO: 15099 - DNA, 201 bp, synthetic construct
  misc_feature 1..201: note = Description of Artificial Sequence: Synthetic polynucleotide
  source 1..201: mol_type = other DNA
ttttttggagttaattgtgtttttattattttaaatagagtagtygggatygggygttgtgttttaygtttataattttagtattttgygaggtygaggygggtagattaygaggttaggagatygagattattttggttaatatggtgaaaatttgtttttattaaaaatataaaaaatttttygggygtggtggygggc

SEQ ID NO: 15100 - DNA, 201 bp, synthetic construct
  misc_feature 1..201: note = Description of Artificial Sequence: Synthetic polynucleotide
  source 1..201: mol_type = other DNA
tygatagagtgaaatggyggyggyggtygggatgatgttgttgggtttgttataggygggtgggtaggtgttgggttaggygatggaggaggtggtaggyggtaattttttgtttatgttgttgatygtttgygtttttatttttagtttggtttatttgtttygtttygttgtyggttatttggtttagttgatygtagg

SEQ ID NO: 15101 - DNA, 201 bp, synthetic construct
  misc_feature 1..201: note = Description of Artificial Sequence: Synthetic polynucleotide
  source 1..201: mol_type = other DNA
gtgaaattttgtttttattaaaaatattaaaaaaattagtyggygyggtggtaggygtttgtagttttagttattygtaaagttgaggtaggagaatggygtgaattygggaggyggagtttgtagtgagttgagatygygttttygtattttagtttgggtgatagagygagattttgttttaaaaaaaaagtagtttgg

SEQ ID NO: 15102 - DNA, 201 bp, synthetic construct
  misc_feature 1..201: note = Description of Artificial Sequence: Synthetic polynucleotide
  source 1..201: mol_type = other DNA
tttttatttttgtttttgagatggagttttatttttatttaggttggagtgtagtagtatgatttgggtttattgtaatttttgtttttygggtttagtygatttttttgttttagttttttaagtggttggaattataggtatatattattatattyggtaaatttttttttttttttttttgtatttttagtagattgt

SEQ ID NO: 15103 - DNA, 201 bp, synthetic construct
  misc_feature 1..201: note = Description of Artificial Sequence: Synthetic polynucleotide
  source 1..201: mol_type = other DNA
tatggtgaaatttygattttgttaaaaatataaaaattagtygggygtggttgtgagtatttgtaattttagttatttgggaggttgaggtaggagaatygttagaattygggaggtggaggttgtagtgagttaagatggtattattgtattttagtttgggtaatagagtgagattttattttaaaataaaaaaaaata

SEQ ID NO: 15104 - DNA, 201 bp, synthetic construct
  misc_feature 1..201: note = Description of Artificial Sequence: Synthetic polynucleotide
  source 1..201: mol_type = other DNA
atttgttttaaggattggaagaggaaaattaaaaatattatttgaaaggtyggaygyggtggtttatatttgtaattttagtattttgggaggttaaggygggyggattaygaggttaggagttygagattagtttggttaatataatgaaatttygtttttattaaaaatataaaaattagttgggtttggtggtaggta

SEQ ID NO: 15105 - DNA, 201 bp, synthetic construct
  misc_feature 1..201: note = Description of Artificial Sequence: Synthetic polynucleotide
  source 1..201: mol_type = other DNA
tgtagtggtataatttttgtttttgtaatttttttttttyggttttaagygattttygygttttagtttttaagtagttgggattataggttygagtttygttyggttaattttttttatatttttagtagagatggggttttattatgttggttaggttggtttygaatttttgattttaagtgattygtttattttggt

SEQ ID NO: 15106 - DNA, 201 bp, synthetic construct
  misc_feature 1..201: note = Description of Artificial Sequence: Synthetic polynucleotide
  source 1..201: mol_type = other DNA
aataygggtggtttygygtaggaygggggttttagggtygtttgagtyggaggatagttygtagtttttatygtttgtagttgaagtgtgttgtgagatygttgtaggggttygggttatttttgttttgggggattttaaaaagttgagttatatttatgttgaaatttttattgaggataattaygtattatatagatt

SEQ ID NO: 15107 - DNA, 201 bp, synthetic construct
  misc_feature 1..201: note = Description of Artificial Sequence: Synthetic polynucleotide
  source 1..201: mol_type = other DNA
agttttygttgattttagtaygagtygtttatatatatttaaggtyggtagtatagyggtatatgtggtaaaatygagtaggygtggatgggaagggagygtattagtttgygtgtgaaggttatatttaggggyggagggaggggagaaatatttttgtygtatttgtagtgttttattttttttagtaatttaaaaygt

SEQ ID NO: 15108 - DNA, 234 bp, synthetic construct
  misc_feature 1..234: note = Description of Artificial Sequence: Synthetic polynucleotide
  source 1..234: mol_type = other DNA
ttttgttgaygtagtgttygtygtygtttttggatgattttagtggtgaagtggtgtattatgttataggtttgtyggaattttygtttattygtygagyggtagtaaatgaagtygaggtagtggtgtaagygatattggygtyggatagatagagygtttagtttaatgatagyggagatataattatttatttttttgttaaggagaaggggatttatgagtgtagttttt

SEQ ID NO: 15109 - DNA, 201 bp, synthetic construct
  misc_feature 1..201: note = Description of Artificial Sequence: Synthetic polynucleotide
  source 1..201: mol_type = other DNA
tagtttttttatttgtgtagtgggygtaatgtygatgattgttttygggaagttagayggtgtttgggaggygttgagttggggttgatatagagygagygtttygtgaagtatttgggttttgtgatgtttttaagtttatagaygtattaygttatgaggaatatatttgggttggygatgttggagataagggatttt

SEQ ID NO: 15110 - DNA, 201 bp, synthetic construct
  misc_feature 1..201: note = Description of Artificial Sequence: Synthetic polynucleotide
  source 1..201: mol_type = other DNA
tagtgagtatagatygygttattgtattgtagtttgggtgatagaagtgaaaagaaatattgttttaaaaaaaaaataggagggaggagttaagatggtygaataggaatagtttyggtttatagtttttagygtgagygaygtagaagaygggtgatttttgtatttttatttgaggtatygggtttattttattaggga

SEQ ID NO: 15111 - DNA, 201 bp, synthetic construct
  misc_feature 1..201: note = Description of Artificial Sequence: Synthetic polynucleotide
  source 1..201: mol_type = other DNA
gatgaaatttygtttttattaaaaatataaaaatttagtygggygtggtggyggaygtttgtagttttagttatttaggaggttgaggtaggygaatggygtgaattygggaggyggagtttgtagtgagtygagattgygttattgtattttagtttgggygatagagygagattttgttttaaaaataaaataaaatta

SEQ ID NO: 15112 - DNA, 201 bp, synthetic construct
  misc_feature 1..201: note = Description of Artificial Sequence: Synthetic polynucleotide
  source 1..201: mol_type = other DNA
gtgagtgtggggtttagttggttgttttaagtatyggtatataggtaggttttaggtagggtttgtagttggattaggtatgttatttygaagggaatgyggtggtattttaagaggggtgtttagattttgaagtttyggaaggggygattttatttgttaattagtttttttagttttgttattygtagttttagggat

SEQ ID NO: 15113 - DNA, 201 bp, synthetic construct
  misc_feature 1..201: note = Description of Artificial Sequence: Synthetic polynucleotide
  source 1..201: mol_type = other DNA
gtgyggttttttagttagggtagttygaaatttaggaaygttttaaggttattttgtgggaattgtggygttagggtttttgaatatttttttgtttttygagtygagtygttttatttgttttttaaaygggtttygggaggaaggttygygtgtttttttaaggtgaggagttattgatgtaaattttttgtaaggatt

SEQ ID NO: 15114 - DNA, 201 bp, synthetic construct
  misc_feature 1..201: note = Description of Artificial Sequence: Synthetic polynucleotide
  source 1..201: mol_type = other DNA
ggggatttagtttaygtgtgtgggggtygtgygtgttygtttygtttgtttatgtatgttatatatgtgagagtttatagygagggtagtttttataygygatggtttagaggagygagtattttaggttttttagtaygtttttgtgttgattttttgtagtattgtygggagttatgtgagtgtttaygtttgtgtgtg

SEQ ID NO: 15115 - DNA, 201 bp, synthetic construct
  misc_feature 1..201: note = Description of Artificial Sequence: Synthetic polynucleotide
  source 1..201: mol_type = other DNA
tttattygtttttygtttttttttttgttggatttgaggygtygttttygtygygttgttttygygttatgttaygttaygttaygttaygttaygttaygtttttaygttaygtttaygttaygtttttatttttygtttatagggaaaygggtttyggygatgtgagggygtttgtygtgtttggtgtttttatagggg

SEQ ID NO: 15116 - DNA, 201 bp, synthetic construct
  misc_feature 1..201: note = Description of Artificial Sequence: Synthetic polynucleotide
  source 1..201: mol_type = other DNA
agtttttaaagttttaatttttttttttttttttttttttttttttttttttttttgagtyggagttttattttgttgttaggttggagtgtagtggygygattttagtttattgtaatttttgygtttygggtttaagggatttttttgttttagttttttgagtagttgagattgtaggtaygtgttattaygtttagt

SEQ ID NO: 15117 - DNA, 201 bp, synthetic construct
  misc_feature 1..201: note = Description of Artificial Sequence: Synthetic polynucleotide
  source 1..201: mol_type = other DNA
ttgtaggatagttttaaaaaggaaggttattttttttttgtttattatygtagtttgttaattaattagaaggtaggygttgagatagtaataattagtygatagttgyggaggattgtygggatttttatagagttygataagtgggattatagttattattagttattgagaagagtgttttttatttatagagtgtaa

SEQ ID NO: 15118 - DNA, 201 bp, synthetic construct
  misc_feature 1..201: note = Description of Artificial Sequence: Synthetic polynucleotide
  source 1..201: mol_type = other DNA
ttaaatttttagagggtttattgtaagatttttttygggtttgaaagtttaagatgaataatttttttttttttaggtttagttttaaggygtaatttgygttagtagggtgygttagtagggtgygttagtagggtgygttagtagggtgygttagtagggtgygttagtagggtgygttagtagggtgygttagtaggg

SEQ ID NO: 15119 - DNA, 686 bp, synthetic construct
  misc_feature 1..686: note = Description of Artificial Sequence: Synthetic polynucleotide
  source 1..686: mol_type = other DNA
attatgttttagtttttttggtygtttttatttttaaatattygaaaaatagaggygttgggtgygaggyggagagatgtataggtttggtttyggtttygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygtgagttttgttttgttttgtattaagtttgtattttttaggtttttggtatttttgtttttgggaygtggggtttttatagatttggaaatttttgtttgtttttttttatttagagtaaattgagaygtttataagagtttggaagttgtttttttttgggtttgaagtygtttggaggttggtttygttttyggtttttttgttatagggtaatgtatatattttttatygtatagtttttttgtttaaaattttgttgatttattttgttttttgttttttaaagtttttattygtgygttggattttygttttgggygttttttagttttygtyggttttttttggagygtagygtyggggttttagttttggggaggttgggttttttgtttggttttgggagtttgtaggtgttat

SEQ ID NO: 15120 - DNA, 201 bp, synthetic construct
  misc_feature 1..201: note = Description of Artificial Sequence: Synthetic polynucleotide
  source 1..201: mol_type = other DNA
aggttggtagattaygaggttaggagatygagatygttttggttaatatggtgaaatttygtttttattaaaaatataaaaattagtygggygtggyggygtgtttttgttttagttgttggggaggttgaggtaggagaatggygtgaattygggaggyggagtttgtagtgagtygagatygtattattgtattttagt

SEQ ID NO: 15121 - DNA, 201 bp, synthetic construct
  misc_feature 1..201: note = Description of Artificial Sequence: Synthetic polynucleotide
  source 1..201: mol_type = other DNA
tattgtaagtttygtttttygggtttaygtygttttgttgatttygtgattygtttygtttyggttttttaaagtgttgggattataggygtgagttatygygttyggttaatagtttttaatattaattatttagagtgtgtaataatttggaaaagggtttttttttttttttttgtttttagagatagggtttttggt

SEQ ID NO: 15122 - DNA, 201 bp, synthetic construct
  misc_feature 1..201: note = Description of Artificial Sequence: Synthetic polynucleotide
  source 1..201: mol_type = other DNA
tgggagtgattygatttttaaggtgygttygttatttttttttttgatttagaaagggaattttttgattttttgygttttttaagtgaggtagtgtttygttttgtttyggttygtatayggtgtaygtatttattgatttgygtttattgtttggtattttttagtgagatgaattyggtattttagatggaaatgtag

SEQ ID NO: 15123 - DNA, 201 bp, synthetic construct
  misc_feature 1..201: note = Description of Artificial Sequence: Synthetic polynucleotide
  source 1..201: mol_type = other DNA
attttataaaaatgaaaattaaataagtataagaatggttatatttgggggaggagttaatatggtygaataggaatagtttyggtttatagtttttagygtgagygatatagaagatggtgatttttgtatttttaattgaggtatygggtttattttattagggattgttagatagtgggygtaggttagtgggtgygt

SEQ ID NO: 15124 - DNA, 201 bp, synthetic construct
  misc_feature 1..201: note = Description of Artificial Sequence: Synthetic polynucleotide
  source 1..201: mol_type = other DNA
yggggttttattttgttagttaggatggtttygattttttgatttygtggttygtttgtttyggttttttaaagtgttgggattatagatttgaattatygygtygggttagttttgtgggtttttaaygtgtttttttttatttgtaatttagagttagaagaggttagygttgataggtaggtagtagttatatgaaaa

SEQ ID NO: 15125 - DNA, 201 bp, synthetic construct
  misc_feature 1..201: note = Description of Artificial Sequence: Synthetic polynucleotide
  source 1..201: mol_type = other DNA
ttattaaaaatataaaaaattagtygggygtggtggtgggygtttgtaattttagttattygggaggttgaggtagaagaatggtatgaatttaagaggyggagtttgtagtgagtygggatagygttattgtagtttagtttgggygaaagagtgagatttygttttaaaaaaaaaaaaaaaaaaaaaaaaaaaagattt

SEQ ID NO: 15126 - DNA, 201 bp, synthetic construct
  misc_feature 1..201: note = Description of Artificial Sequence: Synthetic polynucleotide
  source 1..201: mol_type = other DNA
ggagggtggtgagggtggggagggggaaggygggaggtygggttyggtgtatgggggtygggtatattttttttgggtatttttaggataggygaggaaygtatyggtygggattttatttaygagtaggagggtaaggtgtagtttgtgattgatgyggtgtaygttattgtttaygttttttatagtatgtattaggyg

SEQ ID NO: 15127 - DNA, 201 bp, synthetic construct
  misc_feature 1..201: note = Description of Artificial Sequence: Synthetic polynucleotide
  source 1..201: mol_type = other DNA
ttatataagtygtagtttgggtagaygttgtatttgtagygggtttttattataggtttattgtagttatygtagattatattggggtgtattatgttgyggggygttttttgagtatayggtgggyggtggtttygtyggtatttttttttttttataggaagggtaaagagagtygttagggtgggattttttaaagtt

SEQ ID NO: 15128 - DNA, 201 bp, synthetic construct
  misc_feature 1..201: note = Description of Artificial Sequence: Synthetic polynucleotide
  source 1..201: mol_type = other DNA
tatggggaaattttgtttttattaaaaatataaaaattagttyggygtggtggtatataattgtaattttagttattygggaggttgaggtaggagaatygttggaattygggaggyggagtttgtagtgagttaagattgygttatgtattttaatttgggygtygtagygagattttgtttttaaataaataaagtgtt

SEQ ID NO: 15129 - DNA, 201 bp, synthetic construct
  misc_feature 1..201: note = Description of Artificial Sequence: Synthetic polynucleotide
  source 1..201: mol_type = other DNA
agtaattaataaagtgaagatatggtttattgaagygtagaaaatatttataagtygggygyggtagtttaygtttgtaattttagtattttgggaggtygagataygyggattataaggttaggagatygagattattttggttaatatagtgaaattttgtttttattataaatagaaaaaattagttgggtatggtgg

SEQ ID NO: 15130 - DNA, 227 bp, synthetic construct
  misc_feature 1..227: note = Description of Artificial Sequence: Synthetic polynucleotide
  source 1..227: mol_type = other DNA
agattggttttttttatttaataatatgtattttaatttttagggttgggygtggtggtttaygtttgtaattttagtattttgggaggtygaggtyggyggattaygaggttaggagattaagaygattttggttaatatggtgaaatttygtttttattaaaaatatagaaaataagtygggygtggtggygggtatttgtagttttagttatttaggaggttga

SEQ ID NO: 15131 - DNA, 201 bp, synthetic construct
  misc_feature 1..201: note = Description of Artificial Sequence: Synthetic polynucleotide
  source 1..201: mol_type = other DNA
gtttttttttygagttaaagaaaggggtgayggaygtatttggaaaatygggttatttttattygaatattgygttttttygatyggtttaaaaaayggygtattaygagattatattttatatttggttyggagtttygttgattgttagtatagtagtttgagattaaattgtaaggtggtagtaaggttgggggaggg

SEQ ID NO: 15132 - DNA, 201 bp, synthetic construct
  misc_feature 1..201: note = Description of Artificial Sequence: Synthetic polynucleotide
  source 1..201: mol_type = other DNA
aygtagaagaygggtgatttttgtatttttatttgaggtatygggtttattttatttgggagagttagatagtgggygtaggttagtgggggtatgtatygtgygygagtygaagtagggagaggtattgttttatttgggaagygtaaggggttagggagtttttttttygagttaaagaaaggggtgatagaygtattt

SEQ ID NO: 15133 - DNA, 201 bp, synthetic construct
  misc_feature 1..201: note = Description of Artificial Sequence: Synthetic polynucleotide
  source 1..201: mol_type = other DNA
ggtattygttattaygttyggttaattttttgtatttatagtatagayggggttttatygtgttagttaggatggtttygattttttgatttygtgattygttygtttttgttttttaaagtgttgggattataggygtgagttatygygttyggtggaaaggatatttttttatagtatgagtattgaaataaaaaggta

SEQ ID NO: 15134 - DNA, 201 bp, synthetic construct
  misc_feature 1..201: note = Description of Artificial Sequence: Synthetic polynucleotide
  source 1..201: mol_type = other DNA
aatygtgttattggaagttaggaagtaaattttaattttagtattgtttttttttgaaatggagtttygttttgttatttaggttggagtgtagtggygygatttyggtttattgtaagtttygtttttygggtttattttatttttttgttttagtttttygagtagttgggattataggtgttygttattaygttyggt

SEQ ID NO: 15135 - DNA, 201 bp, synthetic construct
  misc_feature 1..201: note = Description of Artificial Sequence: Synthetic polynucleotide
  source 1..201: mol_type = other DNA
tttgggtgatygtttgtaatggagggagtgtgtgggttggtttgttagyggagagatttgttttaygttattaggagtttggtygagtattayggtgatygtggtygggtggaaggagatggaygtttatttgtgtaatttgtttttattttttttttaggggttattttagaataaaatgtaatggtttttttttgttta

SEQ ID NO: 15136 - DNA, 201 bp, synthetic construct
  misc_feature 1..201: note = Description of Artificial Sequence: Synthetic polynucleotide
  source 1..201: mol_type = other DNA
ataagttggttgttyggtaggttatattggggtttttaagagtttgggttgtagaygaatttaggtttgttttttttaattagtgtgattygggtaagtygygttttttttttgagttttagtttttttattttttaaatgggggtgaygttatttttattgttaggggtttttttgagygggttataggaaggtgtttag

SEQ ID NO: 15137 - DNA, 201 bp, synthetic construct
  misc_feature 1..201: note = Description of Artificial Sequence: Synthetic polynucleotide
  source 1..201: mol_type = other DNA
tttagtttgggatyggtagtatttttatttgtaygttatttttagggayggtaatattgtttattttgagtttagagtagttattattttyggttttttygttggttttttgggaggttttaggaagaygtgattttttgttaggtattygtgggtttttttatagttgtyggggtggtttttgtttttttaaaattatat

SEQ ID NO: 15138 - DNA, 201 bp, synthetic construct
  misc_feature 1..201: note = Description of Artificial Sequence: Synthetic polynucleotide
  source 1..201: mol_type = other DNA
aaagttatygtaggtaattagaaaagttgtttttattttatggttgtgtttatttgyggtagataggataatggtttaaagatgtttgagattygtgatygttttattttgtgatygtattattttatatggtaaagaagtttttgtaygtgtgattaygattaaggattttgagattyggagatgatttgggtattyggg

SEQ ID NO: 15139 - DNA, 201 bp, synthetic construct
  misc_feature 1..201: note = Description of Artificial Sequence: Synthetic polynucleotide
  source 1..201: mol_type = other DNA
gtggyggtaggtttgttgygttygttttagttagggtttagagtttttyggttagtttatygtatttggattttagatgggygygttgggtggtgttygygttagggaaagagttggyggttggttgagttgttgygtttttgagygttgtgttygttgtgattattggygtggttgtttttyggtaggttygaaggaatc

SEQ ID NO: 15140 - DNA, 201 bp, synthetic construct
  misc_feature 1..201: note = Description of Artificial Sequence: Synthetic polynucleotide
  source 1..201: mol_type = other DNA
ttttygatattttgtttttatattgtattattygtyggtaatygttttyggatagyggttaggtygyggggaggttggttttggagtttattttyggggygtatattttygttaattttttygaggtggggtataggatygtggtgttgtattayggggatttgttttttttggggttttattatttgttgttatttaagg

SEQ ID NO: 15141 - DNA, 201 bp, synthetic construct
  misc_feature 1..201: note = Description of Artificial Sequence: Synthetic polynucleotide
  source 1..201: mol_type = other DNA
gggtttagaggtattttagtaaatggtttaggaattgtagtattaatttatattgagaaatagaattgttatttaagaaagataattgttggtttaatgyggtggtttaygtttgtaattttagtattttgggaggtygaggttggyggattaygaggttaggagatygagattattttggttaatagggtgaaattttgt

SEQ ID NO: 15142 - DNA, 201 bp, synthetic construct
  misc_feature 1..201: note = Description of Artificial Sequence: Synthetic polynucleotide
  source 1..201: mol_type = other DNA
tayggtgaaattttgtttttattaaaaatataaaaaattagttaggtgtggaggtattttttgtaattttagatatttaggaggttgaggtaggaaaatygtttgaattygggaggtggagtttgtagtgagttgatatygtattattgtgttttagtttgggtaatagagtaaaattttgttttaaaaaaaaaaaaaaaa

SEQ ID NO: 15143 - DNA, 201 bp, synthetic construct
  misc_feature 1..201: note = Description of Artificial Sequence: Synthetic polynucleotide
  source 1..201: mol_type = other DNA
tatttttttgttttagttttaggagtagttgggattataggygttygttataaygttyggttaattttttttgtatttttagtggagayggggttttatygtgttagttaggatggtttygattttttgatttygtgatttattygttttagttttttaaagtgttgggattataggtgtgagttatygygtttagttgtt

SEQ ID NO: 15144 - DNA, 201 bp, synthetic construct
  misc_feature 1..201: note = Description of Artificial Sequence: Synthetic polynucleotide
  source 1..201: mol_type = other DNA
gtttatagtttttagygtgagygatgtagaagaygggtgatttttgtatttttatttgaggtatygggtttattttattagggagggttagatagtgggygtaggttagtgggtgygygtatygtgygttagttaaagtagggtaaggtattgttttatttgggaagygtaaggggttagggagtttttttttygagttaa

SEQ ID NO: 15145 - DNA, 201 bp, synthetic construct
  misc_feature 1..201: note = Description of Artificial Sequence: Synthetic polynucleotide
  source 1..201: mol_type = other DNA
tggtaaaattttatttttattaaaaatataaagatttagtatgggtatggtggtgtatatttgtaattttagttgtttgggaggttgaagtagaagaatygygtgaattygggaggtagaagttgtagtgagttaagattaygttattgtattttagtttgggtgatataaygagattttgtttaaaaaataaaataaaaa

SEQ ID NO: 15146 - DNA, 201 bp, synthetic construct
  misc_feature 1..201: note = Description of Artificial Sequence: Synthetic polynucleotide
  source 1..201: mol_type = other DNA
aaattttttatttttttgaggtagagttttattttgtygtttaggttggagtgtagtagygtgatttyggtttattgtaagttttatttttygggtttaygttatttttttgttttagttttttgagtagttgygattataggtgttttttattaygtygggttaattttttgtatttttagtagagayggggttttattg

SEQ ID NO: 15147 - DNA, 201 bp, synthetic construct
  misc_feature 1..201: note = Description of Artificial Sequence: Synthetic polynucleotide
  source 1..201: mol_type = other DNA
tttygagtagttgggattataggygttygttattaygttyggttaatattttgtatttttagtagagayggggttttatygygttagttaggatggtttygattttttgatttygtgatttgtttgtttyggttttttaaagtgttgggattataggygtgagttatygygttyggtttattttttttattttttatagag

SEQ ID NO: 15148 - DNA, 201 bp, synthetic construct
  misc_feature 1..201: note = Description of Artificial Sequence: Synthetic polynucleotide
  source 1..201: mol_type = other DNA
tgagtygagyggagattgygttattgttttttagtttgggtgatagagggagattttgtgtttaaaaaaaatagatgtaggtaggagtttttttttyggygtttatatttagattgaagaaagtaattgggttgggttyggtggtttagatttgtaattttagtattttgggaggtttaggtagaygtattattttagttt

SEQ ID NO: 15149 - DNA, 201 bp, synthetic construct
  misc_feature 1..201: note = Description of Artificial Sequence: Synthetic polynucleotide
  source 1..201: mol_type = other DNA
ttggagtagtggtaggtggtaagggttgggtggggggttgttttattgggttttttattttttttttttttttttaattttttttttttttttttgagayggagttttgttttgttatttaggttggagtaaagaggtatgatttyggtttatagtaatttttgtttttygggtttaagtgatttttttgttttatgtttt

SEQ ID NO: 15150 - DNA, 201 bp, synthetic construct
  misc_feature 1..201: note = Description of Artificial Sequence: Synthetic polynucleotide
  source 1..201: mol_type = other DNA
tgaagggagggaygagagttttattatttaattttaagtttagtggtyggtgtttttggaagtggagatatatgtttattggtgtgygatttatatttaygaaagggaaygtgttttttggaatataggggagttttggttagggaagtygtttttttatttaagagggataaaggtgtgtaaattttagaaattagatat

SEQ ID NO: 15151 - DNA, 201 bp, synthetic construct
  misc_feature 1..201: note = Description of Artificial Sequence: Synthetic polynucleotide
  source 1..201: mol_type = other DNA
aaattatttttgatttgagatataaaaataaagaggtygggygtaaggtggtttaygtttgtaattttagtattttgggaggtygaggygggyggattaygaggttagtagatygagattattttggttaatayggtgaaatttygtttttattaaataaaatataaaaaattagtygggygtggtggygggygtttgtag

SEQ ID NO: 15152 - DNA, 217 bp, synthetic construct
  misc_feature 1..217: note = Description of Artificial Sequence: Synthetic polynucleotide
  source 1..217: mol_type = other DNA
ttttgaatgaaattaggaaggagaaagtatgggataatgggtttttgataatgataaaaagagaaaaaataaatagaaaaaagaggagggtyggtygggygyggttaggaaggygyggttttggttaggagatygagattattttggttaaygyggtgaagtttygtttttattaaaaatataaaaaattagtygggygtggtggggggygtttgta

SEQ ID NO: 15153 - DNA, 217 bp, synthetic construct
  misc_feature 1..217: note = Description of Artificial Sequence: Synthetic polynucleotide
  source 1..217: mol_type = other DNA
tygttatttttttttttgattgggaaagggaattttttgattttttgttttttttaagtgaggtagtgtttygttttgtttyggttygygtayggtgtaygtatttattgatttgygtttattgtttggtattttttagtgagatgaattyggtattttagatggaaatgtagaaattattygttttttgygtygtttaagttgggagttgtagatc

SEQ ID NO: 15154 - DNA, 201 bp, synthetic construct
  misc_feature 1..201: note = Description of Artificial Sequence: Synthetic polynucleotide
  source 1..201: mol_type = other DNA
tgttggtgggagttaaaatggattaattatataaaaaataatttttaggtygggygtagtggtttaygtttgtaatttyggtattttgggaggttaaggygggyggattaygaggttaggaaatygatattattttggttaataaggtgaaattttatttttattaaaaatataaaaatttagtygggygtggtggygggt

SEQ ID NO: 15155 - DNA, 201 bp, synthetic construct
  misc_feature 1..201: note = Description of Artificial Sequence: Synthetic polynucleotide
  source 1..201: mol_type = other DNA
tggagattttttatttattgtggtagtaaattygtttgaggtgtttgtatgttttagtttyggggtttygggggtygtgtttatagtttttttatttttyggtttttaygttagggttttyggtttatatygtgttgttttgttttatatgagatyggaaagttatatgtggataatttaggatttatttagggttatata

SEQ ID NO: 15156 - DNA, 201 bp, synthetic construct
  misc_feature 1..201: note = Description of Artificial Sequence: Synthetic polynucleotide
  source 1..201: mol_type = other DNA
gtagggttygaattttttttttaggagggttagggttgyggtygggygaygttaggtggggaagatattagaagaggagaaaattaggagygtaggaygyggtgggagattgggaggttgtagagaggaggtttgaggataggagggaaggaggyggggatagaggtygagggttggaggggttgtygggttttttttggg

SEQ ID NO: 15157 - DNA, 201 bp, synthetic construct
  misc_feature 1..201: note = Description of Artificial Sequence: Synthetic polynucleotide
  source 1..201: mol_type = other DNA
gttatygygttyggttaatttttttgtatttttttagtagagtyggggttttatygtgttagttaggatggttaygattttttgattttgtgattyggtygtttyggttttttaaagtgttgggattataggygttaagttatygygttyggttgatagttagatttttaaaggtgtttgaatttttttaatgtggaaata

SEQ ID NO: 15158 - DNA, 201 bp, synthetic construct
  misc_feature 1..201: note = Description of Artificial Sequence: Synthetic polynucleotide
  source 1..201: mol_type = other DNA
agtttaygtayggtgygygtatttattgatttgtatttattgtttggtattttttagtgagatgaattyggtattttagatggaaatatagaaattattygttttttgygtygtttatagtgggagttgtagatyggagttgtttttattyggttattttggtttgattyggagtggtataygtttttaaataattaaatt

SEQ ID NO: 15159 - DNA, 201 bp, synthetic construct
  misc_feature 1..201: note = Description of Artificial Sequence: Synthetic polynucleotide
  source 1..201: mol_type = other DNA
ttggygagaagtygagtatagtagttgttggtttaggtgttaagttttttattgttyggggttgttggtygttttaagtgygggttagtttagtttaygygtattyggaagtygygttggtgagggagggttgygagggttgttagtatgttattattttttattgggattataggygtgagttayggygttyggttgaag

SEQ ID NO: 15160 - DNA, 201 bp, synthetic construct
  misc_feature 1..201: note = Description of Artificial Sequence: Synthetic polynucleotide
  source 1..201: mol_type = other DNA
ttaygttatttttttgttttagtttgtagttgggattataggtgttygttattaygttyggttattttttttgtatttttaatagagayggggttttatygtgttagttaggatggttttaatttgttgatttygtgattygttygtttyggttttttaaagttttgggattgtaggagtgagttatygygttyggttgta

SEQ ID NO: 15161 - DNA, 201 bp, synthetic construct
  misc_feature 1..201: note = Description of Artificial Sequence: Synthetic polynucleotide
  source 1..201: mol_type = other DNA
tagattggagtgtagtggtaygatttyggtttagaattttygttttatgggtttaagtaatttttttgttttagttttyggagtagttgggattataggygttygttattaygttaggttaattttttgtatttttagtagggayggttgatygggygyggtggtttaygtttgtaattttagtattttgggaggtygagg

SEQ ID NO: 15162 - DNA, 201 bp, synthetic construct
  misc_feature 1..201: note = Description of Artificial Sequence: Synthetic polynucleotide
  source 1..201: mol_type = other DNA
tattttttagatgggatagyggtygggaagaggygttttttattttttagatgggatggyggttaggtagagaygttttttattttttagayggggtggyggtygggtagaggttgtaatttyggtattttgggaggttaaggtaggttgttgggaggtgaaggttgtagygagtygagattaygttattgtattttagtt

SEQ ID NO: 15163 - DNA, 201 bp, synthetic construct
  misc_feature 1..201: note = Description of Artificial Sequence: Synthetic polynucleotide
  source 1..201: mol_type = other DNA
gatggagttgtttgttagtttyggtattgtgygttygtattttttagtttttgggtggttaatgggattgggtgtygtggagtagggggtggygttygtyggggaggttygggtygtataggagtttayggaaggggtgggaggtttaggtatggygggttgtaggtttygagttttgtttygygggaaggtagttaaggt

SEQ ID NO: 15164 - DNA, 286 bp, synthetic construct
  misc_feature 1..286: note = Description of Artificial Sequence: Synthetic polynucleotide
  source 1..286: mol_type = other DNA
gagttaggtgtgggatatagtttygtggtgtatygttttttaagtyggtttgaaaagygtaataatygggtgggagtgattygattttttaggtgygttygttatttatttatttgattyggaaagggaattttttgattttttgygttttttaggtgaggtaatgtttygttttgtttyggttygygtayggtgygygtatttattggtttgygtttattgtttggtattttttagtgagatgaattyggtattttagatggaaatgtagaaattattygttttt

SEQ ID NO: 15165 - DNA, 201 bp, synthetic construct
  misc_feature 1..201: note = Description of Artificial Sequence: Synthetic polynucleotide
  source 1..201: mol_type = other DNA
aggtaaagttgtttgttagttttatgttttgtgtttaygttttttagtygttttatagtygatgggatygggtgttatggagtagggggyggtgttygtyggggaggtttttgttgtataggagtttagggtagtggggggaggtttatatatggtaggttgtaggttttaagttttgtttygtagggaggtagttgaggt

SEQ ID NO: 15166 - DNA, 201 bp, synthetic construct
  misc_feature 1..201: note = Description of Artificial Sequence: Synthetic polynucleotide
  source 1..201: mol_type = other DNA
aggygggtggattaygaggttaggggttygagaygagtttggttaatatggtgaaatttygtttttattaaaaatataaaaattagttgggygtggaggygygygtttgtaattttagatattygggaggttgaggtaagagaatygtttgaattygggaggyggaggttgtagtgagtygagatggtgttattgtatttt

SEQ ID NO: 15167 - DNA, 201 bp, synthetic construct
  misc_feature 1..201: note = Description of Artificial Sequence: Synthetic polynucleotide
  source 1..201: mol_type = other DNA
gagygaygtagaagaygggtgatttttgtatttttatttgaggtatygggtttattttattagggagtgttagatagtgggygtaggttagtgggtgtgygtaatgtgygygagtygaagtagggygaggtattgttttattygggaagygtaaggggttagggagtttttttttygagttaaaggaaggggtgayggagg

SEQ ID NO: 15168 - DNA, 201 bp, synthetic construct
  misc_feature 1..201: note = Description of Artificial Sequence: Synthetic polynucleotide
  source 1..201: mol_type = other DNA
gtgtygtttgttatttttttttttgattaggaaagggaattttttgattttttgygttttyggagtgaggtaatgtttygttttgttttagttygtatayggtgtatgtatttayggatttgygtttattgtttggtattttttagtgagatgaattyggtattttagatggaaatgtagaaattattygttttttgygtt

SEQ ID NO: 15169 - DNA, 201 bp, synthetic construct
  misc_feature 1..201: note = Description of Artificial Sequence: Synthetic polynucleotide
  source 1..201: mol_type = other DNA
atttttatttgaattttgatagtagttattatgtagagttgttaaaatgtatatttttggtygggtgyggtggtttaygtttgtaattttagtattttgyggggtygaggygggyggattaygaggttaagagattaagattattttggttaatatggtgaaattttgtttttattaaaaatataaaaaaaattagttggg

SEQ ID NO: 15170 - DNA, 201 bp, synthetic construct
  misc_feature 1..201: note = Description of Artificial Sequence: Synthetic polynucleotide
  source 1..201: mol_type = other DNA
ttaggtgttattygttatttttttttttgatttagaaagggaattttttgattttttgygttttttaggtgaggtaatgtttygttttgtttyggttygygtayggtgygtatatatattggtttgygtttattgtttggtattttttagtgagatgaattyggtattttagatggaaatgtagaaattattygttttttg

SEQ ID NO: 15171 - DNA, 201 bp, synthetic construct
  misc_feature 1..201: note = Description of Artificial Sequence: Synthetic polynucleotide
  source 1..201: mol_type = other DNA
tttagtttatygttgtattgtgagagtttttttttgggttggttaaggttagagttygtttttttagtttgtagggaggtgtggatggagaggygtgagygggaatttaggttgtgtatggtgtttgygggttagttggagtttygggtgggygtgggtttggtaggtttygtattgggagtagtyggtyggttttgttag

SEQ ID NO: 15172 - DNA, 201 bp, synthetic construct
  misc_feature 1..201: note = Description of Artificial Sequence: Synthetic polynucleotide
  source 1..201: mol_type = other DNA
ggggagagggattgattttttgtgttttatttttagtttatttaattttagtgtagtttggagattgttatygtgtttttyggagggygatggagttttygttttgtttaggagtagtttggttttygggagggtagtttgatttttayggtattgtyggtgattttttagtttaggtttyggggttgygagaattttaag

SEQ ID NO: 15173 - DNA, 201 bp, synthetic construct
  misc_feature 1..201: note = Description of Artificial Sequence: Synthetic polynucleotide
  source 1..201: mol_type = other DNA
atgagygttatygayggtagagtygttttttttatgttttgtggggatygggaagagatygtagggagtgaggtattttattygtttattyggtagattygaagattgagattygagagttygtagtttygggttatatttttagygtttggtttagttttttttttatttttttattygttttttgtagaygaggggttt

SEQ ID NO: 15174 - DNA, 201 bp, synthetic construct
  misc_feature 1..201: note = Description of Artificial Sequence: Synthetic polynucleotide
  source 1..201: mol_type = other DNA
gttgtaattttattgagtgtgtttgtttattagatatttgattttgtaagattgttttttttttttttttttgayggagtttygttttgtygtttaggtygaagtgtagtggygygatttyggtttattgtaagtttygtttttygggtttatgttatttttttgttttagtttttygagtagttgggattataggygttc

SEQ ID NO: 15175 - DNA, 210 bp, synthetic construct
  misc_feature 1..210: note = Description of Artificial Sequence: Synthetic polynucleotide
  source 1..210: mol_type = other DNA
ttttgggtttttattttttttttttttttttttttttttttgagaygaagttttattttgtygttygggttggagtgttgtggtaggatttyggtttatygtaagtttygtttttyggatttaygttatttttttgttttagtttttygagtagttgggattagaggygttygttatygygttaggttaatttttttgtatttttagtag

SEQ ID NO: 15176 - DNA, 201 bp, synthetic construct
  misc_feature 1..201: note = Description of Artificial Sequence: Synthetic polynucleotide
  source 1..201: mol_type = other DNA
taagttgggygyggtggtttaygtttgtaattttagtattttgggaggtttaggtaggyggattaygaggttaggagattaagattattttggttaatayggtgagaatttygtttttataaaaaatataaaaaattagtygggtgtttgtagttttagttattygggaggttgaggygagagaatggygtgaattygggg

SEQ ID NO: 15177 - DNA, 201 bp, synthetic construct
  misc_feature 1..201: note = Description of Artificial Sequence: Synthetic polynucleotide
  source 1..201: mol_type = other DNA
gggttaaagaggaatyggaaagggttyggggtagaygtgggygttatagggtgagtygggttaggttgagaggatttaygggttatgggagtttgtgggygayggttyggtaggggtttgyggygggaatagggataaaatatatttaataaattgtttatttagagtaagttgtgtgggtataatggygagaaaayggtt

SEQ ID NO: 15178 - DNA, 201 bp, synthetic construct
  misc_feature 1..201: note = Description of Artificial Sequence: Synthetic polynucleotide
  source 1..201: mol_type = other DNA
ggygggtgggttaygaagttaggagatygagattattttggttaatatggtgaaattttatttttattaaaaatataaaaaattagtttggtatagtggygggygtttgtagttttagttagttyggaggttgaggtaggagaatggygtgaattygggaggyggagtttgtagtgagtygagattgygttattgtattat

SEQ ID NO: 15179 - DNA, 201 bp, synthetic construct
  misc_feature 1..201: note = Description of Artificial Sequence: Synthetic polynucleotide
  source 1..201: mol_type = other DNA
gtttatgttattttaatagtgggttttttttyggtgagaattggttaatagttattgtttygtttttttagtatgttgtttgattagagagggatagggyggggaggaaaatyggggygtygtgggttgtagttttagttgtaaataygggagtttttttygaygtttgtggttygtyggttygaaagggagaaataygga

SEQ ID NO: 15180 - DNA, 201 bp, synthetic construct
  misc_feature 1..201: note = Description of Artificial Sequence: Synthetic polynucleotide
  source 1..201: mol_type = other DNA
ttatgaatttttgagtttaagtgatttttttatttggttttgygaagtgttgggattatatgtgtgagttattaygtygggattataggtgtgagttatygygtygggattatgggtatgagttattgygtyggtttttagtaaatattttattagtatttagtgaattttgggtttttgtggaataggaatgtttgtttt

SEQ ID NO: 15181 - DNA, 201 bp, synthetic construct
  misc_feature 1..201: note = Description of Artificial Sequence: Synthetic polynucleotide
  source 1..201: mol_type = other DNA
aggttgaggttggtggattataaggttaggagatygagattattttggttaatatggtgaaatttygtttttattaaaaatataaaaaaattagtygggygtggtggtgtgtatttgtagttttagttattygggagtttgaggtaggagaatggtatgaattygggaggtagagtttgtagtgagttaaaattgtattat

SEQ ID NO: 15182 - DNA, 201 bp, synthetic construct
  misc_feature 1..201: note = Description of Artificial Sequence: Synthetic polynucleotide
  source 1..201: mol_type = other DNA
aaggagatgtttgggttaggattgaagtttttyggaataaygggttgggattttgaggttggtaggggtgtagtgggtattgggtttatgtgtggtttgygttggtygaygtgggtatataaggggtatagttgttattgggggtttggaggggaggatttagttggggtttggagggttaggattttgtagaaggtttac

SEQ ID NO: 15183 - DNA, 201 bp, synthetic construct
  misc_feature 1..201: note = Description of Artificial Sequence: Synthetic polynucleotide
  source 1..201: mol_type = other DNA
tatggtgaaatttygttttaattaaaagtattaaaattatttgggtatggtggtatatgtttgtaattttagttattygggaggttgaggtaggagaatygtttgagttygggaggyggaggttgtagtgagtygtgatygygttattgtattttagtttgggygatagagtaagattttattttaataaaaaaattaaaa

SEQ ID NO: 15184 - DNA, 201 bp, synthetic construct
  misc_feature 1..201: note = Description of Artificial Sequence: Synthetic polynucleotide
  source 1..201: mol_type = other DNA
gygatttttttgttttagtttttygagtagttaggattataggygttygtttttaygttyggttaattttttgtatttttggtagagayggggttttatygtgttagtaaggatagtttygattttttgatttygtgattygtttgtttyggygttttaaagtgttgggattataggtatgagttatygygtttggtgggg

SEQ ID NO: 15185 - DNA, 201 bp, synthetic construct
  misc_feature 1..201: note = Description of Artificial Sequence: Synthetic polynucleotide
  source 1..201: mol_type = other DNA
agtgaaatttttttttattaaaaatttaaaaaaattagtygggtgtggtagtatgtgtttgtagttttagttattygagaggttgagataggagaatggygtgaattygggaggyggagtttgtagtgagtygagatygtgttattgtattttagygtgggygatagagtaagatttygttttaaaaaaaaagaaaataat

SEQ ID NO: 15186 - DNA, 201 bp, synthetic construct
  misc_feature 1..201: note = Description of Artificial Sequence: Synthetic polynucleotide
  source 1..201: mol_type = other DNA
agattatagatgaatttgaattttaagtagtatagatgygttatatttattattttgtygttgattattttygggattatattatatttattatttygtygttgattattttygggattattatggygggttatgatagtaygttttttttagaaataygtttgaatagtataagaaaaggatattattyggattygygga

SEQ ID NO: 15187 - DNA, 201 bp, synthetic construct
  misc_feature 1..201: note = Description of Artificial Sequence: Synthetic polynucleotide
  source 1..201: mol_type = other DNA
ygttgttatttataagagtttttttttttttgtaattaatggttttgtttttggtttgtttagtaaattgaaattatygaaaaaggattttgtygggagyggtggtttaygtttgtaatattagtattttgggaggtygaggygggttgattataaggttaggaaatygagattattttggttaatayggtgaaatttagt

SEQ ID NO: 15188 - DNA, 201 bp, synthetic construct
  misc_feature 1..201: note = Description of Artificial Sequence: Synthetic polynucleotide
  source 1..201: mol_type = other DNA
ttagagttaggygtttatygttaattyggagtgtgtgttttagttttttggggtygattttggttgttgggttagtagtgtgaattttttttttttatayggggtttttaagataygtgtttgtgtgtgttygtttttaagatatgtgtgtgtgtatatgtgtgtgtgtgtgtgtgttttatatgaaygatttgagttatt

SEQ ID NO: 15189 - DNA, 201 bp, synthetic construct
  misc_feature 1..201: note = Description of Artificial Sequence: Synthetic polynucleotide
  source 1..201: mol_type = other DNA
gttagtgtttttayggtagtttttgtattgggttyggggtgggggyggggggtggttgtggagtttttggtttttatttagygtgttttttttayggggygtattttaaagygataagatgttttttaggaaatggggaatggaygttaggtttttagggagaggttgaggtagtttgaggtaaaaagggaygggtygagg

SEQ ID NO: 15190 - DNA, 201 bp, synthetic construct
  misc_feature 1..201: note = Description of Artificial Sequence: Synthetic polynucleotide
  source 1..201: mol_type = other DNA
gggtgtttatggagtttttagtttttatttagggtgygtgttttttttayggggggtattttaaaggggtatgaagtttttygggggatggggatatgaygttaggtttttagtgggatattgagatagtygggggaaaaaagtygggagggtaagaaggttggggtatttttatggaggttagtttttttttagtagttt

SEQ ID NO: 15191 - DNA, 201 bp, synthetic construct
  misc_feature 1..201: note = Description of Artificial Sequence: Synthetic polynucleotide
  source 1..201: mol_type = other DNA
gtatttattgttttgtattaattgtttagtattttttagtgagatgaattygttattttagttggaaatgtagaaattatttattttttgygtygtttaygttgggagttgtagatyggagttgtttttattyggttattttggttttattttattatattttttttatttagtttattattgatggatatttgggttggt

SEQ ID NO: 15192 - DNA, 201 bp, synthetic construct
  misc_feature 1..201: note = Description of Artificial Sequence: Synthetic polynucleotide
  source 1..201: mol_type = other DNA
gtaggtgttagggagaggtaattttttaaatagataaaaatatttttggtygggygyggtggtttatgtttgtaattttagtatttygggaggtygaygygggyggattaygaggttaggagatygagattatttttgttaatayggtgaaatttygtttttattaaaaatataaaaaattagtygggtgtggtggygggc

SEQ ID NO: 15193 - DNA, 201 bp, synthetic construct
  misc_feature 1..201: note = Description of Artificial Sequence: Synthetic polynucleotide
  source 1..201: mol_type = other DNA
tggttttattatgttagttaggatggttttaattttttgatttygtgattygttygttayggttttygaaagtgttgtgattataggtatgagttatygygttyggtttaaaataatttttgaggttatataagaatatagtttatgtttatttatagttgtatttaatttaattaagaatttgttttttaagatgaaaaa

SEQ ID NO: 15194 - DNA, 201 bp, synthetic construct
  misc_feature 1..201: note = Description of Artificial Sequence: Synthetic polynucleotide
  source 1..201: mol_type = other DNA
ygggttttygatttgygtggatgagtagttttgagttttatatagggygggtgaygttgtagattgataaggtttatttttggttatattgagttaaagyggaaggggtgtaggtgtggagtgttatgtgygatgttattgtyggttagttggagtggaggtgttygttatgtgtatggggagaygtgtttttggttagtt

SEQ ID NO: 15195 - DNA, 366 bp, synthetic construct
  misc_feature 1..366: note = Description of Artificial Sequence: Synthetic polynucleotide
  source 1..366: mol_type = other DNA
tygttttgtagtttgattttagattgttgtgttagtaattagtgagatttygtgggygtaggattttttaagttaggtgtgggatatagtttygtggtgygttattttttaagtyggtttgaaaagygtaatattygggtgggagtgattygattttttaggtgygtyggttatttttttttttgattyggaaagggaattttttgatttttggygttttttaggtgaggtaatgtttygttttgtttyggttygtttayggtgygygtatttattggtttgygtttattgtttggtattttttagtgaggtgaattyggtattttagatggaaatgtagaaattattygttttttgygtygttta

SEQ ID NO: 15196 - DNA, 201 bp, synthetic construct
  misc_feature 1..201: note = Description of Artificial Sequence: Synthetic polynucleotide
  source 1..201: mol_type = other DNA
ggtttttgtagggtygagtttttttaatgagygttgttttttgttttayggygttyggttttatygatygtttaagggttgaggattgtgggagtattgygygggattggtaggtagttttatttgyggttttyggtgygggatttattgggtgaagttagttgggttygtgagtttagtgtggatttggagaatttttat

SEQ ID NO: 15197 - DNA, 201 bp, synthetic construct
  misc_feature 1..201: note = Description of Artificial Sequence: Synthetic polynucleotide
  source 1..201: mol_type = other DNA
ygtagaagatgagtgatttttgtatttttatatgaggtatygggtttattttattagggagtgttagatagtgggygtaggatagtgggtgtagygtatygtaygygagtygaagtagggygaggtattgttttatttyggaagtataaggggttagggagtttttttttttagttaaagaaaggggtgatagayggtatt

SEQ ID NO: 15198 - DNA, 201 bp, synthetic construct
  misc_feature 1..201: note = Description of Artificial Sequence: Synthetic polynucleotide
  source 1..201: mol_type = other DNA
tttttttttttagttaaagaaaggggtgatagatagtatttggaaaatygggttattttaatyggaatattgtatttttttaataggtttaaaaaayggygtatttggagattgtatttygtatttggttyggagggttttatgtttayggagtttygttgattgttagtatagtagtttgagattaaattgtaaggyggt

SEQ ID NO: 15199 - DNA, 384 bp, synthetic construct
  misc_feature 1..384: note = Description of Artificial Sequence: Synthetic polynucleotide
  source 1..384: mol_type = other DNA
ttygtttttttggtttttgttgtttatgagaaatgaggaaaaataaaggttagatttttaataattttttyggaagaaagagttgttttgagtgggtgtyggtgtttatataygttgtttttaaaaaaatttgttttgtttaggtttgtgtgaatataaygtyggatgaattttgtttttttagaagaaagtygggttggtgtgttygatgaygtagygtttgtagtggygtttgataaagygtagggtttttayggagatttygtagttttggatatttagygtttggaggttaaagtagttggyggttaygatttgtaagttttggtyggtgatgttttygtaggatttgaggttgagtygtttgaggttgaagtagtttag

SEQ ID NO: 15200 - DNA, 216 bp, synthetic construct
  misc_feature 1..216: note = Description of Artificial Sequence: Synthetic polynucleotide
  source 1..216: mol_type = other DNA
tgggagtgattygattttttagttgygtttattatttttttttttgattyggaaagggaattttttgattttttgygttttttaggtgaggtaatgtttygttttgtttyggttygygtayggtgygygtatttattggtttgygtttattgtttggtattttttagtgagattaattyggtattttagatggaaatgtagaaattattygttttt

SEQ ID NO: 15201 - DNA, 334 bp, synthetic construct
  misc_feature 1..334: note = Description of Artificial Sequence: Synthetic polynucleotide
  source 1..334: mol_type = other DNA
ttgtgttggtaattagygagatttygtygggtaggatttttygagttagatgygggatataatttygtggtgygtygttttttaggtyggttygaaaagygtaatattygggtgggagtgattygattttttaggtgygttygttatttttttttttgattaggaaagggaattttttgatttttggygtttttygagtgaggtattgttttattttgtttyggttygygtayggtgygygtatttattgatttgtgtttattgtttggtattttttagtgagatgaattyggtattttagatggaaatgtagaaattatygttttttatgtta

SEQ ID NO: 15202 - DNA, 201 bp, synthetic construct
  misc_feature 1..201: note = Description of Artificial Sequence: Synthetic polynucleotide
  source 1..201: mol_type = other DNA
ttygatgtaaggyggggtaggtaaaagttyggtagttattygagaaggtgtgattaaaayggaggaattygagagatttttygaggattgtaggttyggygyggagttygygtttaatggtttggtttatggtagygyggaggttattttggttttaaygttyggtgtttttgggtygtattagtaagattttaggatttt

SEQ ID NO: 15203 - DNA, 270 bp, synthetic construct
  misc_feature 1..270: note = Description of Artificial Sequence: Synthetic polynucleotide
  source 1..270: mol_type = other DNA
tttyggttttygttygtgtttttttttttatattttttygtaagttgagggagtyggtttyggttttggttagtttaggaatgggtttttatagtgtagyggygggttgaagggttttttaagygyggttagagtgggtgttaaggtygaggaggygttaagagygagygagggttgtgagggttgttatgtyggtatattgttattttttagaaggaygtagggtagagttttaggttggttttgttatttatgttggagtgtagtggt

SEQ ID NO: 15204 - DNA, 253 bp, synthetic construct
  misc_feature 1..253: note = Description of Artificial Sequence: Synthetic polynucleotide
  source 1..253: mol_type = other DNA
ggtyggaaaagygtagtatttyggtgggagtgattygattttttaggtgygttygttatttttttttttgattyggaaayggaattttttgattttttgygttttttaagtgaggtaatgtttygttttgtttyggttygygtayggtgygygtatttattgatttgygtttattgtttggtattttttagtgagatgaattyggtattttagatggaaatgtagaaattatttgttttttaygtygtttayg

SEQ ID NO: 15205 - DNA, 204 bp, synthetic construct
  misc_feature 1..204: note = Description of Artificial Sequence: Synthetic polynucleotide
  source 1..204: mol_type = other DNA
taaattagtaaatttaatattttaggatttttgttaagaagtttggttttggtygggaggatggagtttagygggtagyggagttgttttagtttttgtygtygtttygttygggagggaggtggggggggttagtttttttgttyggttagtygtttygttygggaggtgaggggygtttttgttyggtygtttttattggga

SEQ ID NO: 15206 - DNA, 228 bp, synthetic construct
  misc_feature 1..228: note = Description of Artificial Sequence: Synthetic polynucleotide
  source 1..228: mol_type = other DNA
attygggaagtataaggggttagggagtttttttttttggttaaggaaaggggtgatagatagtaygtggaaaattaggttttttttattygaatattgygttttttttaygggtttaaaaatyggygtattaggagattatatttygtatttggttyggagggttttaygtttayggagtttygtygattgttagtatagtagtttgagattaaattgtaaggtagt

SEQ ID NO: 15207 - DNA, 217 bp, synthetic construct
  misc_feature 1..217: note = Description of Artificial Sequence: Synthetic polynucleotide
  source 1..217: mol_type = other DNA
tttagtggtygtaggggttgtygtgtgttttgtagatggataygygttatttaatatagagatgygttgagttygggtgattagtgaatygtaygttatygtagatattagaaagygaaagtataygggggaaggtttygggtatagatttagtayggttattattygagttggagttgtttgygagaygatgagygtttgtaatttgtattttgyg

SEQ ID NO: 15208 - DNA, 201 bp, synthetic construct
  misc_feature 1..201: note = Description of Artificial Sequence: Synthetic polynucleotide
  source 1..201: mol_type = other DNA
ttyggtgtttaatttttgaattttaaggaaaaatagggtagaatagaaagtgaaataggttygaaggtatttatygtgtggtaatattttagaygagttygatggtatttatygtgtggtaatattttagaygaatatttaagatgtgttyggagttggttttttttagtgggtttgtggttttagtgattttaagaatga

SEQ ID NO: 15209 - DNA, 204 bp, synthetic construct
  misc_feature 1..204: note = Description of Artificial Sequence: Synthetic polynucleotide
  source 1..204: mol_type = other DNA
ayggtgygtatatttattgatttgtgtttattgtttggtattttttagtgagatgaattyggtattttygatggaaatgtagaaattatttatttttygygtygtttaygttgggagttgtagatyggagttgtttttatttggttattttggtttttttttggtattttttttattttttatttaggattagtttgttgtttt

SEQ ID NO: 15210 - DNA, 223 bp, synthetic construct
  misc_feature 1..223: note = Description of Artificial Sequence: Synthetic polynucleotide
  source 1..223: mol_type = other DNA
tagaagtataagtaatygtttttttttgtattttagtggaaygtygtgggttttttgaagatttttttttgttttgtaggtttyggtattttaagtaygygagtttgygtaggaggygtttygtttttyggagttttttattgttttttagatatagtttyggttttttatttygggyggaggtttttttagaygggtttygattgtttttgtatgtttattg

SEQ ID NO: 15211 - DNA, 201 bp, synthetic construct
  misc_feature 1..201: note = Description of Artificial Sequence: Synthetic polynucleotide
  source 1..201: mol_type = other DNA
tatttataaggttgaggtaggagaattgtttgaagtygggaggyggaggttgtaatgagtygagattatattattgtattttagtttgggygataagagygaaattttgtaataatattaataataataataaaataaaaataaaaataaaaaagaaaataagagaygyggtggttttgtttgtaattttagtattttggg

SEQ ID NO: 15212 - DNA, 203 bp, synthetic construct
  misc_feature 1..203: note = Description of Artificial Sequence: Synthetic polynucleotide
  source 1..203: mol_type = other DNA
tttaatattaagttaggtttagggaagtgttttttttttttttttttttttttatttgagaygtagttttattttgttatttaggttggagtatagtggygygatttyggtttattgtaagtttygtttttygggtttaygttattttgttgttttagtttttygagtagttgggattatygttygattaatttatttgtatt

SEQ ID NO: 15213 - DNA, 201 bp, synthetic construct
  misc_feature 1..201: note = Description of Artificial Sequence: Synthetic polynucleotide
  source 1..201: mol_type = other DNA
tataaaaagaattataaaatattgttgaaaaaaattagataatagtygggygyggtgttttatgtttgtaattttagtagtttgggaggtygagttgggyggattaygaggttaggagatttagattatttyggttaatayggtgaaatttyggtgaaatttygtttttattaataatataaaaaaattagtygggygtgg

SEQ ID NO: 15214 - DNA, 201 bp, synthetic construct
  misc_feature 1..201: note = Description of Artificial Sequence: Synthetic polynucleotide
  source 1..201: mol_type = other DNA
attattgttaaaaattaaattgggtygggygyggtggtttaygtttgtaattttagtattttggggggtygaggttggyggattaygaggttaggagatygagattattttggttaatayggtgaaattttatttttattaaaaatataaaaaattagtygggygaggtggtaggtatttgtagttttagttattygggag

SEQ ID NO: 15215 - DNA, 201 bp, synthetic construct
  misc_feature 1..201: note = Description of Artificial Sequence: Synthetic polynucleotide
  source 1..201: mol_type = other DNA
tttgttttgattttgtttgtgggtgtygggatatttgggtgtagagggtttgtgtttagttagaagygatttttgtttttttttgygtaggygttggtgygttygtygygtgtgygtggttygtgtgtygttgtttyggtttgygtttttatatgtgtaggaaaggataygtygtttgtttttaygttttttgtgattttt

SEQ ID NO: 15216 - DNA, 201 bp, synthetic construct
  misc_feature 1..201: note = Description of Artificial Sequence: Synthetic polynucleotide
  source 1..201: mol_type = other DNA
gaggttgaggtaggagaattatgtgaattyggaaggyggagtttgtagtgagtygagatygygttattgtattttagtttgggygatagagygagatttygttttaaaaaaaaaaaaaaaaaaaaaaaaagtgatttgggtygggygyggtggtttaygtttgtaattttagtattttgggaggtygaggagggtagatta

SEQ ID NO: 15217 - DNA, 201 bp, synthetic construct
  misc_feature 1..201: note = Description of Artificial Sequence: Synthetic polynucleotide
  source 1..201: mol_type = other DNA
tattagttaggtatggtagtatatgtttgtaattttagttattygggaggttgaggtaggagaatygtttgaattygggaggtggagattgtagtaagtygagttygtgttattttattttagtttgggtaagagygaaattttattgggaaaaaaaaatttatagtttaggtygggygyggtggtttaygtttgtaattt

SEQ ID NO: 15218 - DNA, 201 bp, synthetic construct
  misc_feature 1..201: note = Description of Artificial Sequence: Synthetic polynucleotide
  source 1..201: mol_type = other DNA
ggttagtttttygttyggttagtygttttattygggaggtgaggggygtttttgttyggtygtttttattgggaagtgaggagtttttttgttyggttaygatttygtttgggaggtgtgtttagtagtttattggggatgggttatgatgataatggyggttttgtggaatagaaaggygggaagggtggggaaaaaatt

SEQ ID NO: 15219 - DNA, 201 bp, synthetic construct
  misc_feature 1..201: note = Description of Artificial Sequence: Synthetic polynucleotide
  source 1..201: mol_type = other DNA
attggttaaagagtattgtgggttttyggaagtatttgtttttttattagttgtaaatyggaatgataattagtttttaggttttggtttttgaatgtaygttgygaaygatgtattgttttggttttatggtaggggttggggaggttygttttattttgtatttygattygggtttaaagttgagtttgaagggttttt

SEQ ID NO: 15220 - DNA, 201 bp, synthetic construct
  misc_feature 1..201: note = Description of Artificial Sequence: Synthetic polynucleotide
  source 1..201: mol_type = other DNA
ttygttattaygttyggttaattttttgtatttttagtagagayggggttttatygttttagttgggatggtttygattttttgatttygtgatttgttygtttyggttttttaaagtgttgggattataggygtgagttatygtattyggttttttttttttttttttttttttaagatagagttttattttgttgttta

SEQ ID NO: 15221 - DNA, 201 bp, synthetic construct
  misc_feature 1..201: note = Description of Artificial Sequence: Synthetic polynucleotide
  source 1..201: mol_type = other DNA
atttyggaaagtataggaggttatgttttagtgtggttttttttttttgggtttaagttaaggtttttatygtgtttgtyggtttttygggtttttgygyggtggattttggatttttttgtttygttttgttttagggtttttgtatttgttgttatygyggtttggaaygttttttttttgaaattttgtgatttttat

SEQ ID NO: 15222 - DNA, 201 bp, synthetic construct
  misc_feature 1..201: note = Description of Artificial Sequence: Synthetic polynucleotide
  source 1..201: mol_type = other DNA
tgtgtttataagaatattagttattggatttagggtttatttaatttagtatgattttattttaatttgattatatttgaaaagatttttggtygggygyggtggtttatgtttataattttattattttgggaggtygaggtaggtggattatttgaggttaggagttygagattagtttggttaatatggggaaatttt

SEQ ID NO: 15223 - DNA, 211 bp, synthetic construct
  misc_feature 1..211: note = Description of Artificial Sequence: Synthetic polynucleotide
  source 1..211: mol_type = other DNA
tttagtttttaggaygtgttttttatggttttttttgyggtgtggttaygttyggatttttttggtattttttatttgtttygtaygatttgttttgygygatttgtttygtaaggtyggggggagygtttttttttttygygattttttattttttttyggtattygtttatttygttgtttaggttttttgttttttyggttttagggc

SEQ ID NO: 15224 - DNA, 201 bp, synthetic construct
  misc_feature 1..201: note = Description of Artificial Sequence: Synthetic polynucleotide
  source 1..201: mol_type = other DNA
gtgygygtatttattgatttgygtttattgtttggtattttttagtgagatgaatygggtattttagatgtaaatgtagaaattattygttttttttgtygtttaygttgggagttgtagatyggagttgtttttattyggttattttggttttttttttygaaaagagtattttttaattaagaagatggttttggttgt

SEQ ID NO: 15225 - DNA, 201 bp, synthetic construct
  misc_feature 1..201: note = Description of Artificial Sequence: Synthetic polynucleotide
  source 1..201: mol_type = other DNA
atttagtggattttatatyggggttgtaggtggagttgtttgttagttttgygtygtgtgtttatattttttagtttttgggtggtygatgggattgggygtygtggagtagggggtggtattygttygggaggtttgggyggtataggagtttatggagtgggtgggaggtttaggtatggtgggttgtaggttttgagt

SEQ ID NO: 15226 - DNA, 201 bp, synthetic construct
  misc_feature 1..201: note = Description of Artificial Sequence: Synthetic polynucleotide
  source 1..201: mol_type = other DNA
gatatgtataggttatttaagagaatgatygatttttggttattyggtgtttgtttgttgyggtggygttgtgtygggtttaggggttttagggattttygtygtgttgttagttttggaattttagtggggatttgttgtgtggaaattttyggataatagttttttttatggagaatttaygtttttataatgttatta

SEQ ID NO: 15227 - DNA, 201 bp, synthetic construct
  misc_feature 1..201: note = Description of Artificial Sequence: Synthetic polynucleotide
  source 1..201: mol_type = other DNA
ttatttttttatatttgtagagygttttattttttgtaaygtttatttgygaaattgttgygttaggttaggagtattttaagagygagaggtagaygtygtttgattttttattttgataggggatttttttatttggtagtgttaatattyggtttttaygtattttttatggaggattattaggttagtttatgggag

SEQ ID NO: 15228 - DNA, 201 bp, synthetic construct
  misc_feature 1..201: note = Description of Artificial Sequence: Synthetic polynucleotide
  source 1..201: mol_type = other DNA
ttttggtagagttagtattygattttttttgttyggagatttaggygayggtgtygtgtgatttttgatttygyggatgaggaaggtagagagagagygygtagatayggaggtyggygttgaggttgagggagttatattyggtygtaagtttgagggagggaagtygggtgyggaaatagtttagygggtttagaagtc

SEQ ID NO: 15229 - DNA, 201 bp, synthetic construct
  misc_feature 1..201: note = Description of Artificial Sequence: Synthetic polynucleotide
  source 1..201: mol_type = other DNA
tygttgttaygtttagttaattttttgtattgtttagtagagayggggttttatygtgttagttaggatggtttygattttttgattttgtgatttgttygtttyggttttttaaagtgttgggattataggtatgaattatygtattyggttaatttagtggttttgaggaggattygttaggagttttgtaaaatgttt

SEQ ID NO: 15230 - DNA, 201 bp, synthetic construct
  misc_feature 1..201: note = Description of Artificial Sequence: Synthetic polynucleotide
  source 1..201: mol_type = other DNA
atyggatggaygtttgttgttgttttatyggggtygtgtggggagtygagtgygaggtttgttyggatttygagtttttggagttygttagtttgtgttygygggggttgggtttygttagtygggattttttgtttggtygattattttataaaggtgyggttggggaaggggttaggtttttggaaggatggggagggg

SEQ ID NO: 15231 - DNA, 201 bp, synthetic construct
  misc_feature 1..201: note = Description of Artificial Sequence: Synthetic polynucleotide
  source 1..201: mol_type = other DNA
ttataggtgtgagttattyggtttttttttttttttttttttttttttgagaygaagttttatttttgttttttaggttggagtgtaaaggygtaatttyggtttattataatttttatttttygggtttaggtaatttttttgttttaatttttggagtagttgggattataggtgtttgttattaggtttggttaattt

SEQ ID NO: 15232 - DNA, 201 bp, synthetic construct
  misc_feature 1..201: note = Description of Artificial Sequence: Synthetic polynucleotide
  source 1..201: mol_type = other DNA
attattyggtttagtaggtagaggygtaggaatatggggatggatagtagtaygtttaygtyggtttyggttatygagggygygtaygtgaaggttagtygygtygtttaygtgaagyggtagtggtygggtatygggtgaatggygtatattgttagttttagygagatgaggaataygygttygtaggttatggygatg

SEQ ID NO: 15233 - DNA, 201 bp, synthetic construct
  misc_feature 1..201: note = Description of Artificial Sequence: Synthetic polynucleotide
  source 1..201: mol_type = other DNA
gtagttttagttattttaaaggtagaggtgagaatygtttgaattyggaaggagtaggttttagtgagttgaggttatgttatttttttttagtttgggygatagagaaagattttgtttagaaaaagtaaattatgggagtyggygtyggygagygtygttygggaggtagyggttggaggagyggaygggtttygyggg

SEQ ID NO: 15234 - DNA, 201 bp, synthetic construct
  misc_feature 1..201: note = Description of Artificial Sequence: Synthetic polynucleotide
  source 1..201: mol_type = other DNA
gaggttgaggtaggagaatggygtgaattygggaggyggagtttgtagtgagtygagatttygttattgtattttagtttgggygatagagygagatttygttttaaaaaaaaaataaaaataaaaataaaataaaataaaaaatgagttgggtatgatggtataagtttgtggttttagttatttaggaggttgaggtgg

SEQ ID NO: 15235 - DNA, 201 bp, synthetic construct
  misc_feature 1..201: note = Description of Artificial Sequence: Synthetic polynucleotide
  source 1..201: mol_type = other DNA
gtagtttaataattttgygttgtaaatttaaatattttatatattattagatattaaaaataaagatttatgttgttygtttttayggagtgaggatttygttgattttatattyggttatgaatttgtttgaggtttattagttgaaygttttyggttaagaaagttygtygagtgggggyggtttttaaattattattt

SEQ ID NO: 15236 - DNA, 201 bp, synthetic construct
  misc_feature 1..201: note = Description of Artificial Sequence: Synthetic polynucleotide
  source 1..201: mol_type = other DNA
gtgtattttggtttattataatttttattatattygttttttttaggtttaagtgatttttttattttagtttttttagtagttgggattataggtgtayggtattatgatyggttaatttttgtattttttgtagagatgggattttgttatgttatttaggttggtttygaatttttaagttaaagtaattygtttgtt

SEQ ID NO: 15237 - DNA, 201 bp, synthetic construct
  misc_feature 1..201: note = Description of Artificial Sequence: Synthetic polynucleotide
  source 1..201: mol_type = other DNA
ttttatttttattaaaaatataaaaaattagttaggygtggtggtaygttttgtaattttagttattygggaggttgaggtaggagaattgtttgaaygygggttggggaggttgyggtgagtygagattgtattattgtattttagttygggtgatagtgtaagattttattttaaaaaaaaaaaaaatttgttaattta

SEQ ID NO: 15238 - DNA, 201 bp, synthetic construct
  misc_feature 1..201: note = Description of Artificial Sequence: Synthetic polynucleotide
  source 1..201: mol_type = other DNA
taygtattatttatatgagtttttagtaggtttyggttttaaataggtatatgygtatttttttagttttttattgggattttttygttaagttaygttygatgtttttgtttatagttatgagttgtagtaagatgtttaggttyggtgttagygtgygtagtaygtgtgttagtatygtggaatttttgtygttygagg

SEQ ID NO: 15239 - DNA, 201 bp, synthetic construct
  misc_feature 1..201: note = Description of Artificial Sequence: Synthetic polynucleotide
  source 1..201: mol_type = other DNA
tggtattttggaaggtygaygtgggggtattatttgagattaggggttygagattagttttgygaaygtgatgaaatttygtttttattgaaaatttaaygattagtygggggtggtggtgtatgtttgtaattttagttatttaggaggttgaggtaggagaatygtttgaattyggaaggtggaagttgtaatgagtyg

SEQ ID NO: 15240 - DNA, 201 bp, synthetic construct
  misc_feature 1..201: note = Description of Artificial Sequence: Synthetic polynucleotide
  source 1..201: mol_type = other DNA
ttgaggtgggtygggygyggtggtttaygtttgtaattttaatattttgggaggtygaggggggtggattatttgaggtgggttyggygtggtggtttaygtttgtaattttaatattttgggaggttgagaggggtggattatttgaggtgggtygggygyggtggtttaygtttgtaattttaatattttgggaggtyg

SEQ ID NO: 15241 - DNA, 201 bp, synthetic construct
  misc_feature 1..201: note = Description of Artificial Sequence: Synthetic polynucleotide
  source 1..201: mol_type = other DNA
ggggtttyggttaggggtgggtgaggttggtgtttttttaggttttttttagttataggtagtaggtgttatgggagttttgtyggtatttttttttttygttagggttttggtttatttgatggygtagtttttttttaaggtgtgtatyggygtagatattgtgtaggaagttaggttgatgtagayggtttttaagtc

SEQ ID NO: 15242 - DNA, 201 bp, synthetic construct
  misc_feature 1..201: note = Description of Artificial Sequence: Synthetic polynucleotide
  source 1..201: mol_type = other DNA
aaagttgtttaaagttttataatgagttgatttatygggaataggaggaggtttygtygttagtttttgtgttatatttggtatttygtttaggtttatyggagaggagattataygttttttttttagtttttttaatttttttagttaagataggtgttattatttattttagttttagtgtgttttgagtgtgtygga

SEQ ID NO: 15243 - DNA, 201 bp, synthetic construct
  misc_feature 1..201: note = Description of Artificial Sequence: Synthetic polynucleotide
  source 1..201: mol_type = other DNA
tatttttttgttttagtttttygagtagttgggattataggygttygttattgygttyggttaattttttgtatttttttagtagagayggggttttatygtggtttygattttttgatttygtgattygtttatttyggttttttaaagtgttgggattataggygtgagttatygygttyggtygtgtgtgttttttaa

SEQ ID NO: 15244 - DNA, 201 bp, synthetic construct
  misc_feature 1..201: note = Description of Artificial Sequence: Synthetic polynucleotide
  source 1..201: mol_type = other DNA
gtaygtggtagtaggatttatttttggggtgtttygggtyggtgaatttatatttttttaygttaatggttygtagtatttgtagttygtgggtygagtyggttgtggggggtttattggtggtaggggtattattggggagagtggyggayggttgggttggyggyggtggaggtagtaggggttttgttatgtggtygt

SEQ ID NO: 15245 - DNA, 279 bp, synthetic construct
  misc_feature 1..279: note = Description of Artificial Sequence: Synthetic polynucleotide
  source 1..279: mol_type = other DNA
ggtggaagagttgatagtaaggggagtggttaaayggaggyggggtttggaagggggygtggtttgygggtttttgggtygttyggtttttttaggtgtygtagyggaaggtttggagtagaggttgttttttygtttaagtattttttgggtgagtttatatttttggygygagtaygatttttttttttagggaaggtygggtttttygttggggttygattygattttttttttttatttttttttttttgttttatatttagygagtttaggttt

SEQ ID NO: 15246 - DNA, 201 bp, synthetic construct
  misc_feature 1..201: note = Description of Artificial Sequence: Synthetic polynucleotide
  source 1..201: mol_type = other DNA
ttataygggaggttgaggttagagaatggygtgaattygggaggtagagttygtagtgagtygagatggtattattgtattttagtttgggygatagagygagatttagttttaaaaaaaaaaaaaaaaaaaaaggaaaatttaggtttttttttagattgaaatttttgtaaatataatttatgattttatagtagttag

SEQ ID NO: 15247 - DNA, 201 bp, synthetic construct
  misc_feature 1..201: note = Description of Artificial Sequence: Synthetic polynucleotide
  source 1..201: mol_type = other DNA
ttttgttgtaaaagaagtgtttatagaatttttatttttttttattattattattttttgagatagagtygttgtygttygggttggagtatagtggtaygatttyggttaattgtaagtttygtttttygggtttaygttatttttttgttttagttttattttttygtttygtttygtttygtttygtttygttttyga

SEQ ID NO: 15248 - DNA, 201 bp, synthetic construct
  misc_feature 1..201: note = Description of Artificial Sequence: Synthetic polynucleotide
  source 1..201: mol_type = other DNA
gtttttttaatattttgaaatttaaagtgtgatagttttagaggattattaatataagtattatttgaaaatttgttagaaatgaagaattaggtygggygyggtggtttaygtttataattttagtattttgggaggtttagatgggaggattaygatattaggagatygagattattttggttaatayggtgagatttc

SEQ ID NO: 15249 - DNA, 201 bp, synthetic construct
  misc_feature 1..201: note = Description of Artificial Sequence: Synthetic polynucleotide
  source 1..201: mol_type = other DNA
tatggtgaaaatttgttttttttaaaaatataaaaattagttaggygtagtggtatgygtttgtagatttagttatttgggtggttgaggtaggagaatygttggaattygggaggtygaggttgtagtgagtygagatygtattattgtattgtagtttgggtgatagaataagattttaatttaaaaataataataata

SEQ ID NO: 15250 - DNA, 201 bp, synthetic construct
  misc_feature 1..201: note = Description of Artificial Sequence: Synthetic polynucleotide
  source 1..201: mol_type = other DNA
tttgtttaggaaatgtatataggagttggttattttgtgttttgagttttttyggaggtgttggatttttagagagagaaatagagataygtaagagggygaagatgttttagtggtgatatattggggagtttygtttaygattygtttaygatyggtatatttaatttgttttayggaattttattttatagttyggtt

SEQ ID NO: 15251 - DNA, 201 bp, synthetic construct
  misc_feature 1..201: note = Description of Artificial Sequence: Synthetic polynucleotide
  source 1..201: mol_type = other DNA
ygttaggataagygagggtggtttgagttttgtgtttatatggygtatgtygtttagtagatgatattgayggtygtaaaygtygtagggaatatagygygggygtaaatgttaatggtgtttgygtygatgggtttgagtygggtayggatgtttttttggttttttgagygggttgtttttttttttttygtttttttt

SEQ ID NO: 15252 - DNA, 201 bp, synthetic construct
  misc_feature 1..201: note = Description of Artificial Sequence: Synthetic polynucleotide
  source 1..201: mol_type = other DNA
tttttgttgagagtggatttygtgygtgtgttttttaggaayggtgataagtaygayggygattgggttygggatyggygttagggatayggggtgttgygttgygtygayggttttatttataaggtattygggggygygyggtatttgttgtttagagggtataggtttygtggtgggtagggygygtggggtgtatgg

SEQ ID NO: 15253 - DNA, 201 bp, synthetic construct
  misc_feature 1..201: note = Description of Artificial Sequence: Synthetic polynucleotide
  source 1..201: mol_type = other DNA
gatattatattttatatttttttattttttttgattyggagtttygttttgtygtttaggtttgggtgtagtagygygatttyggtttattgtaagtttygtttttygggtttatattatttttttgttttagtttttygagtagttgggattataggtgttygttattaygttyggttaattttttgtatttgtagtaga

SEQ ID NO: 15254 - DNA, 201 bp, synthetic construct
  misc_feature 1..201: note = Description of Artificial Sequence: Synthetic polynucleotide
  source 1..201: mol_type = other DNA
tttttttttagaaagtatatgaataggtygggtayggtggtttaygtttgtaattttagtattttgggaggtygaggygggtggattaygttagaagatygagattattttggttaatayggtgaaatttygtttttattaaaaatataaaaaaaaataagtygggygtggtagtgggygtttgtggttttagttattttg

SEQ ID NO: 15255 - DNA, 201 bp, synthetic construct
  misc_feature 1..201: note = Description of Artificial Sequence: Synthetic polynucleotide
  source 1..201: mol_type = other DNA
gtgtgagagttatatgttaggaataagaggtatgtygagaggtggtygggtayggtggtttaygtttgtaattttagtattttaggaggaygaggtgggyggattataaggttaggagatygagattattttggttaatatggtgaaatttygtttttattaaaaatataaaaaattagtygggygtggtggygggygttt

SEQ ID NO: 15256 - DNA, 203 bp, synthetic construct
  misc_feature 1..203: note = Description of Artificial Sequence: Synthetic polynucleotide
  source 1..203: mol_type = other DNA
ttttataaygttttttattatttgtgagtayggtttgtaaygtggaagatataattttatttgattttttttagatttttttgttgttttagttttttaygygttagttttygggtttttattttaaatttttttaggtttagaatgttttgttttaaattttatygatattatttgygaaattgtagttttttatgattaat

SEQ ID NO: 15257 - DNA, 201 bp, synthetic construct
  misc_feature 1..201: note = Description of Artificial Sequence: Synthetic polynucleotide
  source 1..201: mol_type = other DNA
attatatatggtygggygygatggtttaygttatygagtgattgttgtaattttagtattttgggaggtygagaygggaggattaygaggttaggagatygagattattttggttaatayggtgaaatttygtttttattaaaaaaataaaaatattagtygggygtggtggtgggygtttgtagttttagttatttggga

SEQ ID NO: 15258 - DNA, 201 bp, synthetic construct
  misc_feature 1..201: note = Description of Artificial Sequence: Synthetic polynucleotide
  source 1..201: mol_type = other DNA
agttttagttattygggaggttgaggtaggagaatggygtgaattygggaggyggagtttgtagtgagtygagatygygttattgtattttagtttgggygatagagygagatttygttttaaaaaataaaaataaataataataataattttagatattttataataatttttaggtataagagtttttatgagagtagg

SEQ ID NO: 15259 - DNA, 201 bp, synthetic construct
  misc_feature 1..201: note = Description of Artificial Sequence: Synthetic polynucleotide
  source 1..201: mol_type = other DNA
tgggggttttagaatttttgtagtttatatttttttggtttttttttgggtagtttggaggttttygatttttyggagtttttggtatttgagttttttygtgaaagttygttygagaagggtttttgtttygggtttggtagattggagtttttttttgggttttttttttttttttttgggtgttttgtttttygttaa

SEQ ID NO: 15260 - DNA, 201 bp, synthetic construct
  misc_feature 1..201: note = Description of Artificial Sequence: Synthetic polynucleotide
  source 1..201: mol_type = other DNA
aygygttattaygttyggttaatttttgtatttttagtggagayggggttttattatgttggttaggttggttttaaattttttatttygtgattygttygtttyggttttttaaagtgttgggattataggagtgagttattatgttyggttttaattttagttttatagatgaaaaaayggaagtttaggattagtgat

SEQ ID NO: 15261 - DNA, 201 bp, synthetic construct
  misc_feature 1..201: note = Description of Artificial Sequence: Synthetic polynucleotide
  source 1..201: mol_type = other DNA
aagtagtatttggttttttgtttttgtgttaatttatttyggataatggtttttagttgtatttatgttgttgtaaaggatyggattttgttttttttaygattgtatagtattttatggtatatatatatatatattatatttttttaattyggtttatttatgtttttgttgttgtgaatagttttgtaatgaatatgt

SEQ ID NO: 15262 - DNA, 201 bp, synthetic construct
  misc_feature 1..201: note = Description of Artificial Sequence: Synthetic polynucleotide
  source 1..201: mol_type = other DNA
ttaaataaatgtygggtgttagggtygttgagtaagataataggtygtaaggaygtagtagaggattttyggtygatttgttgygatggagtgagttagyggtgaggtttgaaggtttttgttttatttttttttyggagtagaggtyggggagggtgttgggtgttagtatagagtagagggtyggttayggaattgggg

SEQ ID NO: 15263 - DNA, 201 bp, synthetic construct
  misc_feature 1..201: note = Description of Artificial Sequence: Synthetic polynucleotide
  source 1..201: mol_type = other DNA
gggagtgtagtggygygatttyggtttattgtaattttygtttttygggtttaagygatttttttgttttagtttttttagtaggtaggattatagtygygtgttattatattyggttaattttttgtatttttagtagagattgggttttattatgttagttagaatggttttaatttattgatttygtgattygttygt

SEQ ID NO: 15264 - DNA, 201 bp, synthetic construct
  misc_feature 1..201: note = Description of Artificial Sequence: Synthetic polynucleotide
  source 1..201: mol_type = other DNA
ttagtagaaatagggttttattatgttggttagaatggttttgattttttgattttgtgatttgttygtttygtttttttaaagygttgggattataggygtgagttattgygttttgtttattgtttatttttttttgttygttttattttgattgtyggggttttggatattatataaagagttagttggagagtgaga

SEQ ID NO: 15265 - DNA, 201 bp, synthetic construct
  misc_feature 1..201: note = Description of Artificial Sequence: Synthetic polynucleotide
  source 1..201: mol_type = other DNA
ggaatgtagtggygttatttygttgattgtatttttygtttttyggttgtaagtgatttttttgttttagtttttttagtagttgggattataggygtgygttataatatttagttaatttttgtatttttagtagagaygggtttttattaagttggttaggttggtttygaatttttgatttygtgattygtttgtttt

SEQ ID NO: 15266 - DNA, 201 bp, synthetic construct
  misc_feature 1..201: note = Description of Artificial Sequence: Synthetic polynucleotide
  source 1..201: mol_type = other DNA
tatttyggttttttaaagtgttggtgttataggtgtgaattatygtattyggtttgttttttattttattatttatttattttttttgagattgagtttygtttttgttgtttaggttggagtgtgtagtggtttaatttyggtttattgtaaatttygtttttygggtttaagygatttttttgttttagttttttgagt

SEQ ID NO: 15267 - DNA, 3238 bp, synthetic construct
  misc_feature 1..3238: note = Description of Artificial Sequence: Synthetic polynucleotide
  source 1..3238: mol_type = other DNA
ttttttttyggattggtttaatttttttttttaagtttggtattttgtttttttttagygggggatattttgtygttttggggtgttygtygtgggygtygtaygattttgggtgtaagttagagattttataaataygtygggttttgygtagyggttttygggaaggtattgttattygtgggagggttyggttygttattttttattttttgttgttttaaygttattttttaagtttggygtttttttttttttttttggaggttttygtgttgttttggggtgttttttgtgggygagatatataatttgggtgtaagttagggatttygygattatttttggttyggygtaggggtggttatttttgggaygatattatttygttatttttttttttggattgtttttattattttttttaattttggygttttgtattttttttttagtggtttttttgtygttttgtggtgtttttygtgggtgagataygtattyggggtgtaagatagggattttaggaygttttygggtttattgtagaggttgttgggaaggtagtgtygttygtgagaggattttagtattttygtttttttttttyggggttgttttaatttttttttttaagattgaygtgttgtttttttttttygggaatttttttgttgttttgtggtgttygtygtgggtaagatatttattttgggtgtaagttagggaattaataattttygtatgttyggtaaaggggttgtyggtaaggtattgttattygtgggattattttagtttygttgtttttttttttaggttatttaaaygtttttatttaagtttggygttttgttgttttttygygggggattttttgttattttggggtgtttttygtgggygagataygtatattgtgtgtaagatagggatttygygattttttygggattggtataggggttgtagggaaggtattgttattygtgaaaggattttagtttygttttttttttttttgggttgttttaaygtttttttttaagtttggtattttgttttttttttttyggggtttttttgttgttttggggtgttattygtgggygaggtaygtattttgggtgtaaattagggattttaagatttttagggttaggygtaggggatgtygggaagttattgtttttygtggaaagtttttttttggattgttttaaagtttttttttaagtttggtattttgtttttttttttyggagttttttttgtagttttygygtgtatatttaggygagataygtattttgttgtaagatagggattttaaattttttygtttgggttaggtttaggggttgtygggaaggtattgtggtttgtgggaygattatagtttagtygttgtttttttttggttggtttaaygtttttttttaagtttgatatgttgtttttttttttygggggttttgttgttatttttaygtgtatttygtgagtaagataggtattttgggtttaagttaggggttttatygtttatttgggttttatttagaggttgtygggaaggtattgtttttagtggaaatttttttttyggattgttttaaygtttttttttaagttyggygttttgtttttttttattyggggattttttatygtattgyggtgtttatygtgggtaygataygtatttygggtgtaagttagggattttataattattttaggttygatgtaggggttatyggataagatattgttgtttttgggatgatatyggtttgttttaattttattttttaattttggagttttgtattttttttttgggggtttttttgttgttttgtggtgttattygtgggygagatatataatttgggagtaagttagagattttaygatatttttgggtttattgtagaggttgttaggaaggyggtgttattygtgggaggattttagttttattatttttatttyggggtygttttaattttttttttaagtttgaygtgtttttttttttttygggaatttatttgtygttttggggtgtttttttgagygagataygtattttgggtgtaagttayggattttaggattattttggtttagygaaggggttgttaggaaggtattgtygtttgtgggagaaatttagygtygtygtttttttttaygggttattttaaagtttttttttaagtttgaggtgttgttttttttttttaggggtttatttgtygttttggggtgttttttatgggygaaataygtattttgggtgtaagatagggattttaygattttttygggtttagygtagggattgttaggaaggtattgttattygtaggaggaattygattagtygtttttttttttgtgttgttttagtatttttattaaagtttggttttttgtggygttygttyggyggtttttttgttattttggggtgtttttatgggtgygattygtattttyggtgtaagttagggattttaygattatttygggtttgaygtaggggttgttgggaaggtattgtygtttatgggaygattttagtttgttaygttttttttyggattgttttaattattttttttaattttggygttttatatttttttttyggtggtttttttgtygttttgtggtgtttttygagggygagataygtattttgggtgtaagttaaggattttatgaygtttttaggtttattatagatgttgtygggaagatagtgttattygtggtaggattttagtattttttttttattttyggggttgttttaaygtttttttttaagtttgaygtgttgttttttttttttgggaatttatttgtygttttggggtgtttttygtggaattttgggtgtaagtttgggatataataattttttygggtttggtaaaggggttgtygggaaggtatygtggttygtgggaagtttttttttggattgttttaaagtttttttttaagtttggygttttgttttttttttagggggtatttttgtygttttggggtgttttttygtgggygygataygtattttgggtttaagttaggaattttaygataatttygagtttggygtaggggttgtygggaaggtattgtygttygtgtgaygatygttgtttgttgttttttttttygtgttgttttaaygttattttttaygtttggygtttta

SEQ ID NO: 15268 - DNA, 201 bp, synthetic construct
  misc_feature 1..201: note = Description of Artificial Sequence: Synthetic polynucleotide
  source 1..201: mol_type = other DNA
tgttatttygttyggttaattttgtgtgtgtgtgtttttagtagagayggggttttatygtgttagttaggatggtttygattttttgatttygtgattygtttttttyggttttttaaagtgttgggattataggygtgagttatygygttyggttttttgtatattattttttgagatattttgaggtaatagttttgg

SEQ ID NO: 15269 - DNA, 201 bp, synthetic construct
  misc_feature 1..201: note = Description of Artificial Sequence: Synthetic polynucleotide
  source 1..201: mol_type = other DNA
ygaygtttaagtattygagaayggtgattaattattttggagagtatttgtaaaggyggttttttagtygtttttttyggaagtygtagtttttgtgttygttttygtattttgtatatttgttgaggtggggygtgttaattattaaattattaatgagtgatggtttaaattgtaggtagagtaatgaatagatggtgg

SEQ ID NO: 15270 - DNA, 201 bp, synthetic construct
  misc_feature 1..201: note = Description of Artificial Sequence: Synthetic polynucleotide
  source 1..201: mol_type = other DNA
tgtaataagttygggggttgattttgggygtgtygggggygagggggttayggtggagayggataygggygtggggyggtygagatttgtayggtttagygggtatyggtattgyggggttttygtttttagaggattattgttttatattgaagtttttttttttgtatatttagagtttgatgtatttttaattatygt

SEQ ID NO: 15271 - DNA, 201 bp, synthetic construct
  misc_feature 1..201: note = Description of Artificial Sequence: Synthetic polynucleotide
  source 1..201: mol_type = other DNA
gggygtggtggygggtatttgtaattttagttattygggaggttgaggtaggagaatggtgtgaattygggaggtggagtttgtagtgagtygagatygygttattgtattttagtttgggygatagagygagatttygttttaaaaaaaaaaaaaaaaaaaaagaagaagttagagtaaggaggtagaatgatttttagg

SEQ ID NO: 15272 - DNA, 201 bp, synthetic construct
  misc_feature 1..201: note = Description of Artificial Sequence: Synthetic polynucleotide
  source 1..201: mol_type = other DNA
ggttagggygtaygyggygttggggttyggggggatgttygttgtttyggtygtattttggttaygtatatttttgggggyggttgttttattgtagggygygggggyggagttyggtttaagaagagyggtaaagggygggyggttttggyggtttagtttagggttygggagtgtttgggggttttttygtttyggggg

SEQ ID NO: 15273 - DNA, 201 bp, synthetic construct
  misc_feature 1..201: note = Description of Artificial Sequence: Synthetic polynucleotide
  source 1..201: mol_type = other DNA
aaaaagtaaaaaataaaaattagtyggttatagtggtgggtgtttgtaattttaattgttygggaggttgagttaggataatagtttgattttgyggggyggaggttgttatgagttaaaatygtgttattttattttaggttgggygtaagagygagattttgttttaaaaaaaaaaaaaaagttttatgtygggygtyg

SEQ ID NO: 15274 - DNA, 201 bp, synthetic construct
  misc_feature 1..201: note = Description of Artificial Sequence: Synthetic polynucleotide
  source 1..201: mol_type = other DNA
taggygtgagttatygygttyggttatttttgataattttattttaaatagtgataggttaaaagttaagagyggatgttttagtatttagttttttagygttttgttagttattttaagtttgtygataggagtttgattttattgattttttttttttttagagttatgtttattttttaaaattttaagaagttgttt

SEQ ID NO: 15275 - DNA, 201 bp, synthetic construct
  misc_feature 1..201: note = Description of Artificial Sequence: Synthetic polynucleotide
  source 1..201: mol_type = other DNA
atttyggaggttgaggtaggagaatggygtgaaygygggaggtggagtttgtagtgagtygagatygygttttttgattttaggtgatttgtttgttttygtattyggttaatttgtttttgtatatataatttttttattgtttaatatattttagggttttttaattttatattttatattttagtttttttaatagat

SEQ ID NO: 15276 - DNA, 201 bp, synthetic construct
  misc_feature 1..201: note = Description of Artificial Sequence: Synthetic polynucleotide
  source 1..201: mol_type = other DNA
tagggtttygttgtgttggtygggtyggtttttagtttttaatygygagtgattygttaatttyggtttttygaggtgtygggattgtagayggagtttygtttatttagtgtttaatggtgtttaggttggagtgtagtggygtgatttyggtttattataatttatattttttagtygtttgttttggttttttaaaat

SEQ ID NO: 15277 - DNA, 201 bp, synthetic construct
  misc_feature 1..201: note = Description of Artificial Sequence: Synthetic polynucleotide
  source 1..201: mol_type = other DNA
aggtygaggtaggyggattataaggttagaatatygagattattttgggtagtaygatgaaatttygtttttattaaaaaatataaaaaattagtygggygtggtggtyggygtttgtagtattagttgtttaggaggttgaggtaggagaatggtatgaatttgggaggyggagtttgtagtgagtygagattgygttat

SEQ ID NO: 15278 - DNA, 201 bp, synthetic construct
  misc_feature 1..201: note = Description of Artificial Sequence: Synthetic polynucleotide
  source 1..201: mol_type = other DNA
ggtgggtgggttatgaggttaggatattgagattattttggttaatatggtgaaattttgtttttattaaaaatatagaaaattagttgggtatgttggtgggtatttgtaagttttagttatttgggaggttgaggtaggagaatggtgtgattttgggaggtggagtttgtagtgagttgagattatgttattgtattt

SEQ ID NO: 15279 - DNA, 208 bp, synthetic construct
  misc_feature 1..208: note = Description of Artificial Sequence: Synthetic polynucleotide
  source 1..208: mol_type = other DNA
tttatttatttatttttgagatagagttttgttttgttgtttaggttggagtgtagtggtgtgattttggtttattgtaagttttgttttttgggtttatgttatttggttttagttttttgagtagttgggattataggtgtttgttattatgtttggttaattttttatatttttagtagagatagggttttattatgttagttag

SEQ ID NO: 15280 - DNA, 201 bp, synthetic construct
  misc_feature 1..201: note = Description of Artificial Sequence: Synthetic polynucleotide
  source 1..201: mol_type = other DNA
ttttttttttttttttttttttttttgagatggagtttggttttgttgtttaggttggtgtgtagtggtttattgtattttttgttttttgggtttaagtgatttttttattttagttttttaagtagttggggttaaaggtttgtgttattatgtttggttaattttttgtattttagtagagatggggttttattgtgt

SEQ ID NO: 15281 - DNA, 201 bp, synthetic construct
  misc_feature 1..201: note = Description of Artificial Sequence: Synthetic polynucleotide
  source 1..201: mol_type = other DNA
ttgtggtgtaattttagtttattgtaatttttgttggtagggtttaagtaatttttttgttttagttttttgagtagttgggattataggtatgtattatgatgtttggttaatttttgtatttttagtagagatggggttttattatgttgattaggttggttttgaatttttgattttaggtgatttgtttattttggt

SEQ ID NO: 15282 - DNA, 201 bp, synthetic construct
  misc_feature 1..201: note = Description of Artificial Sequence: Synthetic polynucleotide
  source 1..201: mol_type = other DNA
gtgggttttaaatattttataagttagagtaattagaatagtatggtattggtataaagataggtatatagtttgtttggttttgttttgttttgttgttgtgtttgttagttatgagttttatgtagttaaataaaggtttttttgtggatttttggttgaggttaagaattggtttttgtttaaatatgatttttagaa

SEQ ID NO: 15283 - DNA, 201 bp, synthetic construct
  misc_feature 1..201: note = Description of Artificial Sequence: Synthetic polynucleotide
  source 1..201: mol_type = other DNA
tattgatttggaagaatggaatgatagttagtgaggtatatttagtaattgagtatggttagtgttggtttttggtttttgagatattgatttatgtagtgttaggatttggggattttttaggtgtaaattagaggttaaatagtttgtttggttaatgggttagaatttgtggttgaatagaggttttgttgtggtttt

SEQ ID NO: 15284 - DNA, 201 bp, synthetic construct
  misc_feature 1..201: note = Description of Artificial Sequence: Synthetic polynucleotide
  source 1..201: mol_type = other DNA
ttatttttgggggatgagaggagggatggtgagaggatatttttaaagaatatttggggttggggaagaattttttatgattttgttttataatttggttgtttattttgtattttgttgtatgttgtttggtttttggttatgttatgtgaatttttggagttattttttttttttttttatttggatggagagggtttt

SEQ ID NO: 15285 - DNA, 201 bp, synthetic construct
  misc_feature 1..201: note = Description of Artificial Sequence: Synthetic polynucleotide
  source 1..201: mol_type = other DNA
tttaatagatatgaaaattgaaggttgggtgtagtggtttaagtttgtaattttagtattttgggaggttgaggtgggtggattatgaggttaggagattgagattattttggttaatatagtgaaattttgtttttattaaaaatattaaaaattagttgggtgtggtggtgggtgtttgtagttttagttatttgggag

SEQ ID NO: 15286 - DNA, 201 bp, synthetic construct
  misc_feature 1..201: note = Description of Artificial Sequence: Synthetic polynucleotide
  source 1..201: mol_type = other DNA
ttgaatagttgggattataggtgtttgttattgtgtttggtttattttttgtgtgtttttagtagagatggggttttattgtgttagttaggatggttttgattttttgattttgtgatttgtttgttttggttttttaaagtgttgggattataggtttgagttattgtgtttggttaaaataattaatttttgtgttaa

SEQ ID NO: 15287 - DNA, 201 bp, synthetic construct
  misc_feature 1..201: note = Description of Artificial Sequence: Synthetic polynucleotide
  source 1..201: mol_type = other DNA
atggatttttgtggtgagtgttatagtttttaaaggtggtgtgtttggagtttgttttttttgatgtttggatgtgtttggagttttttttggtgggtttgtggttttgttggtttaggagtgaatttgtagatttttgtggtgagtgttatagtttataaaggtagtgtggatttatagagtgaatagtagtaagattta

SEQ ID NO: 15288 - DNA, 201 bp, synthetic construct
  misc_feature 1..201: note = Description of Artificial Sequence: Synthetic polynucleotide
  source 1..201: mol_type = other DNA
tattaaaaataaagaaggaggttgggtgtggtggtttatgtttgtaattttagtattttgggaggttgaggtgggtggtggattatgaggttaggagattgagattatggtgaaattttgtttttattaaaaatataaaaaattagttgggtgtggtggtgggtgtttgtagttttagttattgggaaggttgaggtagga

SEQ ID NO: 15289 - DNA, 201 bp, synthetic construct
  misc_feature 1..201: note = Description of Artificial Sequence: Synthetic polynucleotide
  source 1..201: mol_type = other DNA
gttaagatagtgttattgtattttagtttgggaatagagtgagattttgttttaaaaaaaaattattgatatatataaatatttgtgaaattggttgggtgtggtggtttatgtttgtaattttagtattttggggggttgaggtgggtgtattataaggttaggagattgagattattttggttaatatggtgaaatttt

SEQ ID NO: 15290 - DNA, 235 bp, synthetic construct
  misc_feature 1..235: note = Description of Artificial Sequence: Synthetic polynucleotide
  source 1..235: mol_type = other DNA
gtttatagtttttagagagagtgatgtagaagatgggtgatttttgtatttttatttgaggtattgggtttattttattagggagtgttagatagtgggtgtaggttagtgggtgtgtgtattttgtgtgagttgaagtagggtgaggtattgttttattttggaagtataaggggttagggagtttttttttttagttaaagaaaggggtgatagatggtatttggaaaattgg

SEQ ID NO: 15291 - DNA, 201 bp, synthetic construct
  misc_feature 1..201: note = Description of Artificial Sequence: Synthetic polynucleotide
  source 1..201: mol_type = other DNA
ttttgagtagttggtgttataggtgtttattattatgtttggttaattttttgtatttttagtagagatagggttttattatgttagttaggatggttttgattttttgattttgtgatttgtttgttttggttttttaaagtgttgggattataggtatgagttattgtggttggttttaattatgtatttttatttatt

SEQ ID NO: 15292 - DNA, 201 bp, synthetic construct
  misc_feature 1..201: note = Description of Artificial Sequence: Synthetic polynucleotide
  source 1..201: mol_type = other DNA
ttgattatttaggtgtgtttgttatttttttttttgatttggaaagggaattttttgtttttttgtgttttttaagtgaggtaatgttttgttttgttttggtttgtgtatggtgtatgtatttattgatttgtgtttattgtttggtattttttagtgagatgaatttggtattttagatggaaatgtagaaattatttg

SEQ ID NO: 15293 - DNA, 201 bp, synthetic construct
  misc_feature 1..201: note = Description of Artificial Sequence: Synthetic polynucleotide
  source 1..201: mol_type = other DNA
tgggttgttgggtgtttgggttgtttttttattgtttaggataaattttattttgttttattggttgatggtttgttggggagtttgtgggtgagttggtgtttgtaggtgtgtttttttgttgatatgttttttgtgattagttgtttttgtttttttttattgatgtgttttttttgttttttagtagtttttgttttt

SEQ ID NO: 15294 - DNA, 201 bp, synthetic construct
  misc_feature 1..201: note = Description of Artificial Sequence: Synthetic polynucleotide
  source 1..201: mol_type = other DNA
tatttggtttggagggttttatgtttattgagttttgttgattgttagtatagtagtttgagattaaattgtaaggtagtagtgaggttgggggaggggtgtttgttattgtttaggtttgtttaggtaaataaagtagttgggaagtttgaattgggtggagtttattatagtttaaggaggtttgtttgtttttgtagg

SEQ ID NO: 15295 - DNA, 201 bp, synthetic construct
  misc_feature 1..201: note = Description of Artificial Sequence: Synthetic polynucleotide
  source 1..201: mol_type = other DNA
ttgttttgtagtttgattttagattgttgtgttagtaattagtgagattttgtgggtgtaggattttttgagttaggtgttggatataatttttaggtgtgttgttttttaagtttgttggaaaagtgtagtattttggtgggagtgatttgattttttaggtgttttttgttatttttttttttgattaggaaagggaat

SEQ ID NO: 15296 - DNA, 201 bp, synthetic construct
  misc_feature 1..201: note = Description of Artificial Sequence: Synthetic polynucleotide
  source 1..201: mol_type = other DNA
agtgatgtagaagatgggtgatttttgtatttttatttgaggtattgggtttattttattaagggagtgttagatagtgggtgtaggttagtgggtgtgtgtattgtgtgtgagttgaagtagggtgaggtattgttttatttgggaagtataaggggttagggagttttttttttgagttaaagaaaggggtgatggatg

SEQ ID NO: 15297 - DNA, 201 bp, synthetic construct
  misc_feature 1..201: note = Description of Artificial Sequence: Synthetic polynucleotide
  source 1..201: mol_type = other DNA
tattaggatattttggttgtagagaggagttatttattgtgagttttttttgagttgttttattatttagtaaagtttttttttattttgtttattttttgtttgtttatgtatgttattgtttttgggtgttgaatttgttaaatggtggaggtgaaagagttttaatataaatagagttgaaatatgttttttgtttgt

SEQ ID NO: 15298 - DNA, 201 bp, synthetic construct
  misc_feature 1..201: note = Description of Artificial Sequence: Synthetic polynucleotide
  source 1..201: mol_type = other DNA
gttggagtgtaatggtatgattttggtttattgtaatatttgttttttgggatttagtaatttttttgttttagttttttgagtagttgagattataggtgattattattatgtttggttgatatttgtatttttagtagagatggggttttattatgttggttaggttggttttgaatttttgattttaggtgatttgtt

SEQ ID NO: 15299 - DNA, 201 bp, synthetic construct
  misc_feature 1..201: note = Description of Artificial Sequence: Synthetic polynucleotide
  source 1..201: mol_type = other DNA
tattgttggtattagtatttggaagaggggaatattgtggtttttgaaaatttggagttgttagtaattgaggagttttaaggagtgagatgggggtgttgttttattatttttttatttttgtagttggtagttttgttagtggtgggggttgggttgaggggtggtggtatattaggggggtggtggtatatattatag

SEQ ID NO: 15300 - DNA, 201 bp, synthetic construct
  misc_feature 1..201: note = Description of Artificial Sequence: Synthetic polynucleotide
  source 1..201: mol_type = other DNA
gttttttggtattattagtatttgggttttttggagtggaagtggttggttggggatatgtagtttatagaggtttagatgaaaatttggttttaaaattgttagatgaaatatgaatggtaaatgtaggatttatagttgaatagtttttttttggggtttttttatgtgtttgggttttttatttattgttttttggtt

SEQ ID NO: 15301 - DNA, 207 bp, synthetic construct
  misc_feature 1..207: note = Description of Artificial Sequence: Synthetic polynucleotide
  source 1..207: mol_type = other DNA
attagagtagaggggtttttttattttttgtttagttttttgatttggttttttattttttaggaaatatattttggtttgaggtttatttgttgttgttgttgttggaggagttggttttgaatgagttggtgatgttgatgtgtttggtatgtggttttagttttaaggatgtgttggtttgttggttgtaggggttataggagt

SEQ ID NO: 15302 - DNA, 201 bp, synthetic construct
  misc_feature 1..201: note = Description of Artificial Sequence: Synthetic polynucleotide
  source 1..201: mol_type = other DNA
atattaggggaagaagatataagtgttggttatttataggagtattttagtagaaggatatgttgataggtatttggaagttagtaggttgtggattagtgggaggaggtggaggttggtttgggtagttaggggagagttggggttgttgagtattttaattttaggggaaaattattttttttttggttgttttatggg

SEQ ID NO: 15303 - DNA, 201 bp, synthetic construct
  misc_feature 1..201: note = Description of Artificial Sequence: Synthetic polynucleotide
  source 1..201: mol_type = other DNA
ttgattttttaggtgtgtttgttatttttttttttgatttggaaagggaattttttgattttttgtgttttttaagtgaggtagtgttttgttttgttttgtgtatggtgtatgtatttattgatttgtgtttattgtttggtattttttagtgagatgaaattggtattttagatggaaatgtagaaattatttgttttt

SEQ ID NO: 15304 - DNA, 201 bp, synthetic construct
  misc_feature 1..201: note = Description of Artificial Sequence: Synthetic polynucleotide
  source 1..201: mol_type = other DNA
ttatgttttaggtatattgatatttttgtattggttttttttaggaggttatgttttaggtatatgggtatttttatattgattttttttagtaggttatgttttaggtatatgggtatttttatattgattttttttgggaggttatgttttaggtatatgggtatttttatattggttttttttaggaggttatgtttt

SEQ ID NO: 15305 - DNA, 201 bp, synthetic construct
  misc_feature 1..201: note = Description of Artificial Sequence: Synthetic polynucleotide
  source 1..201: mol_type = other DNA
gtttttttgtttggttgtttagtttgggaagtgaggagtgtttttttttggttgttattttgtttaggaagtgaggagtgtttttgtttggttatttattgtttgggatgtggggagtatttttgttaggttgtgattttatttgggaattgaggagtgtttttgttttgttattattttatttgggaggtgaggagtgtt

SEQ ID NO: 15306 - DNA, 201 bp, synthetic construct
  misc_feature 1..201: note = Description of Artificial Sequence: Synthetic polynucleotide
  source 1..201: mol_type = other DNA
gagggagatgtggggtgggaattggggttgtttgtggtaggttagagtaagttttgggtggatatggttttggtgggttttatattttgagtagttggttgttttattagttttgggtagtgaggggtttattatttgggatagtagttgtggagggtgtgttgagttttttagtagtgttagtttgttggtgttgtgttc

SEQ ID NO: 15307 - DNA, 201 bp, synthetic construct
  misc_feature 1..201: note = Description of Artificial Sequence: Synthetic polynucleotide
  source 1..201: mol_type = other DNA
tttgattaaaaataaataaatatggttgggtgtggtggtttaggtttgtaattttagtattttgggaggttgaggtggtggattataatgttaggagattgagattattttggttaatatggtgaaattttatttttattgaaaatataaaaaattagttgggtgtggtggtgggtatttgtagttttagttatttaggag

SEQ ID NO: 15308 - DNA, 201 bp, synthetic construct
  misc_feature 1..201: note = Description of Artificial Sequence: Synthetic polynucleotide
  source 1..201: mol_type = other DNA
tggttagggggtatttttagatgtatagaagttttggaggttatggtaagtttgtaattgggatttgtttttaggtttatatgtgtagttttttagttgtgtaatttttttaaatggagtagttttggtgtgggtggggtttgggttggtagtgggggtggggttggtagtgggggtggggttagttgggggaggaggggg

SEQ ID NO: 15309 - DNA, 201 bp, synthetic construct
  misc_feature 1..201: note = Description of Artificial Sequence: Synthetic polynucleotide
  source 1..201: mol_type = other DNA
tatggtgaaattttatttttattaaaaatataaaaattagttgggtgtggtagtgtatgtttgtaattttagttatttgggaggttgaggtaggattattgtttgaatttggaaggtggaggttgtagtgaattaagagagtggttttgtattatagtttgaatgatagagtaagattttattttaaaataattaattaat

SEQ ID NO: 15310 - DNA, 201 bp, synthetic construct
  misc_feature 1..201: note = Description of Artificial Sequence: Synthetic polynucleotide
  source 1..201: mol_type = other DNA
attatgtttggttaattttttttttttgtatttttagtagagatggggttttattgtgttagttaggatggttttgattttttgattttataatttgtttgttttggttttttaaagtgttgggatgataggtgggagttattgtgtttggtttaatttagtgtttgatatttgaagatgatttgggttagaggagattgt

SEQ ID NO: 15311 - DNA, 201 bp, synthetic construct
  misc_feature 1..201: note = Description of Artificial Sequence: Synthetic polynucleotide
  source 1..201: mol_type = other DNA
agtgagttgttgatgttagtgagatgttaggttggatttagtaagttgttgatgttagttagatgtagagtagagaatgttggttaaagagtagttaggtggtgtttgtttggttgaagtttagttttggagaggtaggttttgtattaggatgtggaggttttggggttatgaaatttttagggtgagagataaaggtag

SEQ ID NO: 15312 - DNA, 380 bp, synthetic construct
  misc_feature 1..380: note = Description of Artificial Sequence: Synthetic polynucleotide
  source 1..380: mol_type = other DNA
tttttttttttttttttagatggagtttagttttgtttttatgttgtagggtagtggtgtggttttggtttattgtaatttttgttttttgggtttttgtgatttttttgttttagttttttgagtagttgggattataggtatatgttattatgtttagttaatttttgtttgtttgtttatttatttattattatttttgagatggagttttgttttgttattaggttggagtgttattggagtgtaatggtatgattttggtttattgtaatttttgttttttgggtttaagtaatttttttgttttagttttttgtgtaattgggattataggtatgtgttattatttttagttaattttttgtattttagtagag

SEQ ID NO: 15313 - DNA, 201 bp, synthetic construct
  misc_feature 1..201: note = Description of Artificial Sequence: Synthetic polynucleotide
  source 1..201: mol_type = other DNA
gagtgtaatggtgtgattttggtttattgtaagttttgttttttgggtttatgttatttttttgttttagttttttaagtagttgggattagaggtgtttgttgttatgtttagttaattttttgtatttttagtagagatggggttttattgtattagttaggatggttttgattttttgattttgtgatttgtttgttt

SEQ ID NO: 15314 - DNA, 201 bp, synthetic construct
  misc_feature 1..201: note = Description of Artificial Sequence: Synthetic polynucleotide
  source 1..201: mol_type = other DNA
tatagggtgttgaaattaagttatttagggagtttgtagattttattttttttggtgagagagtttggtggggagtattttatttaatgtagggaatagtgttattgtggtttttattttttggttttaagtgatttatttgttgtagttttttaagtagttgggattataggtgtgtgttattatgttgggttagttttt

SEQ ID NO: 15315 - DNA, 201 bp, synthetic construct
  misc_feature 1..201: note = Description of Artificial Sequence: Synthetic polynucleotide
  source 1..201: mol_type = other DNA
ttttttttttgggggtttttttatgttttatgtagtttatggtgtggggtttattggttttggtggggtggaaggttttatgttgttgttgttttatgttgttggtggtgggggtttgttgggggttgggaggaaggtaaataggaagggtttattggggagagggtgggggagtatgttatagttgttgtagtttgttgt

SEQ ID NO: 15316 - DNA, 201 bp, synthetic construct
  misc_feature 1..201: note = Description of Artificial Sequence: Synthetic polynucleotide
  source 1..201: mol_type = other DNA
tttaggtgtgtttgttatttttttgatttggaaagggaattttttgattttttgtgttttttaagtgaggtaatgttttattttgttttggtttatgtatggtgtgtgtatttattgatttgtgtttattgtttggtattttttagtgagatgaatttggtattttagatggaaatgtagaaattatttgttttttgtgtc

SEQ ID NO: 15317 - DNA, 201 bp, synthetic construct
  misc_feature 1..201: note = Description of Artificial Sequence: Synthetic polynucleotide
  source 1..201: mol_type = other DNA
ggttgtagtgtagtggtgtgatttttgtttattgtaagtttttttttttgggtttatgttatttttttgttttagtttttgagtagttgagattataggtgtttgttattatatttggttaattttttgtaaaaaatttaaaaaaaaaattaaagataaaatgggtttggtagtatgatattttttatttttaattatttg

SEQ ID NO: 15318 - DNA, 201 bp, synthetic construct
  misc_feature 1..201: note = Description of Artificial Sequence: Synthetic polynucleotide
  source 1..201: mol_type = other DNA
ttttgttttttttaagtgttggttaggttgagaaataaagggatagagtataaaagagggaaattttaaagttgggtatttgggggagatattatatgttggtaggttttgtgatgtttttgagttgtaaaattagtaagtttttattagggatttttaaaaggggagggagtgtatgaatagggtgtgggttatagagat

SEQ ID NO: 15319 - DNA, 201 bp, synthetic construct
  misc_feature 1..201: note = Description of Artificial Sequence: Synthetic polynucleotide
  source 1..201: mol_type = other DNA
agtagtgtttttataaataggtgtgaaaattgagtatgttttgggttggttagttgaattattgtgtgtagagagggagttttggttgtataggtatagtggtggattatgtttttatatatgttgtttgtatagaaaatggagaataagtttttttttgggttgggtttttaagattataataataagagtttgttaaag

SEQ ID NO: 15320 - DNA, 201 bp, synthetic construct
  misc_feature 1..201: note = Description of Artificial Sequence: Synthetic polynucleotide
  source 1..201: mol_type = other DNA
ttttaggggttttaaattggagttttatttttaggatttataaaattttagatatagttaggatttgttagggagattagttttttttggtagtttgggtgttgttgtttttaatatatagtgataatttggaatttatttttagagttatttagaaatatgttttggagatggtgttttttgaaagatttttatttttaa

SEQ ID NO: 15321 - DNA, 201 bp, synthetic construct
  misc_feature 1..201: note = Description of Artificial Sequence: Synthetic polynucleotide
  source 1..201: mol_type = other DNA
ggatgtttggttatatttgattttttatttttgggtatggaggtttgtttgtagaggtttgggtttgggtataaagggagagagaggtttttattgttttgtaggggttgaaatgtagattgtgtatttttggtgattttggggatttttttttgattattaggatttttttggattttagggtttttgttttgtttaggt

SEQ ID NO: 15322 - DNA, 201 bp, synthetic construct
  misc_feature 1..201: note = Description of Artificial Sequence: Synthetic polynucleotide
  source 1..201: mol_type = other DNA
ttagtagagatggggttttattgtgttagttaggatggttttgattttttgattttgtgatttgtttgttttggttttttaaagtgttgggattataggtgtgagttattgtgtttggttatttattttttttaagagatggttgatatgattttaatttttttaaatttttgaagatttgttttgtgatttagtatgtga

SEQ ID NO: 15323 - DNA, 568 bp, synthetic construct
  misc_feature 1..568: note = Description of Artificial Sequence: Synthetic polynucleotide
  source 1..568: mol_type = other DNA
aggtggagttgtttgttagtttggtgttgtgtgtttgtattttttagtttttgggtagttgatgggattgggtgttgtggaataggggttggtgtttgttggggaggtttgggttgtataggagtgtatggtgggggtggaggtttaggtatggagggttgtaggttttgagttttgtttggtggggaggtagttaaggtttagtgagaagttgagtatagtagttgttggtttaggtgttaagttttttattgtttgggttggttggttgttttgagtgtggggtttgttaagtttatgtttatttggaatttgagttggtttgtaagtgtagtttgtagttatggtttttgtttatgtttttttttttatatttatttgtaagttgagggagttggttttagttttgtttagtttagaaaggggtttttatagtgtagtgatgggttgaagggttttttaaatgtggttagagtgggtgttaaggttgaggaggtgttgagagggagtgagggttgtgagggttgttagtatgttgttattttttatttttgtgtttgtatattaa

SEQ ID NO: 15324 - DNA, 201 bp, synthetic construct
  misc_feature 1..201: note = Description of Artificial Sequence: Synthetic polynucleotide
  source 1..201: mol_type = other DNA
ttttttttttttttttttttttttttttttttgagatggatttgtgttttgttgtttaggttggagtgtagtggtgtgatttttgtttattgtaagttttgttttttgggtttatgttatttttttgttttagttttttgagtagttgggattataggtatttattatgatgtttagttaattttttgtatttttagtaga

SEQ ID NO: 15325 - DNA, 201 bp, synthetic construct
  misc_feature 1..201: note = Description of Artificial Sequence: Synthetic polynucleotide
  source 1..201: mol_type = other DNA
attttagagaagtttatgggagttttagggagagttttttttgtgaagggtagggtattttggaatgggtttgttgagtttgtttttatttggaatttatgtttgtttataagtgttttatatagttttggtttttatttgtgtttttttttttatatttttttgtaagtagagggagttaattttggttttggttagttt

SEQ ID NO: 15326 - DNA, 201 bp, synthetic construct
  misc_feature 1..201: note = Description of Artificial Sequence: Synthetic polynucleotide
  source 1..201: mol_type = other DNA
ggataaagaaaatgtggtatatggttgggtatggtggtttatgtttgtaattttggtattttgagaggttaaggtgggtagattatgaggttaggagattgagattattttggttaatatgatgaaattttatttgtattaaaaaatataaaaaattagttaggtatggtggtgggtgtttgtagttttagttatttggga

SEQ ID NO: 15327 - DNA, 201 bp, synthetic construct
  misc_feature 1..201: note = Description of Artificial Sequence: Synthetic polynucleotide
  source 1..201: mol_type = other DNA
ttgtattttagtttgggggatagagtgagattttgttttaaaaaagaaagaaaaaaatgtttttttttttttgttttttttgatttttattttgttttgtgggttttttattaataattgtttgtgtttgatttgggtgttttttttattataattttttttttaggtgtatgtttttataataaagtttattttatggtt

SEQ ID NO: 15328 - DNA, 201 bp, synthetic construct
  misc_feature 1..201: note = Description of Artificial Sequence: Synthetic polynucleotide
  source 1..201: mol_type = other DNA
ttagttttatttatgtgttatttatggataagggtaattattagtagtagtgattatgtgtgttaggtatttgtaggtttttttttgttttttgaattatgtgttatgtttagtttagggatgataaattgaggtgtatgagtaggtgagaagatgaatagtgtatttgggtaaggttgttagtttttttgtgtttttgtg

SEQ ID NO: 15329 - DNA, 201 bp, synthetic construct
  misc_feature 1..201: note = Description of Artificial Sequence: Synthetic polynucleotide
  source 1..201: mol_type = other DNA
ttattattgatatttattttttttttatttatagtatttgtatgtatgttaagaattggattggtaagagtgagtttagtaatgagtttattattatggtggatgaggtaggtatgtgggattgggtggaattttgttttagaggagtttgggagttaatttttgagggtttagatgtttaaatgtagaagtagatttttg

SEQ ID NO: 15330 - DNA, 201 bp, synthetic construct
  misc_feature 1..201: note = Description of Artificial Sequence: Synthetic polynucleotide
  source 1..201: mol_type = other DNA
gtgggaggtgtgtaagtgatatattgaggggtttaggtagtagtttttatatgttgttaggttagagtagttttgggttatgtgggtgtttttagttgttgttgtaggtggaggtatgttggttttttaaggatgtgatagtggttggatttttatgattattgtttggttattagagggtaagttttagggttagttaag

SEQ ID NO: 15331 - DNA, 201 bp, synthetic construct
  misc_feature 1..201: note = Description of Artificial Sequence: Synthetic polynucleotide
  source 1..201: mol_type = other DNA
gggttggttttgggttgtttggggtttttgtgatttttatatttattttttttgtagggtgtggtgttgggttttatggtgggttttatgatttatgggtggtgttaattttagtttttggatatgatgatgtggtgtttgattttgtttttttgtgaggttttggttaagttaattatgttggtggatgttgatgttgag

SEQ ID NO: 15332 - DNA, 201 bp, synthetic construct
  misc_feature 1..201: note = Description of Artificial Sequence: Synthetic polynucleotide
  source 1..201: mol_type = other DNA
taatattgtttgtaaatgattgaattggtttttgatttttttagagaagattgtgtatagatatttggatgattttattagttaggaaattgagtggggtgggatgtatttgtagtagtggttggatagtgtgattatgtaggatggatggtttagatggttatgttgtagtttattagtagtaggtttttaaggtgatta

SEQ ID NO: 15333 - DNA, 201 bp, synthetic construct
  misc_feature 1..201: note = Description of Artificial Sequence: Synthetic polynucleotide
  source 1..201: mol_type = other DNA
ttggatagtaaatatgtgtgggttttttttgtgttggatagtaaatatgtgtgggtttttttgtgttaaatggtaaatatgtgtgggttttttgtgtgttgaatagtaaatatgtgtgggttttttttgtgtttgatagtaaatatgtgtgggttttttgtgtgttggatgataaatatgtatgggtgttttgtgtgttgg

SEQ ID NO: 15334 - DNA, 201 bp, synthetic construct
  misc_feature 1..201: note = Description of Artificial Sequence: Synthetic polynucleotide
  source 1..201: mol_type = other DNA
gttttattatgttggttaggttggtttttttaatttttgattttgtgatttatttattttggttttttaaagtgttgggattataggagtgagttattgtgtttggttgagatttttatgttattattttatgaagtttttggtataatgtttgatatatagtaggtatttgataagtggagtttttattgttgttttttt

SEQ ID NO: 15335 - DNA, 201 bp, synthetic construct
  misc_feature 1..201: note = Description of Artificial Sequence: Synthetic polynucleotide
  source 1..201: mol_type = other DNA
gagttaggtgtgggatatagttttgtggtgtgttgttttttaagtttgttggaaaagtgtagtatttgggtgggagtgatttgattttttaggtgtgtttgttatttttttttttgattaggaatgggaattttttgattttttgtgttttttgagtgaggtaatgttttgttttgttttggtttgtgtatggtgtgtgta

SEQ ID NO: 15336 - DNA, 201 bp, synthetic construct
  misc_feature 1..201: note = Description of Artificial Sequence: Synthetic polynucleotide
  source 1..201: mol_type = other DNA
ttttttggagttaattgtgtttttattattttaaatagagtagttgggattgggtgttgtgttttatgtttataattttagtattttgtgaggttgaggtgggtagattatgaggttaggagattgagattattttggttaatatggtgaaaatttgtttttattaaaaatataaaaaattttttgggtgtggtggtgggc

SEQ ID NO: 15337 - DNA, 201 bp, synthetic construct
  misc_feature 1..201: note = Description of Artificial Sequence: Synthetic polynucleotide
  source 1..201: mol_type = other DNA
ttgatagagtgaaatggtggtggtggttgggatgatgttgttgggtttgttataggtgggtgggtaggtgttgggttaggtgatggaggaggtggtaggtggtaattttttgtttatgttgttgattgtttgtgtttttatttttagtttggtttatttgttttgttttgttgttggttatttggtttagttgattgtagg

SEQ ID NO: 15338 - DNA, 201 bp, synthetic construct
  misc_feature 1..201: note = Description of Artificial Sequence: Synthetic polynucleotide
  source 1..201: mol_type = other DNA
gtgaaattttgtttttattaaaaatattaaaaaaattagttggtgtggtggtaggtgtttgtagttttagttatttgtaaagttgaggtaggagaatggtgtgaatttgggaggtggagtttgtagtgagttgagattgtgtttttgtattttagtttgggtgatagagtgagattttgttttaaaaaaaaagtagtttgg

SEQ ID NO: 15339 - DNA, 201 bp, synthetic construct
  misc_feature 1..201: note = Description of Artificial Sequence: Synthetic polynucleotide
  source 1..201: mol_type = other DNA
tttttatttttgtttttgagatggagttttatttttatttaggttggagtgtagtagtatgatttgggtttattgtaatttttgttttttgggtttagttgatttttttgttttagttttttaagtggttggaattataggtatatattattatatttggtaaatttttttttttttttttttgtatttttagtagattgt

SEQ ID NO: 15340 - DNA, 201 bp, synthetic construct
  misc_feature 1..201: note = Description of Artificial Sequence: Synthetic polynucleotide
  source 1..201: mol_type = other DNA
tatggtgaaattttgattttgttaaaaatataaaaattagttgggtgtggttgtgagtatttgtaattttagttatttgggaggttgaggtaggagaattgttagaatttgggaggtggaggttgtagtgagttaagatggtattattgtattttagtttgggtaatagagtgagattttattttaaaataaaaaaaaata

SEQ ID NO: 15341 - DNA, 201 bp, synthetic construct
  misc_feature 1..201: note = Description of Artificial Sequence: Synthetic polynucleotide
  source 1..201: mol_type = other DNA
atttgttttaaggattggaagaggaaaattaaaaatattatttgaaaggttggatgtggtggtttatatttgtaattttagtattttgggaggttaaggtgggtggattatgaggttaggagtttgagattagtttggttaatataatgaaattttgtttttattaaaaatataaaaattagttgggtttggtggtaggta

SEQ ID NO: 15342 - DNA, 201 bp, synthetic construct
  misc_feature 1..201: note = Description of Artificial Sequence: Synthetic polynucleotide
  source 1..201: mol_type = other DNA
tgtagtggtataatttttgtttttgtaattttttttttttggttttaagtgatttttgtgttttagtttttaagtagttgggattataggtttgagttttgtttggttaattttttttatatttttagtagagatggggttttattatgttggttaggttggttttgaatttttgattttaagtgatttgtttattttggt

SEQ ID NO: 15343 - DNA, 201 bp, synthetic construct
  misc_feature 1..201: note = Description of Artificial Sequence: Synthetic polynucleotide
  source 1..201: mol_type = other DNA
aatatgggtggttttgtgtaggatgggggttttagggttgtttgagttggaggatagtttgtagtttttattgtttgtagttgaagtgtgttgtgagattgttgtaggggtttgggttatttttgttttgggggattttaaaaagttgagttatatttatgttgaaatttttattgaggataattatgtattatatagatt

SEQ ID NO: 15344 - DNA, 201 bp, synthetic construct
  misc_feature 1..201: note = Description of Artificial Sequence: Synthetic polynucleotide
  source 1..201: mol_type = other DNA
agtttttgttgattttagtatgagttgtttatatatatttaaggttggtagtatagtggtatatgtggtaaaattgagtaggtgtggatgggaagggagtgtattagtttgtgtgtgaaggttatatttaggggtggagggaggggagaaatatttttgttgtatttgtagtgttttattttttttagtaatttaaaatgt

SEQ ID NO: 15345 - DNA, 234 bp, synthetic construct
  misc_feature 1..234: note = Description of Artificial Sequence: Synthetic polynucleotide
  source 1..234: mol_type = other DNA
ttttgttgatgtagtgtttgttgttgtttttggatgattttagtggtgaagtggtgtattatgttataggtttgttggaatttttgtttatttgttgagtggtagtaaatgaagttgaggtagtggtgtaagtgatattggtgttggatagatagagtgtttagtttaatgatagtggagatataattatttatttttttgttaaggagaaggggatttatgagtgtagttttt

SEQ ID NO: 15346 - DNA, 201 bp, synthetic construct
  misc_feature 1..201: note = Description of Artificial Sequence: Synthetic polynucleotide
  source 1..201: mol_type = other DNA
tagtttttttatttgtgtagtgggtgtaatgttgatgattgtttttgggaagttagatggtgtttgggaggtgttgagttggggttgatatagagtgagtgttttgtgaagtatttgggttttgtgatgtttttaagtttatagatgtattatgttatgaggaatatatttgggttggtgatgttggagataagggatttt

SEQ ID NO: 15347 - DNA, 201 bp, synthetic construct
  misc_feature 1..201: note = Description of Artificial Sequence: Synthetic polynucleotide
  source 1..201: mol_type = other DNA
tagtgagtatagattgtgttattgtattgtagtttgggtgatagaagtgaaaagaaatattgttttaaaaaaaaaataggagggaggagttaagatggttgaataggaatagttttggtttatagtttttagtgtgagtgatgtagaagatgggtgatttttgtatttttatttgaggtattgggtttattttattaggga

SEQ ID NO: 15348 - DNA, 201 bp, synthetic construct
  misc_feature 1..201: note = Description of Artificial Sequence: Synthetic polynucleotide
  source 1..201: mol_type = other DNA
gatgaaattttgtttttattaaaaatataaaaatttagttgggtgtggtggtggatgtttgtagttttagttatttaggaggttgaggtaggtgaatggtgtgaatttgggaggtggagtttgtagtgagttgagattgtgttattgtattttagtttgggtgatagagtgagattttgttttaaaaataaaataaaatta

SEQ ID NO: 15349 - DNA, 201 bp, synthetic construct
  misc_feature 1..201: note = Description of Artificial Sequence: Synthetic polynucleotide
  source 1..201: mol_type = other DNA
gtgagtgtggggtttagttggttgttttaagtattggtatataggtaggttttaggtagggtttgtagttggattaggtatgttattttgaagggaatgtggtggtattttaagaggggtgtttagattttgaagttttggaaggggtgattttatttgttaattagtttttttagttttgttatttgtagttttagggat

SEQ ID NO: 15350 - DNA, 201 bp, synthetic construct
  misc_feature 1..201: note = Description of Artificial Sequence: Synthetic polynucleotide
  source 1..201: mol_type = other DNA
gtgtggttttttagttagggtagtttgaaatttaggaatgttttaaggttattttgtgggaattgtggtgttagggtttttgaatatttttttgttttttgagttgagttgttttatttgttttttaaatgggttttgggaggaaggtttgtgtgtttttttaaggtgaggagttattgatgtaaattttttgtaaggatt

SEQ ID NO: 15351 - DNA, 201 bp, synthetic construct
  misc_feature 1..201: note = Description of Artificial Sequence: Synthetic polynucleotide
  source 1..201: mol_type = other DNA
ggggatttagtttatgtgtgtgggggttgtgtgtgtttgttttgtttgtttatgtatgttatatatgtgagagtttatagtgagggtagtttttatatgtgatggtttagaggagtgagtattttaggttttttagtatgtttttgtgttgattttttgtagtattgttgggagttatgtgagtgtttatgtttgtgtgtg

SEQ ID NO: 15352 - DNA, 201 bp, synthetic construct
  misc_feature 1..201: note = Description of Artificial Sequence: Synthetic polynucleotide
  source 1..201: mol_type = other DNA
tttatttgttttttgtttttttttttgttggatttgaggtgttgtttttgttgtgttgtttttgtgttatgttatgttatgttatgttatgttatgttatgtttttatgttatgtttatgttatgtttttattttttgtttatagggaaatgggttttggtgatgtgagggtgtttgttgtgtttggtgtttttatagggg

SEQ ID NO: 15353 - DNA, 201 bp, synthetic construct
  misc_feature 1..201: note = Description of Artificial Sequence: Synthetic polynucleotide
  source 1..201: mol_type = other DNA
agtttttaaagttttaatttttttttttttttttttttttttttttttttttttttgagttggagttttattttgttgttaggttggagtgtagtggtgtgattttagtttattgtaatttttgtgttttgggtttaagggatttttttgttttagttttttgagtagttgagattgtaggtatgtgttattatgtttagt

SEQ ID NO: 15354 - DNA, 201 bp, synthetic construct
  misc_feature 1..201: note = Description of Artificial Sequence: Synthetic polynucleotide
  source 1..201: mol_type = other DNA
ttgtaggatagttttaaaaaggaaggttattttttttttgtttattattgtagtttgttaattaattagaaggtaggtgttgagatagtaataattagttgatagttgtggaggattgttgggatttttatagagtttgataagtgggattatagttattattagttattgagaagagtgttttttatttatagagtgtaa

SEQ ID NO: 15355 - DNA, 201 bp, synthetic construct
  misc_feature 1..201: note = Description of Artificial Sequence: Synthetic polynucleotide
  source 1..201: mol_type = other DNA
ttaaatttttagagggtttattgtaagattttttttgggtttgaaagtttaagatgaataatttttttttttttaggtttagttttaaggtgtaatttgtgttagtagggtgtgttagtagggtgtgttagtagggtgtgttagtagggtgtgttagtagggtgtgttagtagggtgtgttagtagggtgtgttagtaggg

SEQ ID NO: 15356 - DNA, 686 bp, synthetic construct
  misc_feature 1..686: note = Description of Artificial Sequence: Synthetic polynucleotide
  source 1..686: mol_type = other DNA
attatgttttagtttttttggttgtttttatttttaaatatttgaaaaatagaggtgttgggtgtgaggtggagagatgtataggtttggttttggttttgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgtgagttttgttttgttttgtattaagtttgtattttttaggtttttggtatttttgtttttgggatgtggggtttttatagatttggaaatttttgtttgtttttttttatttagagtaaattgagatgtttataagagtttggaagttgtttttttttgggtttgaagttgtttggaggttggttttgtttttggtttttttgttatagggtaatgtatatattttttattgtatagtttttttgtttaaaattttgttgatttattttgttttttgttttttaaagtttttatttgtgtgttggatttttgttttgggtgttttttagtttttgttggttttttttggagtgtagtgttggggttttagttttggggaggttgggttttttgtttggttttgggagtttgtaggtgttat

SEQ ID NO: 15357 - DNA, 201 bp, synthetic construct
  misc_feature 1..201: note = Description of Artificial Sequence: Synthetic polynucleotide
  source 1..201: mol_type = other DNA
aggttggtagattatgaggttaggagattgagattgttttggttaatatggtgaaattttgtttttattaaaaatataaaaattagttgggtgtggtggtgtgtttttgttttagttgttggggaggttgaggtaggagaatggtgtgaatttgggaggtggagtttgtagtgagttgagattgtattattgtattttagt

SEQ ID NO: 15358 - DNA, 201 bp, synthetic construct
  misc_feature 1..201: note = Description of Artificial Sequence: Synthetic polynucleotide
  source 1..201: mol_type = other DNA
tattgtaagttttgttttttgggtttatgttgttttgttgattttgtgatttgttttgttttggttttttaaagtgttgggattataggtgtgagttattgtgtttggttaatagtttttaatattaattatttagagtgtgtaataatttggaaaagggtttttttttttttttttgtttttagagatagggtttttggt

SEQ ID NO: 15359 - DNA, 201 bp, synthetic construct
  misc_feature 1..201: note = Description of Artificial Sequence: Synthetic polynucleotide
  source 1..201: mol_type = other DNA
tgggagtgatttgatttttaaggtgtgtttgttatttttttttttgatttagaaagggaattttttgattttttgtgttttttaagtgaggtagtgttttgttttgttttggtttgtatatggtgtatgtatttattgatttgtgtttattgtttggtattttttagtgagatgaatttggtattttagatggaaatgtag

SEQ ID NO: 15360 - DNA, 201 bp, synthetic construct
  misc_feature 1..201: note = Description of Artificial Sequence: Synthetic polynucleotide
  source 1..201: mol_type = other DNA
attttataaaaatgaaaattaaataagtataagaatggttatatttgggggaggagttaatatggttgaataggaatagttttggtttatagtttttagtgtgagtgatatagaagatggtgatttttgtatttttaattgaggtattgggtttattttattagggattgttagatagtgggtgtaggttagtgggtgtgt

SEQ ID NO: 15361 - DNA, 201 bp, synthetic construct
  misc_feature 1..201: note = Description of Artificial Sequence: Synthetic polynucleotide
  source 1..201: mol_type = other DNA
tggggttttattttgttagttaggatggttttgattttttgattttgtggtttgtttgttttggttttttaaagtgttgggattatagatttgaattattgtgttgggttagttttgtgggtttttaatgtgtttttttttatttgtaatttagagttagaagaggttagtgttgataggtaggtagtagttatatgaaaa

SEQ ID NO: 15362 - DNA, 201 bp, synthetic construct
  misc_feature 1..201: note = Description of Artificial Sequence: Synthetic polynucleotide
  source 1..201: mol_type = other DNA
ttattaaaaatataaaaaattagttgggtgtggtggtgggtgtttgtaattttagttatttgggaggttgaggtagaagaatggtatgaatttaagaggtggagtttgtagtgagttgggatagtgttattgtagtttagtttgggtgaaagagtgagattttgttttaaaaaaaaaaaaaaaaaaaaaaaaaaaagattt

SEQ ID NO: 15363 - DNA, 201 bp, synthetic construct
  misc_feature 1..201: note = Description of Artificial Sequence: Synthetic polynucleotide
  source 1..201: mol_type = other DNA
ggagggtggtgagggtggggagggggaaggtgggaggttgggtttggtgtatgggggttgggtatattttttttgggtatttttaggataggtgaggaatgtattggttgggattttatttatgagtaggagggtaaggtgtagtttgtgattgatgtggtgtatgttattgtttatgttttttatagtatgtattaggtg

SEQ ID NO: 15364 - DNA, 201 bp, synthetic construct
  misc_feature 1..201: note = Description of Artificial Sequence: Synthetic polynucleotide
  source 1..201: mol_type = other DNA
ttatataagttgtagtttgggtagatgttgtatttgtagtgggtttttattataggtttattgtagttattgtagattatattggggtgtattatgttgtggggtgttttttgagtatatggtgggtggtggttttgttggtatttttttttttttataggaagggtaaagagagttgttagggtgggattttttaaagtt

SEQ ID NO: 15365 - DNA, 201 bp, synthetic construct
  misc_feature 1..201: note = Description of Artificial Sequence: Synthetic polynucleotide
  source 1..201: mol_type = other DNA
tatggggaaattttgtttttattaaaaatataaaaattagtttggtgtggtggtatataattgtaattttagttatttgggaggttgaggtaggagaattgttggaatttgggaggtggagtttgtagtgagttaagattgtgttatgtattttaatttgggtgttgtagtgagattttgtttttaaataaataaagtgtt

SEQ ID NO: 15366 - DNA, 201 bp, synthetic construct
  misc_feature 1..201: note = Description of Artificial Sequence: Synthetic polynucleotide
  source 1..201: mol_type = other DNA
agtaattaataaagtgaagatatggtttattgaagtgtagaaaatatttataagttgggtgtggtagtttatgtttgtaattttagtattttgggaggttgagatatgtggattataaggttaggagattgagattattttggttaatatagtgaaattttgtttttattataaatagaaaaaattagttgggtatggtgg

SEQ ID NO: 15367 - DNA, 227 bp, synthetic construct
  misc_feature 1..227: note = Description of Artificial Sequence: Synthetic polynucleotide
  source 1..227: mol_type = other DNA
agattggttttttttatttaataatatgtattttaatttttagggttgggtgtggtggtttatgtttgtaattttagtattttgggaggttgaggttggtggattatgaggttaggagattaagatgattttggttaatatggtgaaattttgtttttattaaaaatatagaaaataagttgggtgtggtggtgggtatttgtagttttagttatttaggaggttga

SEQ ID NO: 15368 - DNA, 201 bp, synthetic construct
  misc_feature 1..201: note = Description of Artificial Sequence: Synthetic polynucleotide
  source 1..201: mol_type = other DNA
gttttttttttgagttaaagaaaggggtgatggatgtatttggaaaattgggttatttttatttgaatattgtgtttttttgattggtttaaaaaatggtgtattatgagattatattttatatttggtttggagttttgttgattgttagtatagtagtttgagattaaattgtaaggtggtagtaaggttgggggaggg

SEQ ID NO: 15369 - DNA, 201 bp, synthetic construct
  misc_feature 1..201: note = Description of Artificial Sequence: Synthetic polynucleotide
  source 1..201: mol_type = other DNA
atgtagaagatgggtgatttttgtatttttatttgaggtattgggtttattttatttgggagagttagatagtgggtgtaggttagtgggggtatgtattgtgtgtgagttgaagtagggagaggtattgttttatttgggaagtgtaaggggttagggagttttttttttgagttaaagaaaggggtgatagatgtattt

SEQ ID NO: 15370 - DNA, 201 bp, synthetic construct
  misc_feature 1..201: note = Description of Artificial Sequence: Synthetic polynucleotide
  source 1..201: mol_type = other DNA
ggtatttgttattatgtttggttaattttttgtatttatagtatagatggggttttattgtgttagttaggatggttttgattttttgattttgtgatttgtttgtttttgttttttaaagtgttgggattataggtgtgagttattgtgtttggtggaaaggatatttttttatagtatgagtattgaaataaaaaggta

SEQ ID NO: 15371 - DNA, 201 bp, synthetic construct
  misc_feature 1..201: note = Description of Artificial Sequence: Synthetic polynucleotide
  source 1..201: mol_type = other DNA
aattgtgttattggaagttaggaagtaaattttaattttagtattgtttttttttgaaatggagttttgttttgttatttaggttggagtgtagtggtgtgattttggtttattgtaagttttgttttttgggtttattttatttttttgttttagttttttgagtagttgggattataggtgtttgttattatgtttggt

SEQ ID NO: 15372 - DNA, 201 bp, synthetic construct
  misc_feature 1..201: note = Description of Artificial Sequence: Synthetic polynucleotide
  source 1..201: mol_type = other DNA
tttgggtgattgtttgtaatggagggagtgtgtgggttggtttgttagtggagagatttgttttatgttattaggagtttggttgagtattatggtgattgtggttgggtggaaggagatggatgtttatttgtgtaatttgtttttattttttttttaggggttattttagaataaaatgtaatggtttttttttgttta

SEQ ID NO: 15373 - DNA, 201 bp, synthetic construct
  misc_feature 1..201: note = Description of Artificial Sequence: Synthetic polynucleotide
  source 1..201: mol_type = other DNA
ataagttggttgtttggtaggttatattggggtttttaagagtttgggttgtagatgaatttaggtttgttttttttaattagtgtgatttgggtaagttgtgttttttttttgagttttagtttttttattttttaaatgggggtgatgttatttttattgttaggggtttttttgagtgggttataggaaggtgtttag

SEQ ID NO: 15374 - DNA, 201 bp, synthetic construct
  misc_feature 1..201: note = Description of Artificial Sequence: Synthetic polynucleotide
  source 1..201: mol_type = other DNA
tttagtttgggattggtagtatttttatttgtatgttatttttagggatggtaatattgtttattttgagtttagagtagttattatttttggtttttttgttggttttttgggaggttttaggaagatgtgattttttgttaggtatttgtgggtttttttatagttgttggggtggtttttgtttttttaaaattatat

SEQ ID NO: 15375 - DNA, 201 bp, synthetic construct
  misc_feature 1..201: note = Description of Artificial Sequence: Synthetic polynucleotide
  source 1..201: mol_type = other DNA
aaagttattgtaggtaattagaaaagttgtttttattttatggttgtgtttatttgtggtagataggataatggtttaaagatgtttgagatttgtgattgttttattttgtgattgtattattttatatggtaaagaagtttttgtatgtgtgattatgattaaggattttgagatttggagatgatttgggtatttggg

SEQ ID NO: 15376 - DNA, 201 bp, synthetic construct
  misc_feature 1..201: note = Description of Artificial Sequence: Synthetic polynucleotide
  source 1..201: mol_type = other DNA
gtggtggtaggtttgttgtgtttgttttagttagggtttagagttttttggttagtttattgtatttggattttagatgggtgtgttgggtggtgtttgtgttagggaaagagttggtggttggttgagttgttgtgtttttgagtgttgtgtttgttgtgattattggtgtggttgttttttggtaggtttgaaggaatc

SEQ ID NO: 15377 - DNA, 201 bp, synthetic construct
  misc_feature 1..201: note = Description of Artificial Sequence: Synthetic polynucleotide
  source 1..201: mol_type = other DNA
tttttgatattttgtttttatattgtattatttgttggtaattgtttttggatagtggttaggttgtggggaggttggttttggagtttatttttggggtgtatatttttgttaatttttttgaggtggggtataggattgtggtgttgtattatggggatttgttttttttggggttttattatttgttgttatttaagg

SEQ ID NO: 15378 - DNA, 201 bp, synthetic construct
  misc_feature 1..201: note = Description of Artificial Sequence: Synthetic polynucleotide
  source 1..201: mol_type = other DNA
gggtttagaggtattttagtaaatggtttaggaattgtagtattaatttatattgagaaatagaattgttatttaagaaagataattgttggtttaatgtggtggtttatgtttgtaattttagtattttgggaggttgaggttggtggattatgaggttaggagattgagattattttggttaatagggtgaaattttgt

SEQ ID NO: 15379 - DNA, 201 bp, synthetic construct
  misc_feature 1..201: note = Description of Artificial Sequence: Synthetic polynucleotide
  source 1..201: mol_type = other DNA
tatggtgaaattttgtttttattaaaaatataaaaaattagttaggtgtggaggtattttttgtaattttagatatttaggaggttgaggtaggaaaattgtttgaatttgggaggtggagtttgtagtgagttgatattgtattattgtgttttagtttgggtaatagagtaaaattttgttttaaaaaaaaaaaaaaaa

SEQ ID NO: 15380 - DNA, 201 bp, synthetic construct
  misc_feature 1..201: note = Description of Artificial Sequence: Synthetic polynucleotide
  source 1..201: mol_type = other DNA
tatttttttgttttagttttaggagtagttgggattataggtgtttgttataatgtttggttaattttttttgtatttttagtggagatggggttttattgtgttagttaggatggttttgattttttgattttgtgatttatttgttttagttttttaaagtgttgggattataggtgtgagttattgtgtttagttgtt

SEQ ID NO: 15381 - DNA, 201 bp, synthetic construct
  misc_feature 1..201: note = Description of Artificial Sequence: Synthetic polynucleotide
  source 1..201: mol_type = other DNA
gtttatagtttttagtgtgagtgatgtagaagatgggtgatttttgtatttttatttgaggtattgggtttattttattagggagggttagatagtgggtgtaggttagtgggtgtgtgtattgtgtgttagttaaagtagggtaaggtattgttttatttgggaagtgtaaggggttagggagttttttttttgagttaa

SEQ ID NO: 15382 - DNA, 201 bp, synthetic construct
  misc_feature 1..201: note = Description of Artificial Sequence: Synthetic polynucleotide
  source 1..201: mol_type = other DNA
tggtaaaattttatttttattaaaaatataaagatttagtatgggtatggtggtgtatatttgtaattttagttgtttgggaggttgaagtagaagaattgtgtgaatttgggaggtagaagttgtagtgagttaagattatgttattgtattttagtttgggtgatataatgagattttgtttaaaaaataaaataaaaa

SEQ ID NO: 15383 - DNA, 201 bp, synthetic construct
  misc_feature 1..201: note = Description of Artificial Sequence: Synthetic polynucleotide
  source 1..201: mol_type = other DNA
aaattttttatttttttgaggtagagttttattttgttgtttaggttggagtgtagtagtgtgattttggtttattgtaagttttattttttgggtttatgttatttttttgttttagttttttgagtagttgtgattataggtgttttttattatgttgggttaattttttgtatttttagtagagatggggttttattg

SEQ ID NO: 15384 - DNA, 201 bp, synthetic construct
  misc_feature 1..201: note = Description of Artificial Sequence: Synthetic polynucleotide
  source 1..201: mol_type = other DNA
ttttgagtagttgggattataggtgtttgttattatgtttggttaatattttgtatttttagtagagatggggttttattgtgttagttaggatggttttgattttttgattttgtgatttgtttgttttggttttttaaagtgttgggattataggtgtgagttattgtgtttggtttattttttttattttttatagag

SEQ ID NO: 15385 - DNA, 201 bp, synthetic construct
  misc_feature 1..201: note = Description of Artificial Sequence: Synthetic polynucleotide
  source 1..201: mol_type = other DNA
tgagttgagtggagattgtgttattgttttttagtttgggtgatagagggagattttgtgtttaaaaaaaatagatgtaggtaggagttttttttttggtgtttatatttagattgaagaaagtaattgggttgggtttggtggtttagatttgtaattttagtattttgggaggtttaggtagatgtattattttagttt

SEQ ID NO: 15386 - DNA, 201 bp, synthetic construct
  misc_feature 1..201: note = Description of Artificial Sequence: Synthetic polynucleotide
  source 1..201: mol_type = other DNA
ttggagtagtggtaggtggtaagggttgggtggggggttgttttattgggttttttattttttttttttttttttaattttttttttttttttttgagatggagttttgttttgttatttaggttggagtaaagaggtatgattttggtttatagtaatttttgttttttgggtttaagtgatttttttgttttatgtttt

SEQ ID NO: 15387 - DNA, 201 bp, synthetic construct
  misc_feature 1..201: note = Description of Artificial Sequence: Synthetic polynucleotide
  source 1..201: mol_type = other DNA
tgaagggagggatgagagttttattatttaattttaagtttagtggttggtgtttttggaagtggagatatatgtttattggtgtgtgatttatatttatgaaagggaatgtgttttttggaatataggggagttttggttagggaagttgtttttttatttaagagggataaaggtgtgtaaattttagaaattagatat

SEQ ID NO: 15388 - DNA, 201 bp, synthetic construct
  misc_feature 1..201: note = Description of Artificial Sequence: Synthetic polynucleotide
  source 1..201: mol_type = other DNA
aaattatttttgatttgagatataaaaataaagaggttgggtgtaaggtggtttatgtttgtaattttagtattttgggaggttgaggtgggtggattatgaggttagtagattgagattattttggttaatatggtgaaattttgtttttattaaataaaatataaaaaattagttgggtgtggtggtgggtgtttgtag

SEQ ID NO: 15389 - DNA, 217 bp, synthetic construct
  misc_feature 1..217: note = Description of Artificial Sequence: Synthetic polynucleotide
  source 1..217: mol_type = other DNA
ttttgaatgaaattaggaaggagaaagtatgggataatgggtttttgataatgataaaaagagaaaaaataaatagaaaaaagaggagggttggttgggtgtggttaggaaggtgtggttttggttaggagattgagattattttggttaatgtggtgaagttttgtttttattaaaaatataaaaaattagttgggtgtggtggggggtgtttgta

SEQ ID NO: 15390 - DNA, 217 bp, synthetic construct
  misc_feature 1..217: note = Description of Artificial Sequence: Synthetic polynucleotide
  source 1..217: mol_type = other DNA
ttgttatttttttttttgattgggaaagggaattttttgattttttgttttttttaagtgaggtagtgttttgttttgttttggtttgtgtatggtgtatgtatttattgatttgtgtttattgtttggtattttttagtgagatgaatttggtattttagatggaaatgtagaaattatttgttttttgtgttgtttaagttgggagttgtagatc

SEQ ID NO: 15391 - DNA, 201 bp, synthetic construct
  misc_feature 1..201: note = Description of Artificial Sequence: Synthetic polynucleotide
  source 1..201: mol_type = other DNA
tgttggtgggagttaaaatggattaattatataaaaaataatttttaggttgggtgtagtggtttatgtttgtaattttggtattttgggaggttaaggtgggtggattatgaggttaggaaattgatattattttggttaataaggtgaaattttatttttattaaaaatataaaaatttagttgggtgtggtggtgggt

SEQ ID NO: 15392 - DNA, 201 bp, synthetic construct
  misc_feature 1..201: note = Description of Artificial Sequence: Synthetic polynucleotide
  source 1..201: mol_type = other DNA
tggagattttttatttattgtggtagtaaatttgtttgaggtgtttgtatgttttagttttggggttttgggggttgtgtttatagtttttttattttttggtttttatgttagggtttttggtttatattgtgttgttttgttttatatgagattggaaagttatatgtggataatttaggatttatttagggttatata

SEQ ID NO: 15393 - DNA, 201 bp, synthetic construct
  misc_feature 1..201: note = Description of Artificial Sequence: Synthetic polynucleotide
  source 1..201: mol_type = other DNA
gtagggtttgaattttttttttaggagggttagggttgtggttgggtgatgttaggtggggaagatattagaagaggagaaaattaggagtgtaggatgtggtgggagattgggaggttgtagagaggaggtttgaggataggagggaaggaggtggggatagaggttgagggttggaggggttgttgggttttttttggg

SEQ ID NO: 15394 - DNA, 201 bp, synthetic construct
  misc_feature 1..201: note = Description of Artificial Sequence: Synthetic polynucleotide
  source 1..201: mol_type = other DNA
gttattgtgtttggttaatttttttgtatttttttagtagagttggggttttattgtgttagttaggatggttatgattttttgattttgtgatttggttgttttggttttttaaagtgttgggattataggtgttaagttattgtgtttggttgatagttagatttttaaaggtgtttgaatttttttaatgtggaaata

SEQ ID NO: 15395 - DNA, 201 bp, synthetic construct
  misc_feature 1..201: note = Description of Artificial Sequence: Synthetic polynucleotide
  source 1..201: mol_type = other DNA
agtttatgtatggtgtgtgtatttattgatttgtatttattgtttggtattttttagtgagatgaatttggtattttagatggaaatatagaaattatttgttttttgtgttgtttatagtgggagttgtagattggagttgtttttatttggttattttggtttgatttggagtggtatatgtttttaaataattaaatt

SEQ ID NO: 15396 - DNA, 201 bp, synthetic construct
  misc_feature 1..201: note = Description of Artificial Sequence: Synthetic polynucleotide
  source 1..201: mol_type = other DNA
ttggtgagaagttgagtatagtagttgttggtttaggtgttaagttttttattgtttggggttgttggttgttttaagtgtgggttagtttagtttatgtgtatttggaagttgtgttggtgagggagggttgtgagggttgttagtatgttattattttttattgggattataggtgtgagttatggtgtttggttgaag

SEQ ID NO: 15397 - DNA, 201 bp, synthetic construct
  misc_feature 1..201: note = Description of Artificial Sequence: Synthetic polynucleotide
  source 1..201: mol_type = other DNA
ttatgttatttttttgttttagtttgtagttgggattataggtgtttgttattatgtttggttattttttttgtatttttaatagagatggggttttattgtgttagttaggatggttttaatttgttgattttgtgatttgtttgttttggttttttaaagttttgggattgtaggagtgagttattgtgtttggttgta

SEQ ID NO: 15398 - DNA, 201 bp, synthetic construct
  misc_feature 1..201: note = Description of Artificial Sequence: Synthetic polynucleotide
  source 1..201: mol_type = other DNA
tagattggagtgtagtggtatgattttggtttagaatttttgttttatgggtttaagtaatttttttgttttagtttttggagtagttgggattataggtgtttgttattatgttaggttaattttttgtatttttagtagggatggttgattgggtgtggtggtttatgtttgtaattttagtattttgggaggttgagg

SEQ ID NO: 15399 - DNA, 201 bp, synthetic construct
  misc_feature 1..201: note = Description of Artificial Sequence: Synthetic polynucleotide
  source 1..201: mol_type = other DNA
tattttttagatgggatagtggttgggaagaggtgttttttattttttagatgggatggtggttaggtagagatgttttttattttttagatggggtggtggttgggtagaggttgtaattttggtattttgggaggttaaggtaggttgttgggaggtgaaggttgtagtgagttgagattatgttattgtattttagtt

SEQ ID NO: 15400 - DNA, 201 bp, synthetic construct
  misc_feature 1..201: note = Description of Artificial Sequence: Synthetic polynucleotide
  source 1..201: mol_type = other DNA
gatggagttgtttgttagttttggtattgtgtgtttgtattttttagtttttgggtggttaatgggattgggtgttgtggagtagggggtggtgtttgttggggaggtttgggttgtataggagtttatggaaggggtgggaggtttaggtatggtgggttgtaggttttgagttttgttttgtgggaaggtagttaaggt

SEQ ID NO: 15401 - DNA, 286 bp, synthetic construct
  misc_feature 1..286: note = Description of Artificial Sequence: Synthetic polynucleotide
  source 1..286: mol_type = other DNA
gagttaggtgtgggatatagttttgtggtgtattgttttttaagttggtttgaaaagtgtaataattgggtgggagtgatttgattttttaggtgtgtttgttatttatttatttgatttggaaagggaattttttgattttttgtgttttttaggtgaggtaatgttttgttttgttttggtttgtgtatggtgtgtgtatttattggtttgtgtttattgtttggtattttttagtgagatgaatttggtattttagatggaaatgtagaaattatttgttttt

SEQ ID NO: 15402 - DNA, 201 bp, synthetic construct
  misc_feature 1..201: note = Description of Artificial Sequence: Synthetic polynucleotide
  source 1..201: mol_type = other DNA
aggtaaagttgtttgttagttttatgttttgtgtttatgttttttagttgttttatagttgatgggattgggtgttatggagtagggggtggtgtttgttggggaggtttttgttgtataggagtttagggtagtggggggaggtttatatatggtaggttgtaggttttaagttttgttttgtagggaggtagttgaggt

SEQ ID NO: 15403 - DNA, 201 bp, synthetic construct
  misc_feature 1..201: note = Description of Artificial Sequence: Synthetic polynucleotide
  source 1..201: mol_type = other DNA
aggtgggtggattatgaggttaggggtttgagatgagtttggttaatatggtgaaattttgtttttattaaaaatataaaaattagttgggtgtggaggtgtgtgtttgtaattttagatatttgggaggttgaggtaagagaattgtttgaatttgggaggtggaggttgtagtgagttgagatggtgttattgtatttt

SEQ ID NO: 15404 - DNA, 201 bp, synthetic construct
  misc_feature 1..201: note = Description of Artificial Sequence: Synthetic polynucleotide
  source 1..201: mol_type = other DNA
gagtgatgtagaagatgggtgatttttgtatttttatttgaggtattgggtttattttattagggagtgttagatagtgggtgtaggttagtgggtgtgtgtaatgtgtgtgagttgaagtagggtgaggtattgttttatttgggaagtgtaaggggttagggagttttttttttgagttaaaggaaggggtgatggagg

SEQ ID NO: 15405 - DNA, 201 bp, synthetic construct
  misc_feature 1..201: note = Description of Artificial Sequence: Synthetic polynucleotide
  source 1..201: mol_type = other DNA
gtgttgtttgttatttttttttttgattaggaaagggaattttttgattttttgtgtttttggagtgaggtaatgttttgttttgttttagtttgtatatggtgtatgtatttatggatttgtgtttattgtttggtattttttagtgagatgaatttggtattttagatggaaatgtagaaattatttgttttttgtgtt

SEQ ID NO: 15406 - DNA, 201 bp, synthetic construct
  misc_feature 1..201: note = Description of Artificial Sequence: Synthetic polynucleotide
  source 1..201: mol_type = other DNA
atttttatttgaattttgatagtagttattatgtagagttgttaaaatgtatatttttggttgggtgtggtggtttatgtttgtaattttagtattttgtggggttgaggtgggtggattatgaggttaagagattaagattattttggttaatatggtgaaattttgtttttattaaaaatataaaaaaaattagttggg

SEQ ID NO: 15407 - DNA, 201 bp, synthetic construct
  misc_feature 1..201: note = Description of Artificial Sequence: Synthetic polynucleotide
  source 1..201: mol_type = other DNA
ttaggtgttatttgttatttttttttttgatttagaaagggaattttttgattttttgtgttttttaggtgaggtaatgttttgttttgttttggtttgtgtatggtgtgtatatatattggtttgtgtttattgtttggtattttttagtgagatgaatttggtattttagatggaaatgtagaaattatttgttttttg

SEQ ID NO: 15408 - DNA, 201 bp, synthetic construct
  misc_feature 1..201: note = Description of Artificial Sequence: Synthetic polynucleotide
  source 1..201: mol_type = other DNA
tttagtttattgttgtattgtgagagtttttttttgggttggttaaggttagagtttgtttttttagtttgtagggaggtgtggatggagaggtgtgagtgggaatttaggttgtgtatggtgtttgtgggttagttggagttttgggtgggtgtgggtttggtaggttttgtattgggagtagttggttggttttgttag

SEQ ID NO: 15409 - DNA, 201 bp, synthetic construct
  misc_feature 1..201: note = Description of Artificial Sequence: Synthetic polynucleotide
  source 1..201: mol_type = other DNA
ggggagagggattgattttttgtgttttatttttagtttatttaattttagtgtagtttggagattgttattgtgttttttggagggtgatggagtttttgttttgtttaggagtagtttggtttttgggagggtagtttgatttttatggtattgttggtgattttttagtttaggttttggggttgtgagaattttaag

SEQ ID NO: 15410 - DNA, 201 bp, synthetic construct
  misc_feature 1..201: note = Description of Artificial Sequence: Synthetic polynucleotide
  source 1..201: mol_type = other DNA
atgagtgttattgatggtagagttgttttttttatgttttgtggggattgggaagagattgtagggagtgaggtattttatttgtttatttggtagatttgaagattgagatttgagagtttgtagttttgggttatatttttagtgtttggtttagttttttttttatttttttatttgttttttgtagatgaggggttt

SEQ ID NO: 15411 - DNA, 201 bp, synthetic construct
  misc_feature 1..201: note = Description of Artificial Sequence: Synthetic polynucleotide
  source 1..201: mol_type = other DNA
gttgtaattttattgagtgtgtttgtttattagatatttgattttgtaagattgttttttttttttttttttgatggagttttgttttgttgtttaggttgaagtgtagtggtgtgattttggtttattgtaagttttgttttttgggtttatgttatttttttgttttagttttttgagtagttgggattataggtgttc

SEQ ID NO: 15412 - DNA, 210 bp, synthetic construct
  misc_feature 1..210: note = Description of Artificial Sequence: Synthetic polynucleotide
  source 1..210: mol_type = other DNA
ttttgggtttttattttttttttttttttttttttttttttgagatgaagttttattttgttgtttgggttggagtgttgtggtaggattttggtttattgtaagttttgttttttggatttatgttatttttttgttttagttttttgagtagttgggattagaggtgtttgttattgtgttaggttaatttttttgtatttttagtag

SEQ ID NO: 15413 - DNA, 201 bp, synthetic construct
  misc_feature 1..201: note = Description of Artificial Sequence: Synthetic polynucleotide
  source 1..201: mol_type = other DNA
taagttgggtgtggtggtttatgtttgtaattttagtattttgggaggtttaggtaggtggattatgaggttaggagattaagattattttggttaatatggtgagaattttgtttttataaaaaatataaaaaattagttgggtgtttgtagttttagttatttgggaggttgaggtgagagaatggtgtgaatttgggg

SEQ ID NO: 15414 - DNA, 201 bp, synthetic construct
  misc_feature 1..201: note = Description of Artificial Sequence: Synthetic polynucleotide
  source 1..201: mol_type = other DNA
gggttaaagaggaattggaaagggtttggggtagatgtgggtgttatagggtgagttgggttaggttgagaggatttatgggttatgggagtttgtgggtgatggtttggtaggggtttgtggtgggaatagggataaaatatatttaataaattgtttatttagagtaagttgtgtgggtataatggtgagaaaatggtt

SEQ ID NO: 15415 - DNA, 201 bp, synthetic construct
  misc_feature 1..201: note = Description of Artificial Sequence: Synthetic polynucleotide
  source 1..201: mol_type = other DNA
ggtgggtgggttatgaagttaggagattgagattattttggttaatatggtgaaattttatttttattaaaaatataaaaaattagtttggtatagtggtgggtgtttgtagttttagttagtttggaggttgaggtaggagaatggtgtgaatttgggaggtggagtttgtagtgagttgagattgtgttattgtattat

SEQ ID NO: 15416 - DNA, 201 bp, synthetic construct
  misc_feature 1..201: note = Description of Artificial Sequence: Synthetic polynucleotide
  source 1..201: mol_type = other DNA
gtttatgttattttaatagtgggtttttttttggtgagaattggttaatagttattgttttgtttttttagtatgttgtttgattagagagggatagggtggggaggaaaattggggtgttgtgggttgtagttttagttgtaaatatgggagttttttttgatgtttgtggtttgttggtttgaaagggagaaatatgga

SEQ ID NO: 15417 - DNA, 201 bp, synthetic construct
  misc_feature 1..201: note = Description of Artificial Sequence: Synthetic polynucleotide
  source 1..201: mol_type = other DNA
ttatgaatttttgagtttaagtgatttttttatttggttttgtgaagtgttgggattatatgtgtgagttattatgttgggattataggtgtgagttattgtgttgggattatgggtatgagttattgtgttggtttttagtaaatattttattagtatttagtgaattttgggtttttgtggaataggaatgtttgtttt

SEQ ID NO: 15418 - DNA, 201 bp, synthetic construct
  misc_feature 1..201: note = Description of Artificial Sequence: Synthetic polynucleotide
  source 1..201: mol_type = other DNA
aggttgaggttggtggattataaggttaggagattgagattattttggttaatatggtgaaattttgtttttattaaaaatataaaaaaattagttgggtgtggtggtgtgtatttgtagttttagttatttgggagtttgaggtaggagaatggtatgaatttgggaggtagagtttgtagtgagttaaaattgtattat

SEQ ID NO: 15419 - DNA, 201 bp, synthetic construct
  misc_feature 1..201: note = Description of Artificial Sequence: Synthetic polynucleotide
  source 1..201: mol_type = other DNA
aaggagatgtttgggttaggattgaagttttttggaataatgggttgggattttgaggttggtaggggtgtagtgggtattgggtttatgtgtggtttgtgttggttgatgtgggtatataaggggtatagttgttattgggggtttggaggggaggatttagttggggtttggagggttaggattttgtagaaggtttac

SEQ ID NO: 15420 - DNA, 201 bp, synthetic construct
  misc_feature 1..201: note = Description of Artificial Sequence: Synthetic polynucleotide
  source 1..201: mol_type = other DNA
tatggtgaaattttgttttaattaaaagtattaaaattatttgggtatggtggtatatgtttgtaattttagttatttgggaggttgaggtaggagaattgtttgagtttgggaggtggaggttgtagtgagttgtgattgtgttattgtattttagtttgggtgatagagtaagattttattttaataaaaaaattaaaa

SEQ ID NO: 15421 - DNA, 201 bp, synthetic construct
  misc_feature 1..201: note = Description of Artificial Sequence: Synthetic polynucleotide
  source 1..201: mol_type = other DNA
gtgatttttttgttttagttttttgagtagttaggattataggtgtttgtttttatgtttggttaattttttgtatttttggtagagatggggttttattgtgttagtaaggatagttttgattttttgattttgtgatttgtttgttttggtgttttaaagtgttgggattataggtatgagttattgtgtttggtgggg

SEQ ID NO: 15422 - DNA, 201 bp, synthetic construct
  misc_feature 1..201: note = Description of Artificial Sequence: Synthetic polynucleotide
  source 1..201: mol_type = other DNA
agtgaaatttttttttattaaaaatttaaaaaaattagttgggtgtggtagtatgtgtttgtagttttagttatttgagaggttgagataggagaatggtgtgaatttgggaggtggagtttgtagtgagttgagattgtgttattgtattttagtgtgggtgatagagtaagattttgttttaaaaaaaaagaaaataat

SEQ ID NO: 15423 - DNA, 201 bp, synthetic construct
  misc_feature 1..201: note = Description of Artificial Sequence: Synthetic polynucleotide
  source 1..201: mol_type = other DNA
agattatagatgaatttgaattttaagtagtatagatgtgttatatttattattttgttgttgattatttttgggattatattatatttattattttgttgttgattatttttgggattattatggtgggttatgatagtatgttttttttagaaatatgtttgaatagtataagaaaaggatattatttggatttgtgga

SEQ ID NO: 15424 - DNA, 201 bp, synthetic construct
  misc_feature 1..201: note = Description of Artificial Sequence: Synthetic polynucleotide
  source 1..201: mol_type = other DNA
tgttgttatttataagagtttttttttttttgtaattaatggttttgtttttggtttgtttagtaaattgaaattattgaaaaaggattttgttgggagtggtggtttatgtttgtaatattagtattttgggaggttgaggtgggttgattataaggttaggaaattgagattattttggttaatatggtgaaatttagt

SEQ ID NO: 15425 - DNA, 201 bp, synthetic construct
  misc_feature 1..201: note = Description of Artificial Sequence: Synthetic polynucleotide
  source 1..201: mol_type = other DNA
ttagagttaggtgtttattgttaatttggagtgtgtgttttagttttttggggttgattttggttgttgggttagtagtgtgaattttttttttttatatggggtttttaagatatgtgtttgtgtgtgtttgtttttaagatatgtgtgtgtgtatatgtgtgtgtgtgtgtgtgttttatatgaatgatttgagttatt

SEQ ID NO: 15426 - DNA, 201 bp, synthetic construct
  misc_feature 1..201: note = Description of Artificial Sequence: Synthetic polynucleotide
  source 1..201: mol_type = other DNA
gttagtgtttttatggtagtttttgtattgggtttggggtgggggtggggggtggttgtggagtttttggtttttatttagtgtgttttttttatggggtgtattttaaagtgataagatgttttttaggaaatggggaatggatgttaggtttttagggagaggttgaggtagtttgaggtaaaaagggatgggttgagg

SEQ ID NO: 15427 - DNA, 201 bp, synthetic construct
  misc_feature 1..201: note = Description of Artificial Sequence: Synthetic polynucleotide
  source 1..201: mol_type = other DNA
gggtgtttatggagtttttagtttttatttagggtgtgtgttttttttatggggggtattttaaaggggtatgaagttttttgggggatggggatatgatgttaggtttttagtgggatattgagatagttgggggaaaaaagttgggagggtaagaaggttggggtatttttatggaggttagtttttttttagtagttt

SEQ ID NO: 15428 - DNA, 201 bp, synthetic construct
  misc_feature 1..201: note = Description of Artificial Sequence: Synthetic polynucleotide
  source 1..201: mol_type = other DNA
gtatttattgttttgtattaattgtttagtattttttagtgagatgaatttgttattttagttggaaatgtagaaattatttattttttgtgttgtttatgttgggagttgtagattggagttgtttttatttggttattttggttttattttattatattttttttatttagtttattattgatggatatttgggttggt

SEQ ID NO: 15429 - DNA, 201 bp, synthetic construct
  misc_feature 1..201: note = Description of Artificial Sequence: Synthetic polynucleotide
  source 1..201: mol_type = other DNA
gtaggtgttagggagaggtaattttttaaatagataaaaatatttttggttgggtgtggtggtttatgtttgtaattttagtattttgggaggttgatgtgggtggattatgaggttaggagattgagattatttttgttaatatggtgaaattttgtttttattaaaaatataaaaaattagttgggtgtggtggtgggc

SEQ ID NO: 15430 - DNA, 201 bp, synthetic construct
  misc_feature 1..201: note = Description of Artificial Sequence: Synthetic polynucleotide
  source 1..201: mol_type = other DNA
tggttttattatgttagttaggatggttttaattttttgattttgtgatttgtttgttatggtttttgaaagtgttgtgattataggtatgagttattgtgtttggtttaaaataatttttgaggttatataagaatatagtttatgtttatttatagttgtatttaatttaattaagaatttgttttttaagatgaaaaa

SEQ ID NO: 15431 - DNA, 201 bp, synthetic construct
  misc_feature 1..201: note = Description of Artificial Sequence: Synthetic polynucleotide
  source 1..201: mol_type = other DNA
tgggtttttgatttgtgtggatgagtagttttgagttttatatagggtgggtgatgttgtagattgataaggtttatttttggttatattgagttaaagtggaaggggtgtaggtgtggagtgttatgtgtgatgttattgttggttagttggagtggaggtgtttgttatgtgtatggggagatgtgtttttggttagtt

SEQ ID NO: 15432 - DNA, 366 bp, synthetic construct
  misc_feature 1..366: note = Description of Artificial Sequence: Synthetic polynucleotide
  source 1..366: mol_type = other DNA
ttgttttgtagtttgattttagattgttgtgttagtaattagtgagattttgtgggtgtaggattttttaagttaggtgtgggatatagttttgtggtgtgttattttttaagttggtttgaaaagtgtaatatttgggtgggagtgatttgattttttaggtgtgttggttatttttttttttgatttggaaagggaattttttgatttttggtgttttttaggtgaggtaatgttttgttttgttttggtttgtttatggtgtgtgtatttattggtttgtgtttattgtttggtattttttagtgaggtgaatttggtattttagatggaaatgtagaaattatttgttttttgtgttgttta

SEQ ID NO: 15433 - DNA, 201 bp, synthetic construct
  misc_feature 1..201: note = Description of Artificial Sequence: Synthetic polynucleotide
  source 1..201: mol_type = other DNA
ggtttttgtagggttgagtttttttaatgagtgttgttttttgttttatggtgtttggttttattgattgtttaagggttgaggattgtgggagtattgtgtgggattggtaggtagttttatttgtggtttttggtgtgggatttattgggtgaagttagttgggtttgtgagtttagtgtggatttggagaatttttat

SEQ ID NO: 15434 - DNA, 201 bp, synthetic construct
  misc_feature 1..201: note = Description of Artificial Sequence: Synthetic polynucleotide
  source 1..201: mol_type = other DNA
tgtagaagatgagtgatttttgtatttttatatgaggtattgggtttattttattagggagtgttagatagtgggtgtaggatagtgggtgtagtgtattgtatgtgagttgaagtagggtgaggtattgttttattttggaagtataaggggttagggagtttttttttttagttaaagaaaggggtgatagatggtatt

SEQ ID NO: 15435 - DNA, 201 bp, synthetic construct
  misc_feature 1..201: note = Description of Artificial Sequence: Synthetic polynucleotide
  source 1..201: mol_type = other DNA
tttttttttttagttaaagaaaggggtgatagatagtatttggaaaattgggttattttaattggaatattgtatttttttaataggtttaaaaaatggtgtatttggagattgtattttgtatttggtttggagggttttatgtttatggagttttgttgattgttagtatagtagtttgagattaaattgtaaggtggt

SEQ ID NO: 15436 - DNA, 384 bp, synthetic construct
  misc_feature 1..384: note = Description of Artificial Sequence: Synthetic polynucleotide
  source 1..384: mol_type = other DNA
tttgtttttttggtttttgttgtttatgagaaatgaggaaaaataaaggttagatttttaataatttttttggaagaaagagttgttttgagtgggtgttggtgtttatatatgttgtttttaaaaaaatttgttttgtttaggtttgtgtgaatataatgttggatgaattttgtttttttagaagaaagttgggttggtgtgtttgatgatgtagtgtttgtagtggtgtttgataaagtgtagggtttttatggagattttgtagttttggatatttagtgtttggaggttaaagtagttggtggttatgatttgtaagttttggttggtgatgtttttgtaggatttgaggttgagttgtttgaggttgaagtagtttag

SEQ ID NO: 15437 - DNA, 216 bp, synthetic construct
  misc_feature 1..216: note = Description of Artificial Sequence: Synthetic polynucleotide
  source 1..216: mol_type = other DNA
tgggagtgatttgattttttagttgtgtttattatttttttttttgatttggaaagggaattttttgattttttgtgttttttaggtgaggtaatgttttgttttgttttggtttgtgtatggtgtgtgtatttattggtttgtgtttattgtttggtattttttagtgagattaatttggtattttagatggaaatgtagaaattatttgttttt

SEQ ID NO: 15438 - DNA, 334 bp, synthetic construct
  misc_feature 1..334: note = Description of Artificial Sequence: Synthetic polynucleotide
  source 1..334: mol_type = other DNA
ttgtgttggtaattagtgagattttgttgggtaggattttttgagttagatgtgggatataattttgtggtgtgttgttttttaggttggtttgaaaagtgtaatatttgggtgggagtgatttgattttttaggtgtgtttgttatttttttttttgattaggaaagggaattttttgatttttggtgttttttgagtgaggtattgttttattttgttttggtttgtgtatggtgtgtgtatttattgatttgtgtttattgtttggtattttttagtgagatgaatttggtattttagatggaaatgtagaaattattgttttttatgtta

SEQ ID NO: 15439 - DNA, 201 bp, synthetic construct
  misc_feature 1..201: note = Description of Artificial Sequence: Synthetic polynucleotide
  source 1..201: mol_type = other DNA
tttgatgtaaggtggggtaggtaaaagtttggtagttatttgagaaggtgtgattaaaatggaggaatttgagagattttttgaggattgtaggtttggtgtggagtttgtgtttaatggtttggtttatggtagtgtggaggttattttggttttaatgtttggtgtttttgggttgtattagtaagattttaggatttt

SEQ ID NO: 15440 - DNA, 270 bp, synthetic construct
  misc_feature 1..270: note = Description of Artificial Sequence: Synthetic polynucleotide
  source 1..270: mol_type = other DNA
ttttggtttttgtttgtgtttttttttttatatttttttgtaagttgagggagttggttttggttttggttagtttaggaatgggtttttatagtgtagtggtgggttgaagggttttttaagtgtggttagagtgggtgttaaggttgaggaggtgttaagagtgagtgagggttgtgagggttgttatgttggtatattgttattttttagaaggatgtagggtagagttttaggttggttttgttatttatgttggagtgtagtggt

SEQ ID NO: 15441 - DNA, 253 bp, synthetic construct
  misc_feature 1..253: note = Description of Artificial Sequence: Synthetic polynucleotide
  source 1..253: mol_type = other DNA
ggttggaaaagtgtagtattttggtgggagtgatttgattttttaggtgtgtttgttatttttttttttgatttggaaatggaattttttgattttttgtgttttttaagtgaggtaatgttttgttttgttttggtttgtgtatggtgtgtgtatttattgatttgtgtttattgtttggtattttttagtgagatgaatttggtattttagatggaaatgtagaaattatttgttttttatgttgtttatg

SEQ ID NO: 15442 - DNA, 204 bp, synthetic construct
  misc_feature 1..204: note = Description of Artificial Sequence: Synthetic polynucleotide
  source 1..204: mol_type = other DNA
taaattagtaaatttaatattttaggatttttgttaagaagtttggttttggttgggaggatggagtttagtgggtagtggagttgttttagtttttgttgttgttttgtttgggagggaggtggggggggttagtttttttgtttggttagttgttttgtttgggaggtgaggggtgtttttgtttggttgtttttattggga

SEQ ID NO: 15443 - DNA, 228 bp, synthetic construct
  misc_feature 1..228: note = Description of Artificial Sequence: Synthetic polynucleotide
  source 1..228: mol_type = other DNA
atttgggaagtataaggggttagggagtttttttttttggttaaggaaaggggtgatagatagtatgtggaaaattaggttttttttatttgaatattgtgttttttttatgggtttaaaaattggtgtattaggagattatattttgtatttggtttggagggttttatgtttatggagttttgttgattgttagtatagtagtttgagattaaattgtaaggtagt

SEQ ID NO: 15444 - DNA, 217 bp, synthetic construct
  misc_feature 1..217: note = Description of Artificial Sequence: Synthetic polynucleotide
  source 1..217: mol_type = other DNA
tttagtggttgtaggggttgttgtgtgttttgtagatggatatgtgttatttaatatagagatgtgttgagtttgggtgattagtgaattgtatgttattgtagatattagaaagtgaaagtatatgggggaaggttttgggtatagatttagtatggttattatttgagttggagttgtttgtgagatgatgagtgtttgtaatttgtattttgtg

SEQ ID NO: 15445 - DNA, 201 bp, synthetic construct
  misc_feature 1..201: note = Description of Artificial Sequence: Synthetic polynucleotide
  source 1..201: mol_type = other DNA
tttggtgtttaatttttgaattttaaggaaaaatagggtagaatagaaagtgaaataggtttgaaggtatttattgtgtggtaatattttagatgagtttgatggtatttattgtgtggtaatattttagatgaatatttaagatgtgtttggagttggttttttttagtgggtttgtggttttagtgattttaagaatga

SEQ ID NO: 15446 - DNA, 204 bp, synthetic construct
  misc_feature 1..204: note = Description of Artificial Sequence: Synthetic polynucleotide
  source 1..204: mol_type = other DNA
atggtgtgtatatttattgatttgtgtttattgtttggtattttttagtgagatgaatttggtatttttgatggaaatgtagaaattatttattttttgtgttgtttatgttgggagttgtagattggagttgtttttatttggttattttggtttttttttggtattttttttattttttatttaggattagtttgttgtttt

SEQ ID NO: 15447 - DNA, 223 bp, synthetic construct
  misc_feature 1..223: note = Description of Artificial Sequence: Synthetic polynucleotide
  source 1..223: mol_type = other DNA
tagaagtataagtaattgtttttttttgtattttagtggaatgttgtgggttttttgaagatttttttttgttttgtaggttttggtattttaagtatgtgagtttgtgtaggaggtgttttgttttttggagttttttattgttttttagatatagttttggttttttattttgggtggaggtttttttagatgggttttgattgtttttgtatgtttattg

SEQ ID NO: 15448 - DNA, 201 bp, synthetic construct
  misc_feature 1..201: note = Description of Artificial Sequence: Synthetic polynucleotide
  source 1..201: mol_type = other DNA
tatttataaggttgaggtaggagaattgtttgaagttgggaggtggaggttgtaatgagttgagattatattattgtattttagtttgggtgataagagtgaaattttgtaataatattaataataataataaaataaaaataaaaataaaaaagaaaataagagatgtggtggttttgtttgtaattttagtattttggg

SEQ ID NO: 15449 - DNA, 203 bp, synthetic construct
  misc_feature 1..203: note = Description of Artificial Sequence: Synthetic polynucleotide
  source 1..203: mol_type = other DNA
tttaatattaagttaggtttagggaagtgttttttttttttttttttttttttatttgagatgtagttttattttgttatttaggttggagtatagtggtgtgattttggtttattgtaagttttgttttttgggtttatgttattttgttgttttagttttttgagtagttgggattattgtttgattaatttatttgtatt

SEQ ID NO: 15450 - DNA, 201 bp, synthetic construct
  misc_feature 1..201: note = Description of Artificial Sequence: Synthetic polynucleotide
  source 1..201: mol_type = other DNA
tataaaaagaattataaaatattgttgaaaaaaattagataatagttgggtgtggtgttttatgtttgtaattttagtagtttgggaggttgagttgggtggattatgaggttaggagatttagattattttggttaatatggtgaaattttggtgaaattttgtttttattaataatataaaaaaattagttgggtgtgg

SEQ ID NO: 15451 - DNA, 201 bp, synthetic construct
  misc_feature 1..201: note = Description of Artificial Sequence: Synthetic polynucleotide
  source 1..201: mol_type = other DNA
attattgttaaaaattaaattgggttgggtgtggtggtttatgtttgtaattttagtattttggggggttgaggttggtggattatgaggttaggagattgagattattttggttaatatggtgaaattttatttttattaaaaatataaaaaattagttgggtgaggtggtaggtatttgtagttttagttatttgggag

SEQ ID NO: 15452 - DNA, 201 bp, synthetic construct
  misc_feature 1..201: note = Description of Artificial Sequence: Synthetic polynucleotide
  source 1..201: mol_type = other DNA
tttgttttgattttgtttgtgggtgttgggatatttgggtgtagagggtttgtgtttagttagaagtgatttttgtttttttttgtgtaggtgttggtgtgtttgttgtgtgtgtgtggtttgtgtgttgttgttttggtttgtgtttttatatgtgtaggaaaggatatgttgtttgtttttatgttttttgtgattttt

SEQ ID NO: 15453 - DNA, 201 bp, synthetic construct
  misc_feature 1..201: note = Description of Artificial Sequence: Synthetic polynucleotide
  source 1..201: mol_type = other DNA
gaggttgaggtaggagaattatgtgaatttggaaggtggagtttgtagtgagttgagattgtgttattgtattttagtttgggtgatagagtgagattttgttttaaaaaaaaaaaaaaaaaaaaaaaaagtgatttgggttgggtgtggtggtttatgtttgtaattttagtattttgggaggttgaggagggtagatta

SEQ ID NO: 15454 - DNA, 201 bp, synthetic construct
  misc_feature 1..201: note = Description of Artificial Sequence: Synthetic polynucleotide
  source 1..201: mol_type = other DNA
tattagttaggtatggtagtatatgtttgtaattttagttatttgggaggttgaggtaggagaattgtttgaatttgggaggtggagattgtagtaagttgagtttgtgttattttattttagtttgggtaagagtgaaattttattgggaaaaaaaaatttatagtttaggttgggtgtggtggtttatgtttgtaattt

SEQ ID NO: 15455 - DNA, 201 bp, synthetic construct
  misc_feature 1..201: note = Description of Artificial Sequence: Synthetic polynucleotide
  source 1..201: mol_type = other DNA
ggttagttttttgtttggttagttgttttatttgggaggtgaggggtgtttttgtttggttgtttttattgggaagtgaggagtttttttgtttggttatgattttgtttgggaggtgtgtttagtagtttattggggatgggttatgatgataatggtggttttgtggaatagaaaggtgggaagggtggggaaaaaatt

SEQ ID NO: 15456 - DNA, 201 bp, synthetic construct
  misc_feature 1..201: note = Description of Artificial Sequence: Synthetic polynucleotide
  source 1..201: mol_type = other DNA
attggttaaagagtattgtgggtttttggaagtatttgtttttttattagttgtaaattggaatgataattagtttttaggttttggtttttgaatgtatgttgtgaatgatgtattgttttggttttatggtaggggttggggaggtttgttttattttgtattttgatttgggtttaaagttgagtttgaagggttttt

SEQ ID NO: 15457 - DNA, 201 bp, synthetic construct
  misc_feature 1..201: note = Description of Artificial Sequence: Synthetic polynucleotide
  source 1..201: mol_type = other DNA
tttgttattatgtttggttaattttttgtatttttagtagagatggggttttattgttttagttgggatggttttgattttttgattttgtgatttgtttgttttggttttttaaagtgttgggattataggtgtgagttattgtatttggttttttttttttttttttttttttaagatagagttttattttgttgttta

SEQ ID NO: 15458 - DNA, 201 bp, synthetic construct
  misc_feature 1..201: note = Description of Artificial Sequence: Synthetic polynucleotide
  source 1..201: mol_type = other DNA
attttggaaagtataggaggttatgttttagtgtggttttttttttttgggtttaagttaaggtttttattgtgtttgttggttttttgggtttttgtgtggtggattttggatttttttgttttgttttgttttagggtttttgtatttgttgttattgtggtttggaatgttttttttttgaaattttgtgatttttat

SEQ ID NO: 15459 - DNA, 201 bp, synthetic construct
  misc_feature 1..201: note = Description of Artificial Sequence: Synthetic polynucleotide
  source 1..201: mol_type = other DNA
tgtgtttataagaatattagttattggatttagggtttatttaatttagtatgattttattttaatttgattatatttgaaaagatttttggttgggtgtggtggtttatgtttataattttattattttgggaggttgaggtaggtggattatttgaggttaggagtttgagattagtttggttaatatggggaaatttt

SEQ ID NO: 15460 - DNA, 211 bp, synthetic construct
  misc_feature 1..211: note = Description of Artificial Sequence: Synthetic polynucleotide
  source 1..211: mol_type = other DNA
tttagtttttaggatgtgttttttatggttttttttgtggtgtggttatgtttggatttttttggtattttttatttgttttgtatgatttgttttgtgtgatttgttttgtaaggttggggggagtgttttttttttttgtgattttttatttttttttggtatttgtttattttgttgtttaggttttttgtttttttggttttagggc

SEQ ID NO: 15461 - DNA, 201 bp, synthetic construct
  misc_feature 1..201: note = Description of Artificial Sequence: Synthetic polynucleotide
  source 1..201: mol_type = other DNA
gtgtgtgtatttattgatttgtgtttattgtttggtattttttagtgagatgaattgggtattttagatgtaaatgtagaaattatttgttttttttgttgtttatgttgggagttgtagattggagttgtttttatttggttattttggtttttttttttgaaaagagtattttttaattaagaagatggttttggttgt

SEQ ID NO: 15462 - DNA, 201 bp, synthetic construct
  misc_feature 1..201: note = Description of Artificial Sequence: Synthetic polynucleotide
  source 1..201: mol_type = other DNA
atttagtggattttatattggggttgtaggtggagttgtttgttagttttgtgttgtgtgtttatattttttagtttttgggtggttgatgggattgggtgttgtggagtagggggtggtatttgtttgggaggtttgggtggtataggagtttatggagtgggtgggaggtttaggtatggtgggttgtaggttttgagt

SEQ ID NO: 15463 - DNA, 201 bp, synthetic construct
  misc_feature 1..201: note = Description of Artificial Sequence: Synthetic polynucleotide
  source 1..201: mol_type = other DNA
gatatgtataggttatttaagagaatgattgatttttggttatttggtgtttgtttgttgtggtggtgttgtgttgggtttaggggttttagggatttttgttgtgttgttagttttggaattttagtggggatttgttgtgtggaaatttttggataatagttttttttatggagaatttatgtttttataatgttatta

SEQ ID NO: 15464 - DNA, 201 bp, synthetic construct
  misc_feature 1..201: note = Description of Artificial Sequence: Synthetic polynucleotide
  source 1..201: mol_type = other DNA
ttatttttttatatttgtagagtgttttattttttgtaatgtttatttgtgaaattgttgtgttaggttaggagtattttaagagtgagaggtagatgttgtttgattttttattttgataggggatttttttatttggtagtgttaatatttggtttttatgtattttttatggaggattattaggttagtttatgggag

SEQ ID NO: 15465 - DNA, 201 bp, synthetic construct
  misc_feature 1..201: note = Description of Artificial Sequence: Synthetic polynucleotide
  source 1..201: mol_type = other DNA
ttttggtagagttagtatttgattttttttgtttggagatttaggtgatggtgttgtgtgatttttgattttgtggatgaggaaggtagagagagagtgtgtagatatggaggttggtgttgaggttgagggagttatatttggttgtaagtttgagggagggaagttgggtgtggaaatagtttagtgggtttagaagtc

SEQ ID NO: 15466 - DNA, 201 bp, synthetic construct
  misc_feature 1..201: note = Description of Artificial Sequence: Synthetic polynucleotide
  source 1..201: mol_type = other DNA
ttgttgttatgtttagttaattttttgtattgtttagtagagatggggttttattgtgttagttaggatggttttgattttttgattttgtgatttgtttgttttggttttttaaagtgttgggattataggtatgaattattgtatttggttaatttagtggttttgaggaggatttgttaggagttttgtaaaatgttt

SEQ ID NO: 15467 - DNA, 201 bp, synthetic construct
  misc_feature 1..201: note = Description of Artificial Sequence: Synthetic polynucleotide
  source 1..201: mol_type = other DNA
attggatggatgtttgttgttgttttattggggttgtgtggggagttgagtgtgaggtttgtttggattttgagtttttggagtttgttagtttgtgtttgtgggggttgggttttgttagttgggattttttgtttggttgattattttataaaggtgtggttggggaaggggttaggtttttggaaggatggggagggg

SEQ ID NO: 15468 - DNA, 201 bp, synthetic construct
  misc_feature 1..201: note = Description of Artificial Sequence: Synthetic polynucleotide
  source 1..201: mol_type = other DNA
ttataggtgtgagttatttggtttttttttttttttttttttttttttgagatgaagttttatttttgttttttaggttggagtgtaaaggtgtaattttggtttattataatttttattttttgggtttaggtaatttttttgttttaatttttggagtagttgggattataggtgtttgttattaggtttggttaattt

SEQ ID NO: 15469 - DNA, 201 bp, synthetic construct
  misc_feature 1..201: note = Description of Artificial Sequence: Synthetic polynucleotide
  source 1..201: mol_type = other DNA
attatttggtttagtaggtagaggtgtaggaatatggggatggatagtagtatgtttatgttggttttggttattgagggtgtgtatgtgaaggttagttgtgttgtttatgtgaagtggtagtggttgggtattgggtgaatggtgtatattgttagttttagtgagatgaggaatatgtgtttgtaggttatggtgatg

SEQ ID NO: 15470 - DNA, 201 bp, synthetic construct
  misc_feature 1..201: note = Description of Artificial Sequence: Synthetic polynucleotide
  source 1..201: mol_type = other DNA
gtagttttagttattttaaaggtagaggtgagaattgtttgaatttggaaggagtaggttttagtgagttgaggttatgttatttttttttagtttgggtgatagagaaagattttgtttagaaaaagtaaattatgggagttggtgttggtgagtgttgtttgggaggtagtggttggaggagtggatgggttttgtggg

SEQ ID NO: 15471 - DNA, 201 bp, synthetic construct
  misc_feature 1..201: note = Description of Artificial Sequence: Synthetic polynucleotide
  source 1..201: mol_type = other DNA
gaggttgaggtaggagaatggtgtgaatttgggaggtggagtttgtagtgagttgagattttgttattgtattttagtttgggtgatagagtgagattttgttttaaaaaaaaaataaaaataaaaataaaataaaataaaaaatgagttgggtatgatggtataagtttgtggttttagttatttaggaggttgaggtgg

SEQ ID NO: 15472 - DNA, 201 bp, synthetic construct
  misc_feature 1..201: note = Description of Artificial Sequence: Synthetic polynucleotide
  source 1..201: mol_type = other DNA
gtagtttaataattttgtgttgtaaatttaaatattttatatattattagatattaaaaataaagatttatgttgtttgtttttatggagtgaggattttgttgattttatatttggttatgaatttgtttgaggtttattagttgaatgtttttggttaagaaagtttgttgagtgggggtggtttttaaattattattt

SEQ ID NO: 15473 - DNA, 201 bp, synthetic construct
  misc_feature 1..201: note = Description of Artificial Sequence: Synthetic polynucleotide
  source 1..201: mol_type = other DNA
gtgtattttggtttattataatttttattatatttgttttttttaggtttaagtgatttttttattttagtttttttagtagttgggattataggtgtatggtattatgattggttaatttttgtattttttgtagagatgggattttgttatgttatttaggttggttttgaatttttaagttaaagtaatttgtttgtt

SEQ ID NO: 15474 - DNA, 201 bp, synthetic construct
  misc_feature 1..201: note = Description of Artificial Sequence: Synthetic polynucleotide
  source 1..201: mol_type = other DNA
ttttatttttattaaaaatataaaaaattagttaggtgtggtggtatgttttgtaattttagttatttgggaggttgaggtaggagaattgtttgaatgtgggttggggaggttgtggtgagttgagattgtattattgtattttagtttgggtgatagtgtaagattttattttaaaaaaaaaaaaaatttgttaattta

SEQ ID NO: 15475 - DNA, 201 bp, synthetic construct
  misc_feature 1..201: note = Description of Artificial Sequence: Synthetic polynucleotide
  source 1..201: mol_type = other DNA
tatgtattatttatatgagtttttagtaggttttggttttaaataggtatatgtgtatttttttagttttttattgggatttttttgttaagttatgtttgatgtttttgtttatagttatgagttgtagtaagatgtttaggtttggtgttagtgtgtgtagtatgtgtgttagtattgtggaatttttgttgtttgagg

SEQ ID NO: 15476 - DNA, 201 bp, synthetic construct
  misc_feature 1..201: note = Description of Artificial Sequence: Synthetic polynucleotide
  source 1..201: mol_type = other DNA
tggtattttggaaggttgatgtgggggtattatttgagattaggggtttgagattagttttgtgaatgtgatgaaattttgtttttattgaaaatttaatgattagttgggggtggtggtgtatgtttgtaattttagttatttaggaggttgaggtaggagaattgtttgaatttggaaggtggaagttgtaatgagttg

SEQ ID NO: 15477 - DNA, 201 bp, synthetic construct
  misc_feature 1..201: note = Description of Artificial Sequence: Synthetic polynucleotide
  source 1..201: mol_type = other DNA
ttgaggtgggttgggtgtggtggtttatgtttgtaattttaatattttgggaggttgaggggggtggattatttgaggtgggtttggtgtggtggtttatgtttgtaattttaatattttgggaggttgagaggggtggattatttgaggtgggttgggtgtggtggtttatgtttgtaattttaatattttgggaggttg

SEQ ID NO: 15478 - DNA, 201 bp, synthetic construct
  misc_feature 1..201: note = Description of Artificial Sequence: Synthetic polynucleotide
  source 1..201: mol_type = other DNA
ggggttttggttaggggtgggtgaggttggtgtttttttaggttttttttagttataggtagtaggtgttatgggagttttgttggtattttttttttttgttagggttttggtttatttgatggtgtagtttttttttaaggtgtgtattggtgtagatattgtgtaggaagttaggttgatgtagatggtttttaagtc

SEQ ID NO: 15479 - DNA, 201 bp, synthetic construct
  misc_feature 1..201: note = Description of Artificial Sequence: Synthetic polynucleotide
  source 1..201: mol_type = other DNA
aaagttgtttaaagttttataatgagttgatttattgggaataggaggaggttttgttgttagtttttgtgttatatttggtattttgtttaggtttattggagaggagattatatgttttttttttagtttttttaatttttttagttaagataggtgttattatttattttagttttagtgtgttttgagtgtgttgga

SEQ ID NO: 15480 - DNA, 201 bp, synthetic construct
  misc_feature 1..201: note = Description of Artificial Sequence: Synthetic polynucleotide
  source 1..201: mol_type = other DNA
tatttttttgttttagttttttgagtagttgggattataggtgtttgttattgtgtttggttaattttttgtatttttttagtagagatggggttttattgtggttttgattttttgattttgtgatttgtttattttggttttttaaagtgttgggattataggtgtgagttattgtgtttggttgtgtgtgttttttaa

SEQ ID NO: 15481 - DNA, 201 bp, synthetic construct
  misc_feature 1..201: note = Description of Artificial Sequence: Synthetic polynucleotide
  source 1..201: mol_type = other DNA
gtatgtggtagtaggatttatttttggggtgttttgggttggtgaatttatatttttttatgttaatggtttgtagtatttgtagtttgtgggttgagttggttgtggggggtttattggtggtaggggtattattggggagagtggtggatggttgggttggtggtggtggaggtagtaggggttttgttatgtggttgt

SEQ ID NO: 15482 - DNA, 279 bp, synthetic construct
  misc_feature 1..279: note = Description of Artificial Sequence: Synthetic polynucleotide
  source 1..279: mol_type = other DNA
ggtggaagagttgatagtaaggggagtggttaaatggaggtggggtttggaagggggtgtggtttgtgggtttttgggttgtttggtttttttaggtgttgtagtggaaggtttggagtagaggttgtttttttgtttaagtattttttgggtgagtttatatttttggtgtgagtatgatttttttttttagggaaggttgggttttttgttggggtttgatttgattttttttttttatttttttttttttgttttatatttagtgagtttaggttt

SEQ ID NO: 15483 - DNA, 201 bp, synthetic construct
  misc_feature 1..201: note = Description of Artificial Sequence: Synthetic polynucleotide
  source 1..201: mol_type = other DNA
ttatatgggaggttgaggttagagaatggtgtgaatttgggaggtagagtttgtagtgagttgagatggtattattgtattttagtttgggtgatagagtgagatttagttttaaaaaaaaaaaaaaaaaaaaaggaaaatttaggtttttttttagattgaaatttttgtaaatataatttatgattttatagtagttag

SEQ ID NO: 15484 - DNA, 201 bp, synthetic construct
  misc_feature 1..201: note = Description of Artificial Sequence: Synthetic polynucleotide
  source 1..201: mol_type = other DNA
ttttgttgtaaaagaagtgtttatagaatttttatttttttttattattattattttttgagatagagttgttgttgtttgggttggagtatagtggtatgattttggttaattgtaagttttgttttttgggtttatgttatttttttgttttagttttatttttttgttttgttttgttttgttttgttttgtttttga

SEQ ID NO: 15485 - DNA, 201 bp, synthetic construct
  misc_feature 1..201: note = Description of Artificial Sequence: Synthetic polynucleotide
  source 1..201: mol_type = other DNA
gtttttttaatattttgaaatttaaagtgtgatagttttagaggattattaatataagtattatttgaaaatttgttagaaatgaagaattaggttgggtgtggtggtttatgtttataattttagtattttgggaggtttagatgggaggattatgatattaggagattgagattattttggttaatatggtgagatttc

SEQ ID NO: 15486 - DNA, 201 bp, synthetic construct
  misc_feature 1..201: note = Description of Artificial Sequence: Synthetic polynucleotide
  source 1..201: mol_type = other DNA
tatggtgaaaatttgttttttttaaaaatataaaaattagttaggtgtagtggtatgtgtttgtagatttagttatttgggtggttgaggtaggagaattgttggaatttgggaggttgaggttgtagtgagttgagattgtattattgtattgtagtttgggtgatagaataagattttaatttaaaaataataataata

SEQ ID NO: 15487 - DNA, 201 bp, synthetic construct
  misc_feature 1..201: note = Description of Artificial Sequence: Synthetic polynucleotide
  source 1..201: mol_type = other DNA
tttgtttaggaaatgtatataggagttggttattttgtgttttgagtttttttggaggtgttggatttttagagagagaaatagagatatgtaagagggtgaagatgttttagtggtgatatattggggagttttgtttatgatttgtttatgattggtatatttaatttgttttatggaattttattttatagtttggtt

SEQ ID NO: 15488 - DNA, 201 bp, synthetic construct
  misc_feature 1..201: note = Description of Artificial Sequence: Synthetic polynucleotide
  source 1..201: mol_type = other DNA
tgttaggataagtgagggtggtttgagttttgtgtttatatggtgtatgttgtttagtagatgatattgatggttgtaaatgttgtagggaatatagtgtgggtgtaaatgttaatggtgtttgtgttgatgggtttgagttgggtatggatgtttttttggttttttgagtgggttgttttttttttttttgtttttttt

SEQ ID NO: 15489 - DNA, 201 bp, synthetic construct
  misc_feature 1..201: note = Description of Artificial Sequence: Synthetic polynucleotide
  source 1..201: mol_type = other DNA
tttttgttgagagtggattttgtgtgtgtgttttttaggaatggtgataagtatgatggtgattgggtttgggattggtgttagggatatggggtgttgtgttgtgttgatggttttatttataaggtatttgggggtgtgtggtatttgttgtttagagggtataggttttgtggtgggtagggtgtgtggggtgtatgg

SEQ ID NO: 15490 - DNA, 201 bp, synthetic construct
  misc_feature 1..201: note = Description of Artificial Sequence: Synthetic polynucleotide
  source 1..201: mol_type = other DNA
gatattatattttatatttttttattttttttgatttggagttttgttttgttgtttaggtttgggtgtagtagtgtgattttggtttattgtaagttttgttttttgggtttatattatttttttgttttagttttttgagtagttgggattataggtgtttgttattatgtttggttaattttttgtatttgtagtaga

SEQ ID NO: 15491 - DNA, 201 bp, synthetic construct
  misc_feature 1..201: note = Description of Artificial Sequence: Synthetic polynucleotide
  source 1..201: mol_type = other DNA
tttttttttagaaagtatatgaataggttgggtatggtggtttatgtttgtaattttagtattttgggaggttgaggtgggtggattatgttagaagattgagattattttggttaatatggtgaaattttgtttttattaaaaatataaaaaaaaataagttgggtgtggtagtgggtgtttgtggttttagttattttg

SEQ ID NO: 15492 - DNA, 201 bp, synthetic construct
  misc_feature 1..201: note = Description of Artificial Sequence: Synthetic polynucleotide
  source 1..201: mol_type = other DNA
gtgtgagagttatatgttaggaataagaggtatgttgagaggtggttgggtatggtggtttatgtttgtaattttagtattttaggaggatgaggtgggtggattataaggttaggagattgagattattttggttaatatggtgaaattttgtttttattaaaaatataaaaaattagttgggtgtggtggtgggtgttt

SEQ ID NO: 15493 - DNA, 203 bp, synthetic construct
  misc_feature 1..203: note = Description of Artificial Sequence: Synthetic polynucleotide
  source 1..203: mol_type = other DNA
ttttataatgttttttattatttgtgagtatggtttgtaatgtggaagatataattttatttgattttttttagatttttttgttgttttagttttttatgtgttagtttttgggtttttattttaaatttttttaggtttagaatgttttgttttaaattttattgatattatttgtgaaattgtagttttttatgattaat

SEQ ID NO: 15494 - DNA, 201 bp, synthetic construct
  misc_feature 1..201: note = Description of Artificial Sequence: Synthetic polynucleotide
  source 1..201: mol_type = other DNA
attatatatggttgggtgtgatggtttatgttattgagtgattgttgtaattttagtattttgggaggttgagatgggaggattatgaggttaggagattgagattattttggttaatatggtgaaattttgtttttattaaaaaaataaaaatattagttgggtgtggtggtgggtgtttgtagttttagttatttggga

SEQ ID NO: 15495 - DNA, 201 bp, synthetic construct
  misc_feature 1..201: note = Description of Artificial Sequence: Synthetic polynucleotide
  source 1..201: mol_type = other DNA
agttttagttatttgggaggttgaggtaggagaatggtgtgaatttgggaggtggagtttgtagtgagttgagattgtgttattgtattttagtttgggtgatagagtgagattttgttttaaaaaataaaaataaataataataataattttagatattttataataatttttaggtataagagtttttatgagagtagg

SEQ ID NO: 15496 - DNA, 201 bp, synthetic construct
  misc_feature 1..201: note = Description of Artificial Sequence: Synthetic polynucleotide
  source 1..201: mol_type = other DNA
tgggggttttagaatttttgtagtttatatttttttggtttttttttgggtagtttggaggtttttgattttttggagtttttggtatttgagtttttttgtgaaagtttgtttgagaagggtttttgttttgggtttggtagattggagtttttttttgggttttttttttttttttttgggtgttttgttttttgttaa

SEQ ID NO: 15497 - DNA, 201 bp, synthetic construct
  misc_feature 1..201: note = Description of Artificial Sequence: Synthetic polynucleotide
  source 1..201: mol_type = other DNA
atgtgttattatgtttggttaatttttgtatttttagtggagatggggttttattatgttggttaggttggttttaaattttttattttgtgatttgtttgttttggttttttaaagtgttgggattataggagtgagttattatgtttggttttaattttagttttatagatgaaaaaatggaagtttaggattagtgat

SEQ ID NO: 15498 - DNA, 201 bp, synthetic construct
  misc_feature 1..201: note = Description of Artificial Sequence: Synthetic polynucleotide
  source 1..201: mol_type = other DNA
aagtagtatttggttttttgtttttgtgttaatttattttggataatggtttttagttgtatttatgttgttgtaaaggattggattttgttttttttatgattgtatagtattttatggtatatatatatatatattatatttttttaatttggtttatttatgtttttgttgttgtgaatagttttgtaatgaatatgt

SEQ ID NO: 15499 - DNA, 201 bp, synthetic construct
  misc_feature 1..201: note = Description of Artificial Sequence: Synthetic polynucleotide
  source 1..201: mol_type = other DNA
ttaaataaatgttgggtgttagggttgttgagtaagataataggttgtaaggatgtagtagaggatttttggttgatttgttgtgatggagtgagttagtggtgaggtttgaaggtttttgttttattttttttttggagtagaggttggggagggtgttgggtgttagtatagagtagagggttggttatggaattgggg

SEQ ID NO: 15500 - DNA, 201 bp, synthetic construct
  misc_feature 1..201: note = Description of Artificial Sequence: Synthetic polynucleotide
  source 1..201: mol_type = other DNA
gggagtgtagtggtgtgattttggtttattgtaatttttgttttttgggtttaagtgatttttttgttttagtttttttagtaggtaggattatagttgtgtgttattatatttggttaattttttgtatttttagtagagattgggttttattatgttagttagaatggttttaatttattgattttgtgatttgtttgt

SEQ ID NO: 15501 - DNA, 201 bp, synthetic construct
  misc_feature 1..201: note = Description of Artificial Sequence: Synthetic polynucleotide
  source 1..201: mol_type = other DNA
ttagtagaaatagggttttattatgttggttagaatggttttgattttttgattttgtgatttgtttgttttgtttttttaaagtgttgggattataggtgtgagttattgtgttttgtttattgtttatttttttttgtttgttttattttgattgttggggttttggatattatataaagagttagttggagagtgaga

SEQ ID NO: 15502 - DNA, 201 bp, synthetic construct
  misc_feature 1..201: note = Description of Artificial Sequence: Synthetic polynucleotide
  source 1..201: mol_type = other DNA
ggaatgtagtggtgttattttgttgattgtattttttgttttttggttgtaagtgatttttttgttttagtttttttagtagttgggattataggtgtgtgttataatatttagttaatttttgtatttttagtagagatgggtttttattaagttggttaggttggttttgaatttttgattttgtgatttgtttgtttt

SEQ ID NO: 15503 - DNA, 201 bp, synthetic construct
  misc_feature 1..201: note = Description of Artificial Sequence: Synthetic polynucleotide
  source 1..201: mol_type = other DNA
tattttggttttttaaagtgttggtgttataggtgtgaattattgtatttggtttgttttttattttattatttatttattttttttgagattgagttttgtttttgttgtttaggttggagtgtgtagtggtttaattttggtttattgtaaattttgttttttgggtttaagtgatttttttgttttagttttttgagt

SEQ ID NO: 15504 - DNA, 3238 bp, synthetic construct
  misc_feature 1..3238: note = Description of Artificial Sequence: Synthetic polynucleotide
  source 1..3238: mol_type = other DNA
tttttttttggattggtttaatttttttttttaagtttggtattttgtttttttttagtgggggatattttgttgttttggggtgtttgttgtgggtgttgtatgattttgggtgtaagttagagattttataaatatgttgggttttgtgtagtggtttttgggaaggtattgttatttgtgggagggtttggtttgttattttttattttttgttgttttaatgttattttttaagtttggtgtttttttttttttttttggaggtttttgtgttgttttggggtgttttttgtgggtgagatatataatttgggtgtaagttagggattttgtgattatttttggtttggtgtaggggtggttatttttgggatgatattattttgttatttttttttttggattgtttttattattttttttaattttggtgttttgtattttttttttagtggtttttttgttgttttgtggtgttttttgtgggtgagatatgtatttggggtgtaagatagggattttaggatgtttttgggtttattgtagaggttgttgggaaggtagtgttgtttgtgagaggattttagtatttttgttttttttttttggggttgttttaatttttttttttaagattgatgtgttgttttttttttttgggaatttttttgttgttttgtggtgtttgttgtgggtaagatatttattttgggtgtaagttagggaattaataatttttgtatgtttggtaaaggggttgttggtaaggtattgttatttgtgggattattttagttttgttgtttttttttttaggttatttaaatgtttttatttaagtttggtgttttgttgtttttttgtgggggattttttgttattttggggtgttttttgtgggtgagatatgtatattgtgtgtaagatagggattttgtgatttttttgggattggtataggggttgtagggaaggtattgttatttgtgaaaggattttagttttgttttttttttttttgggttgttttaatgtttttttttaagtttggtattttgtttttttttttttggggtttttttgttgttttggggtgttatttgtgggtgaggtatgtattttgggtgtaaattagggattttaagatttttagggttaggtgtaggggatgttgggaagttattgttttttgtggaaagtttttttttggattgttttaaagtttttttttaagtttggtattttgttttttttttttggagttttttttgtagtttttgtgtgtatatttaggtgagatatgtattttgttgtaagatagggattttaaatttttttgtttgggttaggtttaggggttgttgggaaggtattgtggtttgtgggatgattatagtttagttgttgtttttttttggttggtttaatgtttttttttaagtttgatatgttgttttttttttttgggggttttgttgttatttttatgtgtattttgtgagtaagataggtattttgggtttaagttaggggttttattgtttatttgggttttatttagaggttgttgggaaggtattgtttttagtggaaattttttttttggattgttttaatgtttttttttaagtttggtgttttgtttttttttatttggggattttttattgtattgtggtgtttattgtgggtatgatatgtattttgggtgtaagttagggattttataattattttaggtttgatgtaggggttattggataagatattgttgtttttgggatgatattggtttgttttaattttattttttaattttggagttttgtattttttttttgggggtttttttgttgttttgtggtgttatttgtgggtgagatatataatttgggagtaagttagagattttatgatatttttgggtttattgtagaggttgttaggaaggtggtgttatttgtgggaggattttagttttattatttttattttggggttgttttaattttttttttaagtttgatgtgttttttttttttttgggaatttatttgttgttttggggtgtttttttgagtgagatatgtattttgggtgtaagttatggattttaggattattttggtttagtgaaggggttgttaggaaggtattgttgtttgtgggagaaatttagtgttgttgtttttttttatgggttattttaaagtttttttttaagtttgaggtgttgttttttttttttaggggtttatttgttgttttggggtgttttttatgggtgaaatatgtattttgggtgtaagatagggattttatgatttttttgggtttagtgtagggattgttaggaaggtattgttatttgtaggaggaatttgattagttgtttttttttttgtgttgttttagtatttttattaaagtttggttttttgtggtgtttgtttggtggtttttttgttattttggggtgtttttatgggtgtgatttgtatttttggtgtaagttagggattttatgattattttgggtttgatgtaggggttgttgggaaggtattgttgtttatgggatgattttagtttgttatgtttttttttggattgttttaattattttttttaattttggtgttttatattttttttttggtggtttttttgttgttttgtggtgttttttgagggtgagatatgtattttgggtgtaagttaaggattttatgatgtttttaggtttattatagatgttgttgggaagatagtgttatttgtggtaggattttagtattttttttttatttttggggttgttttaatgtttttttttaagtttgatgtgttgttttttttttttgggaatttatttgttgttttggggtgttttttgtggaattttgggtgtaagtttgggatataataatttttttgggtttggtaaaggggttgttgggaaggtattgtggtttgtgggaagtttttttttggattgttttaaagtttttttttaagtttggtgttttgttttttttttagggggtatttttgttgttttggggtgtttttttgtgggtgtgatatgtattttgggtttaagttaggaattttatgataattttgagtttggtgtaggggttgttgggaaggtattgttgtttgtgtgatgattgttgtttgttgtttttttttttgtgttgttttaatgttattttttatgtttggtgtttta

SEQ ID NO: 15505 - DNA, 201 bp, synthetic construct
  misc_feature 1..201: note = Description of Artificial Sequence: Synthetic polynucleotide
  source 1..201: mol_type = other DNA
tgttattttgtttggttaattttgtgtgtgtgtgtttttagtagagatggggttttattgtgttagttaggatggttttgattttttgattttgtgatttgttttttttggttttttaaagtgttgggattataggtgtgagttattgtgtttggttttttgtatattattttttgagatattttgaggtaatagttttgg

SEQ ID NO: 15506 - DNA, 201 bp, synthetic construct
  misc_feature 1..201: note = Description of Artificial Sequence: Synthetic polynucleotide
  source 1..201: mol_type = other DNA
tgatgtttaagtatttgagaatggtgattaattattttggagagtatttgtaaaggtggttttttagttgttttttttggaagttgtagtttttgtgtttgtttttgtattttgtatatttgttgaggtggggtgtgttaattattaaattattaatgagtgatggtttaaattgtaggtagagtaatgaatagatggtgg

SEQ ID NO: 15507 - DNA, 201 bp, synthetic construct
  misc_feature 1..201: note = Description of Artificial Sequence: Synthetic polynucleotide
  source 1..201: mol_type = other DNA
tgtaataagtttgggggttgattttgggtgtgttgggggtgagggggttatggtggagatggatatgggtgtggggtggttgagatttgtatggtttagtgggtattggtattgtggggtttttgtttttagaggattattgttttatattgaagtttttttttttgtatatttagagtttgatgtatttttaattattgt

SEQ ID NO: 15508 - DNA, 201 bp, synthetic construct
  misc_feature 1..201: note = Description of Artificial Sequence: Synthetic polynucleotide
  source 1..201: mol_type = other DNA
gggtgtggtggtgggtatttgtaattttagttatttgggaggttgaggtaggagaatggtgtgaatttgggaggtggagtttgtagtgagttgagattgtgttattgtattttagtttgggtgatagagtgagattttgttttaaaaaaaaaaaaaaaaaaaaagaagaagttagagtaaggaggtagaatgatttttagg

SEQ ID NO: 15509 - DNA, 201 bp, synthetic construct
  misc_feature 1..201: note = Description of Artificial Sequence: Synthetic polynucleotide
  source 1..201: mol_type = other DNA
ggttagggtgtatgtggtgttggggtttggggggatgtttgttgttttggttgtattttggttatgtatatttttgggggtggttgttttattgtagggtgtgggggtggagtttggtttaagaagagtggtaaagggtgggtggttttggtggtttagtttagggtttgggagtgtttgggggtttttttgttttggggg

SEQ ID NO: 15510 - DNA, 201 bp, synthetic construct
  misc_feature 1..201: note = Description of Artificial Sequence: Synthetic polynucleotide
  source 1..201: mol_type = other DNA
aaaaagtaaaaaataaaaattagttggttatagtggtgggtgtttgtaattttaattgtttgggaggttgagttaggataatagtttgattttgtggggtggaggttgttatgagttaaaattgtgttattttattttaggttgggtgtaagagtgagattttgttttaaaaaaaaaaaaaaagttttatgttgggtgttg

SEQ ID NO: 15511 - DNA, 201 bp, synthetic construct
  misc_feature 1..201: note = Description of Artificial Sequence: Synthetic polynucleotide
  source 1..201: mol_type = other DNA
taggtgtgagttattgtgtttggttatttttgataattttattttaaatagtgataggttaaaagttaagagtggatgttttagtatttagttttttagtgttttgttagttattttaagtttgttgataggagtttgattttattgattttttttttttttagagttatgtttattttttaaaattttaagaagttgttt

SEQ ID NO: 15512 - DNA, 201 bp, synthetic construct
  misc_feature 1..201: note = Description of Artificial Sequence: Synthetic polynucleotide
  source 1..201: mol_type = other DNA
attttggaggttgaggtaggagaatggtgtgaatgtgggaggtggagtttgtagtgagttgagattgtgttttttgattttaggtgatttgtttgtttttgtatttggttaatttgtttttgtatatataatttttttattgtttaatatattttagggttttttaattttatattttatattttagtttttttaatagat

SEQ ID NO: 15513 - DNA, 201 bp, synthetic construct
  misc_feature 1..201: note = Description of Artificial Sequence: Synthetic polynucleotide
  source 1..201: mol_type = other DNA
tagggttttgttgtgttggttgggttggtttttagtttttaattgtgagtgatttgttaattttggttttttgaggtgttgggattgtagatggagttttgtttatttagtgtttaatggtgtttaggttggagtgtagtggtgtgattttggtttattataatttatattttttagttgtttgttttggttttttaaaat

SEQ ID NO: 15514 - DNA, 201 bp, synthetic construct
  misc_feature 1..201: note = Description of Artificial Sequence: Synthetic polynucleotide
  source 1..201: mol_type = other DNA
aggttgaggtaggtggattataaggttagaatattgagattattttgggtagtatgatgaaattttgtttttattaaaaaatataaaaaattagttgggtgtggtggttggtgtttgtagtattagttgtttaggaggttgaggtaggagaatggtatgaatttgggaggtggagtttgtagtgagttgagattgtgttat

SEQ ID NO: 15515 - DNA, 414 bp, Homo sapiens
  source 1..414: mol_type = unassigned DNA
ccgccagtgtccgtcgccttccacacgtggccgcagttctgtgcatggggccgcccgccatcctgccgcctctgacctgggctgtgggctcgtgacacgtgtctgagctttccagtcgtggccgtgacgctctgtgcggaggctccgtccgcgtgctgcctccgtcccctctgccctggacggccactcactacctttgtctctcaccctgggggtttcatgaccccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacg

SEQ ID NO: 15516 - DNA, 987 bp, Homo sapiens
  source 1..987: mol_type = unassigned DNA
ccggagggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtggtgagtgcccccccaaagtgggcttggctccatctagcccctcggctctcggcagcagaagagggcccagcccctgcagagctgctgggggtcccaggcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggtgggtcagtccagtcctgagggcgcgggctcctcg

SEQ ID NO: 15517 - DNA, 1061 bp, Homo sapiens
  source 1..1061: mol_type = unassigned DNA
tcgctgttggtggggcccggggagccctgctgtggccgccactcaccaggtaggcggtgaaggcctcggcgtcggcatccaccagcgtggttagcttggccgaagcctcgcggaagggcgggatcaggcgccgcatcgtcgtgtccagggactggaattggcgccgcccgtaggtcatgaggcccaccatggagcccagcgccgcaccctgcgagaggggtggatgtgggggtcgcagggaccccagacggcccgggaccgaccccaggaagagccaggggcccgggtgatccctgcgggggtcccacccgtgtggcccccacgtctccacccagggcggccccaccgcgccctccccaccccgtgccctccccccaacagcgcccttccccctccccgccctccccccaacaactgcgcctcccctgcccctccccccgcgctcaccatggccgcagcggccgccgccaccgagccgcccccgggggccgcagagcgggcacccacctcccccacgaaggcgcgcagggacttgctgcccaggcctcgctcaggcccgcgctcagggaccaggtacctgcagggtgggcgcggctcagcgggtctggccggggttggtggggggagcgcagtcctcccggggcggccccaggccccacgcccgtctgcacccacggggaggtgaccactcggctgagaacctgcggggacccggccggggtctctgtgcccccctcagcccccagaccccggcttggcgcaggccgagtaggcgcccaaagggaggcgctgggaggactcagccgggtctccacgcagggaccccagcgccccgcaaggcccgagaggcagagcccgggaggggtgagaagagggcgggagggcagaggctcactcgatgatccgctccttagggctgaaggggcacagggagtccaggcccagccggctcaccacctggaaaaggggcttggagtggaaacggcctcggcgcgtctccaccaccaggaaagcctcggaacccgcgggtcccacccttgcggcagccgccccctgccccg

SEQ ID NO: 15518 - DNA, 382 bp, Homo sapiens
  source 1..382: mol_type = unassigned DNA
gcgtgtttatcatccggcacacgggagacccacgcgtgtttactgtcgggcacaggggagacccacgcgtgtttactgttcggcacacgagagacccacgcgtgtttaccgtttggcacagggagacccacgcgtgtttactgtccggcacaggggagacccacgcgtgtttactgtccggcacagggagacccacgcgtgtttactgtccggcacaggggagacccacgtgtgtttactgtccggcacagggaagacccacgtgtgtttactgtccggcacacaggagacccacacggggcctgtttaccatccggcacacaggaggcccatgcatctttaccgtcaggcacacgggaaacccacgcgtgtttaccgtccg

SEQ ID NO: 15519 - DNA, 261 bp, Homo sapiens
  source 1..261: mol_type = unassigned DNA
acggaggacttttcgcccctgcggtcagctggaccaggtggccggcagcgagacggaacaagtagaccaggctgagggtgaaggcgcaggcgatcagcagcatggacaagaggttgccgcctgccacctcctccatcgcctggcccagcacctacccacccgcctgtagcaagcccagcagcatcatcccggccgccgccgccatttcactctgtcggagacactgaaggccgaggtcgccaccgatcctcctaatcgacg

SEQ ID NO: 15520 - DNA, 892 bp, Homo sapiens
  source 1..892: mol_type = unassigned DNA
acgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctcgtggccaaggcaggattagggcggcaggagaagcgcgagaaggaggagcagacgcacagcgacccagcccggcctccgccaacgcttaaacagccccgcg

SEQ ID NO: 15521 - DNA, 682 bp, Homo sapiens
  source 1..682: mol_type = unassigned DNA
ccgggggcccacggtgtagcgggtcgtcagccgggccccgggccttctgggcagcaagggccctggcaggaccctgagggctgggccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcg

SEQ ID NO: 15522 - DNA, 223 bp, Homo sapiens
  source 1..223: mol_type = unassigned DNA
acgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcggggccgggaccagacctgtgcatctctccgcctcgcacccagcgcctctgtttttcg

SEQ ID NO: 15523 - DNA, 255 bp, Homo sapiens
  source 1..255: mol_type = unassigned DNA
gcggacagctcgaatgtactgcagaagcatccgcccatcagtgggttccatcgccgggcacaggcctgtgtgcccagggcagagcgcctggtgcatgctgtggagggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccg

SEQ ID NO: 15524 - DNA, 309 bp, Homo sapiens
  source 1..309: mol_type = unassigned DNA
ccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccg

SEQ ID NO: 15525 - DNA, 992 bp, Homo sapiens
  source 1..992: mol_type = unassigned DNA
ccgccctgcgctcagcagcacagcaccgtgggggtcagatagaggcgctcccgcctcccagccggggccagctccgggccccctcttcccccagaccggcacaggacccagaccgcccaccccagcacactgacccagacagtctcgcggatcagcctggctatcttgagcaggagctgcccgaatgtgcccggctggaagtgggtggccgagtgctggatgcagaggcacaggaggaaggcgggggtcagcttgtggtcgtcgccccccggctcgatcaacgtcatgatcctctgcagcagcgtgtcctccaggtggggctcaaactccaggagcagctgctggcgccggggcagggcggcctgagtaggggaggcggctccccgggccccgagcgcggccccgcacagccggcagctctgcggcacagcccggaggcgcgccaaggcccgggcgggcaggggctgggcctgcgcggggtccttgaatagcagcaggtagtagagccccagggagagcaggtccccgtggtgcagcaccacggtcctgtgccccacctcggagaagttgacggagatgtgcgccccggggatgggctccaggaccagcctccccgcggcctggccgctgtccgggagcggttgccggcggatggtgcagtgtagaggcaggatgtcgggggctgagaggctgatgctgggcttgctggagggggtccgctggcccaccgtgtgccggtcccggttgagcacatacaccaggctgtcctgaaacagagactccgctcagggcaggcgtaacgcgagcagcacacgggaaaagcgtcccgtgtctagtcactggttgctgaagcagcgtggctgggatgctgtcgccacgggctctccatgtccctggccacccccacaccagaaccccgacggctctcaggaacccgcccctcgatgtccgggcccatcccagaggaggtcggtttcccggaggagcacacg

SEQ ID NO: 15526 - DNA, 265 bp, Homo sapiens
  source 1..265: mol_type = unassigned DNA
ccgcgtcctgcgctcctggttttctcctcttctagtgtcttccccacctggcgtcgcccggccgcaaccctggccctcctggggaagaggttcggaccctactctttatttgacatgaagaggttcggactcccagttttattcggcatgttcacgggcagcagccccattttgtttggcgtgttcacgggcagcagccctgttttattcggcgtgttcacggtcagcagccccgttgtgcttggcgtgttcacgggcagccccg

SEQ ID NO: 15527 - DNA, 488 bp, Homo sapiens
  source 1..488: mol_type = unassigned DNA
ccggcggaggcgggcgtggtgggggaggggctctctcttttgcccttttacccctctggtaggcgccctagggcgggggtgctgccgcgcgcttcggcgcgccttggttctgtcaccagccccactggggcctcacaatcgctcagccgtccagtgcgcgcctggagaaagagaagtgggcgactacggagcagcgtctccattactgaccgttttctcgccattgtacccacacaacttgctctaaatgggcaatttattaagtatattttgtccctgttcccgccgcaggcccctgccggaccgtcgcccacaagctcccatagcccgtgagtcctctcagcctggcccggctcaccctgtggcgcccacgtctaccccgggccctttccgattcctctttaaccctcagcagagtcgcgggccttctccagtcagcttctacagcgcgcctaggagaccgtgtcctctcccgccagacacgggcg

SEQ ID NO: 15528 - DNA, 676 bp, Homo sapiens
  source 1..676: mol_type = unassigned DNA
ccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcg

SEQ ID NO: 15529 - DNA, 1238 bp, Homo sapiens
  source 1..1238: mol_type = unassigned DNA
gcggcccaaaggcaccggacgttggggccaagatgacctccgcgctgccatgaaccaggccattggacgcgggctccgcgccgagcctgcagtcctcgaggagtctctcgggttcctccgttttgatcacaccttctcggatggctgccgggcttttgcctgccccgccttgcatcgagtctctcatgacctcctccgcctccagcttgcccttctcgtcccctcggaagtagccgagggccggcccggggccttccaacttgaccaccctggaggctctaggaccggtttcgacggcccctcgaggccccactgactgatccaggctgggccccagcttctgcttcttggccttgacatgcagcgccaggggctgcaccgggtgcaactcgggcctggaggtggcgccgtctgacgctgtcggcggctgcaggagccgcaggtcgggcctgaactgcaacagccgcgcctgcgcggacgaggcagcggcttcctcgttctgggcctgaggctgtggtagcagcaacacctgctctggcttcacctgcagcagccgccgcaccgcgggctgtaagccggacgccactgcctccccgcacgacgaggccaaggtcgcactggctgccgcgctcagtgtgggagacgacggagggggctccatggctgctgcccaaaaggaggtgccctcgaccggcagcgggggcggagcgggacgcaacgggcgcggctgaggcggcggctcgggtctggctctctccatgggggagggggacgccccggccaggattgtgagctcagccgtttgttggcgaccttccccctccccctttcggttaagagccttgcaaggcctttgctacccagaaccctacgcggttcaaaacgcagctgtctgtctgggcctcacccaatcacaacgaccgatacccgtggacggccaatcacaggcgggttttccggctcttcctggtccctactctcgcctcgtgctgagtcctcgaatcacctgccatggtaggagccgccgcacttgttgcacattttcgttctgactctcttgtggagttctcttacagccgttgtctttagtcatccctcccccacccggagctgcgacaatggcgttgcccaggaaacgttgcgcttccaggccgctgacatccagggaatgaagtcttgcgtcacaaggggagcgacggccttgtgcacgcgctctgtgcggcctgagtaatctgtcg

SEQ ID NO: 15530 - DNA, 220 bp, Homo sapiens
  source 1..220: mol_type = unassigned DNA
acgctcatcgtctcgcaggcagctccagctcgagtggtggccgtgctgggtctgtgcccggggccttcccccgtatgctttcgctttctagtgtctgcgatgacgtgcgattcactaatcacccggactcagcgcatctctatgttaaatagcgcgtgtccatctgcaaagcacacgacagcccctgcggccactgggtgccggcgcccagcctgtcccg

SEQ ID NO: 15531 - DNA, 631 bp, Homo sapiens
  source 1..631: mol_type = unassigned DNA
gcggtgaggggtgatttcggaggaggcagagccccgggtgtccgtgggaagctccaaagccgggccgcgggacggctaccctgggctgtgacgcagtccaggatcttcgccaaggcacctgctggaggcccctcctgggtcccacgaccccgactgcgcctgccggctgccagcgaggaggcggggccaaggcgagggcggggccgaggcaggaggggcggggtcggcctgatgggcggggcttccgtgtgggcggggctgctggccctgcggtctgagccagcggggagaggcccgggcggaggaggctgcggactcctagaggttcagtgccggaagttgggcctggaaagggggcaccgccttcccggttctggtggcggggagtgaggggacgggcgaaagcggcacagggaacagcatgacacgggcctgaggcagggcacatttggaaaggggcgaggagagggcagtggcttctggcacggcagcagtgggcatacagaggcagtcgggacccgtctggaagagcctccgcccggggtaaggagccgggactgtgtctaggaggcagtggggagctccggagagcgaagcgcctcctgcgcagactcgcgtgcttggagtaccg

SEQ ID NO: 15532 - DNA, 904 bp, Homo sapiens
  source 1..904: mol_type = unassigned DNA
acggcgtctgcctctcgctcttggagtgctcctggcctaacgcagcagtttcgcagataaacgttacagaaggtagagcgctctacagatatgaaggagtggcccgtggtttcacgtagaacaaattacttccggcagaaagatcaggaaagtttcgaaatcgcggagttctcaagggatgggcagaacgggcgggtgagcagggccaagcgcctcctggacagtgaccatcccggagcctggggacgcgctggggggcaggagctgtcccactcgttcaggcgagggtctgggaagggaccccaagcgggaggccgacgctgcctgggtcctcccttggggcggccgcctccccattcaccccgagcatcccgaaacctggaaaggagcaaagctgaagcgatggccacgtgcatgacggcaggcagcctgcagattcgttgttaaactacactcacgccgggtctaacaggcgcgcacctgccggcacgccgcccgctgctgtgacctgggcagcgtcgggtctcaggcccccgcctctcgcgctgtgacagtgagaagccgagaaagtcatgtcacgtccgtctgaggaggcagctcctcagtgtggcagaaagaaatgcccactctccgagcaccagccaggacgtgtgcttaagccaacctgttcattcttccacctgatcccttatgtaatgtaacatgcatgtttcatccacaaaaatgagcagcgaaatccaccgacccagcaacatgttccgagacacgcaggagccttttccacggagccagctcccggccttcccctccaacatccaccccgcgctcgcgtagcccgggctcctgccattgcgctgccagctgggcggcacctttcaggcggggaaaagcgaatcttctgccg

SEQ ID NO: 15533 - DNA, 519 bp, Homo sapiens
  source 1..519: mol_type = unassigned DNA
acgtcactctctgggggcgcggtggggctgggcagggagcgcggcgcgtgtctgacacccatggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtgcgaccgccg

SEQ ID NO: 15534 - DNA, 204 bp, Homo sapiens
  source 1..204: mol_type = unassigned DNA
ccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagaggtaagtcctgctgccacgtgcctccccacgggcctgcgtctgcacctccctgcgcg

SEQ ID NO: 15535 - DNA, 444 bp, Homo sapiens
  source 1..444: mol_type = unassigned DNA
ccggccttcgtgcagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacg

SEQ ID NO: 15536 - DNA, 397 bp, Homo sapiens
  source 1..397: mol_type = unassigned DNA
acgcgccctgcccaccacgaggcctgtaccctctgggcagcaggtgccgcgcgcccccgggtaccttgtaggtggagccgtcggcgcagcgcagcaccccgtgtccctgacgccggtcccggacccagtcgccgtcgtacttgtcaccgttcctgggggacacacgcacggagtccactctcaacagggggagccgggtggtggcagtgactcagaccggctcctcccaccgggctccgcaggcactgcgggaccgaggcaaaaataggcccgagcagatggccccaagagctcctgcctcgccagggccagctgggggccgacgacaggcggtggggacacgtccgcccacccccaccctagatggtaggcctgctcgggacgcactcagcttccg

SEQ ID NO: 15537 - DNA, 1530 bp, Homo sapiens
  source 1..1530: mol_type = unassigned DNA
acgcatggaatcttcgagcctggagaacgtgctggagccctgcgcctacgcccccacctacgtggtcaaggacttcccgatcgccagataccagggcctgcaatttgtgagtgcggctggagaccccgtctcccgtccgggactccgcggagccttctccagccccttgggaggccgccccgggaggtccgcgccctgagccctgcgcccccccaccccccaggtgtacctgtccttcgtttatcccaacgactacactcgcctcacccacatggagacggacaacaagtgcttctaccgcgagtctccgctgtatctggagaggtgggcgcgcggccgggctaatgcggggcggggtgggcggggcgggactcggctctgatgccccgccgcgccccaggtttgggttctataaatacatgaagatggacaaggaggagggggatgaggatgaagaagacgaggtgcagcgccgagccttcctcttcctcaacccggacggtgagtgtccgcagcgcccctggcccgcacccacctgcgcagggagcttctaacccgcgtttcccgcagacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccg

SEQ ID NO: 15538 - DNA, 414 bp, Homo sapiens
  source 1..414: mol_type = unassigned DNA
cgtgtcagcgccaggctggacccagcgagccgccgatgccagcgagatgccaggctggactcagcaagccgccgatgccagccagacgcagagcagagaacgctggtcaaagagcagctaggcggtgtctgctcggccgaagcccagtcccggagaggcaggctctgtaccaggacgtggaggctccggggtcatgaaacccccagggtgagagacaaaggtagtgagtggccgtccagggcagaggggacggaggcagcacgcggacggagcctccgcacagagcgtcacggccacgactggaaagctcagacacgtgtcacgagcccacagcccaggtcagaggcggcaggatggcgggcggccccatgcacagaactgcggccacgtgtggaaggcgacggacactggcgg

SEQ ID NO: 15539 - DNA, 987 bp, Homo sapiens
  source 1..987: mol_type = unassigned DNA
cgaggagcccgcgccctcaggactggactgacccaccttgaggttgacgatgggcacggctgcgcggtcggcacggcgcacgatgctgtacaggtcctgcaggcgcgaggacaggaaggcgcggaaggtgcccgccagccccacggcccgcgcctgctggaagcactggaagtcggccccgcggatgccccgcatgccgcctgacagggggctgttgagcgcaaccaggtggagctgcggggagaggggcgcgtcacgggctgtgtcccacgctgccccctgcacccaggccccgggcgcaccaccccggccccgcacctgtgtggacaggcacggccgaggggcgctgagcgggaggcgcgcaagtgacacactgaggggcccaggcagcagcccccatacgctgccaggtcagagcagccccgggccacgtgggtgcccccagctgccgctgtaggcggaggtacgccggttcctcaaggatgtgacagcggctggactttcatgaccactgcttggccaccagagggcaagtcccagggccagccaagccgccctgagtggccctgagccgccagacccccacccatggccgaagcctgggacccccagcagctctgcaggggctgggccctcttctgctgccgagagccgaggggctagatggagccaagcccactttgggggggcactcaccaccggctggaagtcgcggtggctgtgggcgggtgggcttgtgggtcgcgccggccgcaggtgcacgtaggagctgtggtgcggggctccggggtagggctggggctcgggcaggcgaggggggctggccaggatgtcatctgcccgccagggccgcgcggtggggtgggggtgctcccgccgcgggtaggggttgctgtcgtgcagctgcaccacggggggctgcaaggcggccacttcattgtcctgcaggtgggagacgtggggcctgtcggcggggggaccctccgg

SEQ ID NO: 15540 - DNA, 1061 bp, Homo sapiens
  source 1..1061: mol_type = unassigned DNA
cggggcagggggcggctgccgcaagggtgggacccgcgggttccgaggctttcctggtggtggagacgcgccgaggccgtttccactccaagccccttttccaggtggtgagccggctgggcctggactccctgtgccccttcagccctaaggagcggatcatcgagtgagcctctgccctcccgccctcttctcacccctcccgggctctgcctctcgggccttgcggggcgctggggtccctgcgtggagacccggctgagtcctcccagcgcctccctttgggcgcctactcggcctgcgccaagccggggtctgggggctgaggggggcacagagaccccggccgggtccccgcaggttctcagccgagtggtcacctccccgtgggtgcagacgggcgtggggcctggggccgccccgggaggactgcgctccccccaccaaccccggccagacccgctgagccgcgcccaccctgcaggtacctggtccctgagcgcgggcctgagcgaggcctgggcagcaagtccctgcgcgccttcgtgggggaggtgggtgcccgctctgcggcccccgggggcggctcggtggcggcggccgctgcggccatggtgagcgcggggggaggggcaggggaggcgcagttgttggggggagggcggggagggggaagggcgctgttggggggagggcacggggtggggagggcgcggtggggccgccctgggtggagacgtgggggccacacgggtgggacccccgcagggatcacccgggcccctggctcttcctggggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggtgagtggcggccacagcagggctccccgggccccaccaacagcga

SEQ ID NO: 15541 - DNA, 382 bp, Homo sapiens
  source 1..382: mol_type = unassigned DNA
cggacggtaaacacgcgtgggtttcccgtgtgcctgacggtaaagatgcatgggcctcctgtgtgccggatggtaaacaggccccgtgtgggtctcctgtgtgccggacagtaaacacacgtgggtcttccctgtgccggacagtaaacacacgtgggtctcccctgtgccggacagtaaacacgcgtgggtctccctgtgccggacagtaaacacgcgtgggtctcccctgtgccggacagtaaacacgcgtgggtctccctgtgccaaacggtaaacacgcgtgggtctctcgtgtgccgaacagtaaacacgcgtgggtctcccctgtgcccgacagtaaacacgcgtgggtctcccgtgtgccggatgataaacacgc

SEQ ID NO: 15542 - DNA, 261 bp, Homo sapiens
  source 1..261: mol_type = unassigned DNA
cgtcgattaggaggatcggtggcgacctcggccttcagtgtctccgacagagtgaaatggcggcggcggccgggatgatgctgctgggcttgctacaggcgggtgggtaggtgctgggccaggcgatggaggaggtggcaggcggcaacctcttgtccatgctgctgatcgcctgcgccttcaccctcagcctggtctacttgttccgtctcgctgccggccacctggtccagctgaccgcaggggcgaaaagtcctccgt

SEQ ID NO: 15543 - DNA, 892 bp, Homo sapiens
  source 1..892: mol_type = unassigned DNA
cgcggggctgtttaagcgttggcggaggccgggctgggtcgctgtgcgtctgctcctccttctcgcgcttctcctgccgccctaatcctgccttggccacgagggagcttgtgctcacgcagaccgggcagtgcgggaaccagatcggcgccaaggttggcagccggggctctgagggcccagcccgggcctgccgggtggccggggaagatgttggcagcggcgggggcggtgcccctgcattgcggcccctgggctccctgccggggacggtggaaccgggtggctggcgaggcggcgggggtggaccccagggacagggcggcctggggatgggggtgcggatgggggtgggagagcggctggggcgcctccgtgactcagccccggcctgtctggcccctcccgtctccgcagttctgggaggtgatctctgatgaacatgccatcgactccgctggcacctaccacggggacagccacctgcagctggagcgcatcaacgtgcaccaccacgaggccagcggtgcgacccccgtccttcccccaccgccctcctgggaacgcggccctcccctcgctcatgccctcccgccccacgcaggtggcaggtacgtgtcccgcgctgtgctcgtggatctggagccgggcaccatggactctgtgcgctcggggcccttcgggcaggtcttcaggccagacaacttcatttcccgtgagctgcgggcgaggactggggtgcggctccttagccagggcagctcgaaatccaggaacgctccaaggtcatcctgtgggaactgtggcgccagggcccctgaacaccctcctgtcctccgagtcgagtcgctccatctgcctcctaaacgggcttcgggaggaaggcccgcgt

SEQ ID NO: 15544 - DNA, 682 bp, Homo sapiens
  source 1..682: mol_type = unassigned DNA
cgcccagcaggcggcattgcgccctgacgccggggacccagcacccagccgtcctcgcccgcaggtgccctggctctgccccggccctccctggtctgtgtcctgactctgtttcccgtcgcccagaacgccgcagccagggcggcacacaagcctcgaggggcggggtccgggggcccctcttccatccgcctttcgtctccctccctgctggatctgaggcgccgctcccgccgcgctgtcctcgcgccatgccacgtcacgtcacgtcacgtcacgttacgttcccacgtcacgtccacgtcacgttcccacttcccgtccacagggaaacgggccccggcgatgtgagggcgtctgccgtgcttggtgccttcacaggggagcttcctgccttggccgcggttccaggctctgtgctgacgcagcaggagggtccccgggcagcccaggcaggcgacggggagtgacgagggtccttcacagccatgggagccgagcccagagcaggcggcagcagcgtctttgccacccctggcctaaaagcagccgtgtggggcccctgacaggtgccccggagcgaactgccctccttggcccagccctcagggtcctgccagggcccttgctgcccagaaggcccggggcccggctgacgacccgctacaccgtgggcccccgg

SEQ ID NO: 15545 - DNA, 223 bp, Homo sapiens
  source 1..223: mol_type = unassigned DNA
cgaaaaacagaggcgctgggtgcgaggcggagagatgcacaggtctggtcccggccccgccctttgcctgttctaaagggcaaggtctctccgcctcgcgccccgcctctgtcccacccaggccccgccaccatgttcgggggccccacccgggactggcttctgtcctgcgcagcaaacccggaagtggatcacgtggagtaaaggtcctaccgaggcgcgt

SEQ ID NO: 15546 - DNA, 255 bp, Homo sapiens
  source 1..255: mol_type = unassigned DNA
cgggaggccgggttcggtgcatgggggccgggcacactttctctgggcatccctaggacaggcgaggaacgcatcggccgggactccacctacgagcaggagggcaaggtgcagtttgtgattgatgcggtgtacgccattgcccacgccctccacagcatgcaccaggcgctctgccctgggcacacaggcctgtgcccggcgatggaacccactgatgggcggatgcttctgcagtacattcgagctgtccgc

SEQ ID NO: 15547 - DNA, 309 bp, Homo sapiens
  source 1..309: mol_type = unassigned DNA
cggcaggtttgctgcgctcgtcccagccagggcccagagtccctcggccagtttatcgcatctggaccccagatgggcgcgttgggtggtgcccgcgccagggaaagagctggcggctggctgagttgctgcgttcctgagcgctgtgcccgttgtgaccattggcgtggctgtctcccggcaggctcgaaggaatcgctgttctcctgcacgctgacggccagcgaggaggccatggcggtgctggaggaggtggtgctgtacgccttccagcagtgcgtctactatgtctccaaggtgcacggacgg

SEQ ID NO: 15548 - DNA, 992 bp, Homo sapiens
  source 1..992: mol_type = unassigned DNA
cgtgtgctcctccgggaaaccgacctcctctgggatgggcccggacatcgaggggcgggttcctgagagccgtcggggttctggtgtgggggtggccagggacatggagagcccgtggcgacagcatcccagccacgctgcttcagcaaccagtgactagacacgggacgcttttcccgtgtgctgctcgcgttacgcctgccctgagcggagtctctgtttcaggacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggtcagtgtgctggggtgggcggtctgggtcctgtgccggtctgggggaagagggggcccggagctggccccggctgggaggcgggagcgcctctatctgacccccacggtgctgtgctgctgagcgcagggcgg

SEQ ID NO: 15549 - DNA, 265 bp, Homo sapiens
  source 1..265: mol_type = unassigned DNA
cggggctgcccgtgaacacgccaagcacaacggggctgctgaccgtgaacacgccgaataaaacagggctgctgcccgtgaacacgccaaacaaaatggggctgctgcccgtgaacatgccgaataaaactgggagtccgaacctcttcatgtcaaataaagagtagggtccgaacctcttccccaggagggccagggttgcggccgggcgacgccaggtggggaagacactagaagaggagaaaaccaggagcgcaggacgcgg

SEQ ID NO: 15550 - DNA, 488 bp, Homo sapiens
  source 1..488: mol_type = unassigned DNA
cgcccgtgtctggcgggagaggacacggtctcctaggcgcgctgtagaagctgactggagaaggcccgcgactctgctgagggttaaagaggaatcggaaagggcccggggtagacgtgggcgccacagggtgagccgggccaggctgagaggactcacgggctatgggagcttgtgggcgacggtccggcaggggcctgcggcgggaacagggacaaaatatacttaataaattgcccatttagagcaagttgtgtgggtacaatggcgagaaaacggtcagtaatggagacgctgctccgtagtcgcccacttctctttctccaggcgcgcactggacggctgagcgattgtgaggccccagtggggctggtgacagaaccaaggcgcgccgaagcgcgcggcagcacccccgccctagggcgcctaccagaggggtaaaagggcaaaagagagagcccctcccccaccacgcccgcctccgccgg

SEQ ID NO: 15551 - DNA, 676 bp, Homo sapiens
  source 1..676: mol_type = unassigned DNA
cgccggatgaactctgtcccttcagaagaaagccgggttggtgtgctcgatgacgcagcgcttgcagtggcgtttgacaaagcgcagggcctccacggagacctcgcagtcctggacattcagcgtctggaggtcaaagcagttggcggccacgatctgcaagccctggccggtgatgctctcgcaggacttgaggctgagccgcttgaggttgaagcagttcagggccaggcactccaggcccgtgtcggataccaaagggcatttgccgatatccagggatttgagtttggtgcagttcttggcgaggtactccacaccgtggtccgtgatgccctcgcagcccctcgcgttgaggtagcgcagcttgctgcagtacttggccacgtagcggatgcccacgtcggtgacccggccgcagtgcgcgatgctcaggtaccgcaggcgggactccagcttggcgatctcccgcaggccgaagtcgctgacgaagcggcagtcgctgacgctcagctccttgatggaggcgcagtagatcaccaggtagcgcaggccttcgtcggtcaggcggacgcagcggcgcaggtagaggtgggtgagctgcgtgcagtgcgccgcgatggtgtgcaggccttcgtcctccagcacgaagcagtccgtcatgtccaggtagcgg

SEQ ID NO: 15552 - DNA, 1238 bp, Homo sapiens
  source 1..1238: mol_type = unassigned DNA
cgacagattactcaggccgcacagagcgcgtgcacaaggccgtcgctccccttgtgacgcaagacttcattccctggatgtcagcggcctggaagcgcaacgtttcctgggcaacgccattgtcgcagctccgggtgggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgc

SEQ ID NO: 15553 - DNA, 220 bp, Homo sapiens
  source 1..220: mol_type = unassigned DNA
cgggacaggctgggcgccggcacccagtggccgcaggggctgtcgtgtgctttgcagatggacacgcgctatttaacatagagatgcgctgagtccgggtgattagtgaatcgcacgtcatcgcagacactagaaagcgaaagcatacgggggaaggccccgggcacagacccagcacggccaccactcgagctggagctgcctgcgagacgatgagcgt

SEQ ID NO: 15554 - DNA, 631 bp, Homo sapiens
  source 1..631: mol_type = unassigned DNA
cggtactccaagcacgcgagtctgcgcaggaggcgcttcgctctccggagctccccactgcctcctagacacagtcccggctccttaccccgggcggaggctcttccagacgggtcccgactgcctctgtatgcccactgctgccgtgccagaagccactgccctctcctcgcccctttccaaatgtgccctgcctcaggcccgtgtcatgctgttccctgtgccgctttcgcccgtcccctcactccccgccaccagaaccgggaaggcggtgccccctttccaggcccaacttccggcactgaacctctaggagtccgcagcctcctccgcccgggcctctccccgctggctcagaccgcagggccagcagccccgcccacacggaagccccgcccatcaggccgaccccgcccctcctgcctcggccccgccctcgccttggccccgcctcctcgctggcagccggcaggcgcagtcggggtcgtgggacccaggaggggcctccagcaggtgccttggcgaagatcctggactgcgtcacagcccagggtagccgtcccgcggcccggctttggagcttcccacggacacccggggctctgcctcctccgaaatcacccctcaccgc

SEQ ID NO: 15555 - DNA, 904 bp, Homo sapiens
  source 1..904: mol_type = unassigned DNA
cggcagaagattcgcttttccccgcctgaaaggtgccgcccagctggcagcgcaatggcaggagcccgggctacgcgagcgcggggtggatgttggaggggaaggccgggagctggctccgtggaaaaggctcctgcgtgtctcggaacatgttgctgggtcggtggatttcgctgctcatttttgtggatgaaacatgcatgttacattacataagggatcaggtggaagaatgaacaggttggcttaagcacacgtcctggctggtgctcggagagtgggcatttctttctgccacactgaggagctgcctcctcagacggacgtgacatgactttctcggcttctcactgtcacagcgcgagaggcgggggcctgagacccgacgctgcccaggtcacagcagcgggcggcgtgccggcaggtgcgcgcctgttagacccggcgtgagtgtagtttaacaacgaatctgcaggctgcctgccgtcatgcacgtggccatcgcttcagctttgctcctttccaggtttcgggatgctcggggtgaatggggaggcggccgccccaagggaggacccaggcagcgtcggcctcccgcttggggtcccttcccagaccctcgcctgaacgagtgggacagctcctgccccccagcgcgtccccaggctccgggatggtcactgtccaggaggcgcttggccctgctcacccgcccgttctgcccatcccttgagaactccgcgatttcgaaactttcctgatctttctgccggaagtaatttgttctacgtgaaaccacgggccactccttcatatctgtagagcgctctaccttctgtaacgtttatctgcgaaactgctgcgttaggccaggagcactccaagagcgagaggcagacgccgt

SEQ ID NO: 15556 - DNA, 519 bp, Homo sapiens
  source 1..519: mol_type = unassigned DNA
cggcggtcgcacctctcgcagacgcgcacggtccaggctgcgatgatccaggaggagatgctgaagaccagcagcacggtgccggggcagatggtcatgagtgtcttcatgacgaagcgcgtgttgaaggtgatcttgttgagggccccgatgctgcggctcgaggcgtccgtgaagattttgctgtgcagtagcatcacccggcccagcaggtagaggcgcaggaacatggggatggacagcagcacgtccacgtcggcctcggccaccgagggcgcgtacgtgaaggccagccgcgccgtccacgtgaagcggtagtggccgggcaccgggtgaatggcgcacactgccagctctagcgagatgaggaacacgcgctcgcaggtcatggcgatgcgccagtcatcagccccgttgtccaccatgaacagctgtggagggcgggagggaaccagccatgggtgtcagacacgcgccgcgctccctgcccagccccaccgcgcccccagagagtgacgt

SEQ ID NO: 15557 - DNA, 204 bp, Homo sapiens
  source 1..204: mol_type = unassigned DNA
cgcgcagggaggtgcagacgcaggcccgtggggaggcacgtggcagcaggacttacctctggggtgccccgggtcggtgaactcatacttccccacgccaatggtccgcagcatctgcagcccgtgggccgagtcggttgtggggggcccattggtggcaggggcaccactggggagagtggcggacggctgggctggcggcgg

SEQ ID NO: 15558 - DNA, 444 bp, Homo sapiens
  source 1..444: mol_type = unassigned DNA
cgtggccgactgtcatcccacttcgaaacacgcagaggggaaggcagcccgagggctctttctcccaggaagtttctgggcagctgccgccgggcgccaggacaagcgagggtggcctgagtcctgtgctcacatggcgtatgccgcccagtagatgacattgacggccgcaaacgccgcagggaacacagcgcgggcgtaaatgtcaatggtgtctgcgtcgatgggcctgagccgggcacggatgcccccctggcctcctgagcgggctgccccctccttcttcgtctcccctgtctccacccccaccgacctgtaggagcccatcaggttccccgggacgcggcgctgccggcgggagatggccagctcctgcgtgacgccggcagcagagagggagaagaggacaatggcgttcctcacgtccatctgcacgaaggccgg

SEQ ID NO: 15559 - DNA, 397 bp, Homo sapiens
  source 1..397: mol_type = unassigned DNA
cggaagctgagtgcgtcccgagcaggcctaccatctagggtgggggtgggcggacgtgtccccaccgcctgtcgtcggcccccagctggccctggcgaggcaggagctcttggggccatctgctcgggcctatttttgcctcggtcccgcagtgcctgcggagcccggtgggaggagccggtctgagtcactgccaccacccggctccccctgttgagagtggactccgtgcgtgtgtcccccaggaacggtgacaagtacgacggcgactgggtccgggaccggcgtcagggacacggggtgctgcgctgcgccgacggctccacctacaaggtacccgggggcgcgcggcacctgctgcccagagggtacaggcctcgtggtgggcagggcgcgt

SEQ ID NO: 15560 - DNA, 1530 bp, Homo sapiens
  source 1..1530: mol_type = unassigned DNA
cggctgtccccgcctccaaaaccgccctggcgcgcgttcggccgcccccatacccgccgtggcgcgcgttcagccgctccatgtactgagcggtcacgtccacggcctccgcctccggcagctgcaggttccccgaaacgttgcatcgcaggtcgttccagtccgagcgcagcagctcgaagtccacggcgcccacgctgaacgtgcgctgccagtcgatggcgtcctcacgccagcgtccgagcgccgggcccgcggcctcctcgctgtcctccgacgcggcctcgtcgcccggggccccatcgtcctccccttcctcctcctcttcgccctccccgggcagctgcggcccggacacctgggacaagctcaggaaggaggtcacgggccgcgcttcggaggacaagtttgagtccactgtgggcgccgcaggtcccagcgtgcgcgcctggccctcccggcccccttgggtggcctgcgcccgggctgggggcctcggctgtgtggcctgggggccgccggtcctgcggccgtggggccggggtgggcgtgggggcgcccgcagctgcactctgggcagaggcctggggtgcaggaagacgccagggaagggcggccagggcgcacgcggcgctggggcccggggggatgcccgctgtcccggccgcaccctggtcacgtacacctttgggggcggctgctccactgcagggcgcgggggcggagctcggcccaagaagagcggcaaagggcgggcggccctggcggcccagctcagggcccgggagtgcctgggggtccccccgtcccgggggcggggaggggtcggcggggcgagggtggctccgggctgggcgggggctgctggggcgggggactgggggccgctcctgggcggggccgcctcggtgggctccaggctgtcgagcagctccccctcgtcctcgtcgtccaggaagtctgcgggaaacgcgggttagaagctccctgcgcaggtgggtgcgggccaggggcgctgcggacactcaccgtccgggttgaggaagaggaaggctcggcgctgcacctcgtcttcttcatcctcatccccctcctccttgtccatcttcatgtatttatagaacccaaacctggggcgcggcggggcatcagagccgagtcccgccccgcccaccccgccccgcattagcccggccgcgcgcccacctctccagatacagcggagactcgcggtagaagcacttgttgtccgtctccatgtgggtgaggcgagtgtagtcgttgggataaacgaaggacaggtacacctggggggtgggggggcgcagggctcagggcgcggacctcccggggcggcctcccaaggggctggagaaggctccgcggagtcccggacgggagacggggtctccagccgcactcacaaattgcaggccctggtatctggcgatcgggaagtccttgaccacgtaggtgggggcgtaggcgcagggctccagcacgttctccaggctcgaagattccatgcgt

SEQ ID NO: 15561 - DNA, 414 bp, synthetic construct
  misc_feature 1..414: note = Description of Artificial Sequence: Synthetic polynucleotide
  source 1..414: mol_type = other DNA
tygttagtgttygtygttttttataygtggtygtagttttgtgtatggggtygttygttattttgtygtttttgatttgggttgtgggttygtgataygtgtttgagttttttagtygtggtygtgaygttttgtgyggaggtttygttygygtgttgttttygttttttttgttttggayggttatttattatttttgttttttattttgggggttttatgatttyggagtttttaygttttggtatagagtttgttttttygggattgggtttyggtygagtagatatygtttagttgttttttgattagygttttttgttttgygtttggttggtatyggyggtttgttgagtttagtttggtatttygttggtatyggyggttygttgggtttagtttggygttgatayg

SEQ ID NO: 15562 - DNA, 987 bp, synthetic construct
  misc_feature 1..987: note = Description of Artificial Sequence: Synthetic polynucleotide
  source 1..987: mol_type = other DNA
tyggagggttttttygtygataggttttaygttttttatttgtaggataatgaagtggtygttttgtagtttttygtggtgtagttgtaygatagtaatttttattygyggygggagtatttttattttatygygyggttttggygggtagatgatattttggttagtttttttygtttgttygagttttagttttatttyggagtttygtattatagtttttaygtgtatttgyggtyggygygatttataagtttattygtttatagttatygygatttttagtyggtggtgagtgtttttttaaagtgggtttggttttatttagtttttyggttttyggtagtagaagagggtttagtttttgtagagttgttgggggttttaggtttyggttatgggtgggggtttggyggtttagggttatttagggyggtttggttggttttgggatttgttttttggtggttaagtagtggttatgaaagtttagtygttgttatatttttgaggaatyggygtattttygtttatagyggtagttgggggtatttaygtggttyggggttgttttgatttggtagygtatgggggttgttgtttgggttttttagtgtgttatttgygygtttttygtttagygtttttyggtygtgtttgtttatataggtgyggggtyggggtggtgygttyggggtttgggtgtagggggtagygtgggatatagttygtgaygygttttttttttygtagttttatttggttgygtttaatagttttttgttaggyggtatgyggggtattygyggggtygatttttagtgtttttagtaggygygggtygtggggttggygggtatttttygygtttttttgttttygygtttgtaggatttgtatagtatygtgygtygtgtygatygygtagtygtgtttatygttaattttaaggtgggttagtttagttttgagggygygggtttttyg

SEQ ID NO: 15563 - DNA, 1061 bp, synthetic construct
  misc_feature 1..1061: note = Description of Artificial Sequence: Synthetic polynucleotide
  source 1..1061: mol_type = other DNA
tygttgttggtggggttyggggagttttgttgtggtygttatttattaggtaggyggtgaaggtttyggygtyggtatttattagygtggttagtttggtygaagtttygyggaagggygggattaggygtygtatygtygtgtttagggattggaattggygtygttygtaggttatgaggtttattatggagtttagygtygtattttgygagaggggtggatgtgggggtygtagggattttagayggttygggatygattttaggaagagttaggggttygggtgatttttgygggggttttattygtgtggtttttaygtttttatttagggyggttttatygygttttttttatttygtgttttttttttaatagygttttttttttttttygttttttttttaataattgygttttttttgttttttttttygygtttattatggtygtagyggtygtygttatygagtygttttygggggtygtagagygggtatttattttttttaygaaggygygtagggatttgttgtttaggtttygtttaggttygygtttagggattaggtatttgtagggtgggygyggtttagygggtttggtyggggttggtggggggagygtagttttttyggggyggttttaggttttaygttygtttgtatttayggggaggtgattattyggttgagaatttgyggggattyggtyggggtttttgtgttttttttagtttttagatttyggtttggygtaggtygagtaggygtttaaagggaggygttgggaggatttagtygggtttttaygtagggattttagygtttygtaaggttygagaggtagagttygggaggggtgagaagagggygggagggtagaggtttattygatgattygttttttagggttgaaggggtatagggagtttaggtttagtyggtttattatttggaaaaggggtttggagtggaaayggtttyggygygtttttattattaggaaagtttyggaattygygggttttatttttgyggtagtygttttttgtttyg

SEQ ID NO: 15564 - DNA, 382 bp, synthetic construct
  misc_feature 1..382: note = Description of Artificial Sequence: Synthetic polynucleotide
  source 1..382: mol_type = other DNA
gygtgtttattattyggtataygggagatttaygygtgtttattgtygggtataggggagatttaygygtgtttattgttyggtataygagagatttaygygtgtttatygtttggtatagggagatttaygygtgtttattgttyggtataggggagatttaygygtgtttattgttyggtatagggagatttaygygtgtttattgttyggtataggggagatttaygtgtgtttattgttyggtatagggaagatttaygtgtgtttattgttyggtatataggagatttatayggggtttgtttattattyggtatataggaggtttatgtatttttatygttaggtataygggaaatttaygygtgtttatygttyg

SEQ ID NO: 15565 - DNA, 261 bp, synthetic construct
  misc_feature 1..261: note = Description of Artificial Sequence: Synthetic polynucleotide
  source 1..261: mol_type = other DNA
ayggaggatttttygtttttgyggttagttggattaggtggtyggtagygagayggaataagtagattaggttgagggtgaaggygtaggygattagtagtatggataagaggttgtygtttgttattttttttatygtttggtttagtatttatttattygtttgtagtaagtttagtagtattatttyggtygtygtygttattttattttgtyggagatattgaaggtygaggtygttatygatttttttaatygayg

SEQ ID NO: 15566 - DNA, 892 bp, synthetic construct
  misc_feature 1..892: note = Description of Artificial Sequence: Synthetic polynucleotide
  source 1..892: mol_type = other DNA
aygygggtttttttttygaagttygtttaggaggtagatggagygattygattyggaggataggagggtgtttaggggttttggygttatagtttttataggatgattttggagygtttttggatttygagttgttttggttaaggagtygtattttagttttygttygtagtttaygggaaatgaagttgtttggtttgaagatttgttygaagggtttygagygtatagagtttatggtgttyggttttagatttaygagtatagygygggataygtatttgttatttgygtggggygggagggtatgagygaggggagggtygygtttttaggagggyggtgggggaaggaygggggtygtatygttggtttygtggtggtgtaygttgatgygttttagttgtaggtggttgttttygtggtaggtgttagyggagtygatggtatgtttattagagattattttttagaattgyggagaygggaggggttagataggtyggggttgagttayggaggygttttagtygtttttttatttttattygtatttttatttttaggtygttttgtttttggggtttattttygtygtttygttagttattyggttttatygttttyggtagggagtttaggggtygtaatgtaggggtatygttttygtygttgttaatatttttttyggttattyggtaggttygggttgggtttttagagtttyggttgttaattttggygtygatttggttttygtattgttyggtttgygtgagtataagttttttygtggttaaggtaggattagggyggtaggagaagygygagaaggaggagtagaygtatagygatttagttyggttttygttaaygtttaaatagtttygyg

SEQ ID NO: 15567 - DNA, 682 bp, synthetic construct
  misc_feature 1..682: note = Description of Artificial Sequence: Synthetic polynucleotide
  source 1..682: mol_type = other DNA
tygggggtttayggtgtagygggtygttagtygggtttygggttttttgggtagtaagggttttggtaggattttgagggttgggttaaggagggtagttygtttyggggtatttgttaggggttttatayggttgtttttaggttaggggtggtaaagaygttgttgtygtttgttttgggttyggtttttatggttgtgaaggattttygttatttttygtygtttgtttgggttgttyggggatttttttgttgygttagtatagagtttggaatygyggttaaggtaggaagtttttttgtgaaggtattaagtayggtagaygtttttatatygtyggggttygtttttttgtggaygggaagtgggaaygtgaygtggaygtgaygtgggaaygtaaygtgaygtgaygtgaygtgaygtggtatggygygaggatagygyggygggagyggygttttagatttagtagggagggagaygaaaggyggatggaagaggggttttyggatttygtttttygaggtttgtgtgtygttttggttgyggygttttgggygaygggaaatagagttaggatatagattagggagggtyggggtagagttagggtatttgygggygaggayggttgggtgttgggttttyggygttagggygtaatgtygtttgttgggyg

SEQ ID NO: 15568 - DNA, 223 bp, synthetic construct
  misc_feature 1..223: note = Description of Artificial Sequence: Synthetic polynucleotide
  source 1..223: mol_type = other DNA
aygygtttyggtaggatttttattttaygtgatttattttygggtttgttgygtaggatagaagttagtttygggtggggttttygaatatggtggyggggtttgggtgggatagaggyggggygygaggyggagagattttgttttttagaataggtaaagggyggggtygggattagatttgtgtattttttygtttygtatttagygtttttgtttttyg

SEQ ID NO: 15569 - DNA, 255 bp, synthetic construct
  misc_feature 1..255: note = Description of Artificial Sequence: Synthetic polynucleotide
  source 1..255: mol_type = other DNA
gyggatagttygaatgtattgtagaagtattygtttattagtgggttttatygtygggtataggtttgtgtgtttagggtagagygtttggtgtatgttgtggagggygtgggtaatggygtatatygtattaattataaattgtattttgtttttttgttygtaggtggagtttyggtygatgygtttttygtttgttttagggatgtttagagaaagtgtgttyggtttttatgtatygaattyggtttttyg

SEQ ID NO: 15570 - DNA, 309 bp, synthetic construct
  misc_feature 1..309: note = Description of Artificial Sequence: Synthetic polynucleotide
  source 1..309: mol_type = other DNA
tygttygtgtattttggagatatagtagaygtattgttggaaggygtatagtattattttttttagtatygttatggttttttygttggtygttagygtgtaggagaatagygattttttygagtttgtygggagatagttaygttaatggttataaygggtatagygtttaggaaygtagtaatttagttagtygttagttttttttttggygygggtattatttaaygygtttatttggggtttagatgygataaattggtygagggattttgggttttggttgggaygagygtagtaaatttgtyg

SEQ ID NO: 15571 - DNA, 992 bp, synthetic construct
  misc_feature 1..992: note = Description of Artificial Sequence: Synthetic polynucleotide
  source 1..992: mol_type = other DNA
tygttttgygtttagtagtatagtatygtgggggttagatagaggygttttygttttttagtyggggttagtttygggttttttttttttttagatyggtataggatttagatygtttattttagtatattgatttagatagtttygyggattagtttggttattttgagtaggagttgttygaatgtgttyggttggaagtgggtggtygagtgttggatgtagaggtataggaggaaggygggggttagtttgtggtygtygtttttyggttygattaaygttatgattttttgtagtagygtgttttttaggtggggtttaaattttaggagtagttgttggygtyggggtagggyggtttgagtaggggaggyggtttttygggtttygagygyggtttygtatagtyggtagttttgyggtatagttyggaggygygttaaggttygggygggtaggggttgggtttgygyggggtttttgaatagtagtaggtagtagagttttagggagagtaggttttygtggtgtagtattayggttttgtgttttatttyggagaagttgayggagatgtgygtttyggggatgggttttaggattagttttttygyggtttggtygttgttygggagyggttgtyggyggatggtgtagtgtagaggtaggatgtygggggttgagaggttgatgttgggtttgttggagggggttygttggtttatygtgtgtyggtttyggttgagtatatatattaggttgttttgaaatagagatttygtttagggtaggygtaaygygagtagtataygggaaaagygtttygtgtttagttattggttgttgaagtagygtggttgggatgttgtygttaygggttttttatgtttttggttatttttatattagaatttygayggtttttaggaattygtttttygatgttygggtttattttagaggaggtyggtttttyggaggagtatayg

SEQ ID NO: 15572 - DNA, 265 bp, synthetic construct
  misc_feature 1..265: note = Description of Artificial Sequence: Synthetic polynucleotide
  source 1..265: mol_type = other DNA
tygygttttgygtttttggttttttttttttttagtgttttttttatttggygtygttyggtygtaattttggtttttttggggaagaggttyggattttattttttatttgatatgaagaggttyggatttttagttttattyggtatgtttaygggtagtagttttattttgtttggygtgtttaygggtagtagttttgttttattyggygtgtttayggttagtagtttygttgtgtttggygtgtttaygggtagtttyg

SEQ ID NO: 15573 - DNA, 488 bp, synthetic construct
  misc_feature 1..488: note = Description of Artificial Sequence: Synthetic polynucleotide
  source 1..488: mol_type = other DNA
tyggyggaggygggygtggtgggggaggggtttttttttttgtttttttatttttttggtaggygttttagggygggggtgttgtygygygtttyggygygttttggttttgttattagttttattggggttttataatygtttagtygtttagtgygygtttggagaaagagaagtgggygattayggagtagygtttttattattgatygttttttygttattgtatttatataatttgttttaaatgggtaatttattaagtatattttgtttttgttttygtygtaggtttttgtyggatygtygtttataagtttttatagttygtgagtttttttagtttggttyggtttattttgtggygtttaygtttatttygggtttttttygatttttttttaatttttagtagagtygygggttttttttagttagtttttatagygygtttaggagatygtgttttttttygttagataygggyg

SEQ ID NO: 15574 - DNA, 676 bp, synthetic construct
  misc_feature 1..676: note = Description of Artificial Sequence: Synthetic polynucleotide
  source 1..676: mol_type = other DNA
tygttatttggatatgayggattgtttygtgttggaggaygaaggtttgtatattatygyggygtattgtaygtagtttatttatttttatttgygtygttgygttygtttgatygaygaaggtttgygttatttggtgatttattgygtttttattaaggagttgagygttagygattgtygtttygttagygatttyggtttgygggagatygttaagttggagtttygtttgyggtatttgagtatygygtattgyggtygggttatygaygtgggtattygttaygtggttaagtattgtagtaagttgygttattttaaygygaggggttgygagggtattayggattayggtgtggagtatttygttaagaattgtattaaatttaaatttttggatatyggtaaatgttttttggtattygataygggtttggagtgtttggttttgaattgttttaattttaagyggtttagttttaagttttgygagagtattatyggttagggtttgtagatygtggtygttaattgttttgatttttagaygttgaatgtttaggattgygaggttttygtggaggttttgygttttgttaaaygttattgtaagygttgygttatygagtatattaattyggtttttttttgaagggatagagtttattyggyg

SEQ ID NO: 15575 - DNA, 1238 bp, synthetic construct
  misc_feature 1..1238: note = Description of Artificial Sequence: Synthetic polynucleotide
  source 1..1238: mol_type = other DNA
gyggtttaaaggtatyggaygttggggttaagatgattttygygttgttatgaattaggttattggaygygggtttygygtygagtttgtagttttygaggagtttttygggttttttygttttgattatattttttyggatggttgtygggtttttgtttgtttygttttgtatygagttttttatgatttttttygtttttagtttgtttttttygttttttyggaagtagtygagggtyggttyggggttttttaatttgattattttggaggttttaggatyggtttygayggtttttygaggttttattgattgatttaggttgggttttagtttttgttttttggttttgatatgtagygttaggggttgtatygggtgtaattygggtttggaggtggygtygtttgaygttgtyggyggttgtaggagtygtaggtygggtttgaattgtaatagtygygtttgygyggaygaggtagyggttttttygttttgggtttgaggttgtggtagtagtaatatttgttttggttttatttgtagtagtygtygtatygygggttgtaagtyggaygttattgttttttygtaygaygaggttaaggtygtattggttgtygygtttagtgtgggagaygayggagggggttttatggttgttgtttaaaaggaggtgttttygatyggtagygggggyggagygggaygtaaygggygyggttgaggyggyggttygggtttggttttttttatgggggagggggaygtttyggttaggattgtgagtttagtygtttgttggygattttttttttttttttttyggttaagagttttgtaaggtttttgttatttagaattttaygyggtttaaaaygtagttgtttgtttgggttttatttaattataaygatygatattygtggayggttaattataggygggtttttyggttttttttggtttttattttygtttygtgttgagttttygaattatttgttatggtaggagtygtygtatttgttgtatattttygttttgatttttttgtggagtttttttatagtygttgtttttagttattttttttttattyggagttgygataatggygttgtttaggaaaygttgygtttttaggtygttgatatttagggaatgaagttttgygttataaggggagygayggttttgtgtaygygttttgtgyggtttgagtaatttgtyg

SEQ ID NO: 15576 - DNA, 220 bp, synthetic construct
  misc_feature 1..220: note = Description of Artificial Sequence: Synthetic polynucleotide
  source 1..220: mol_type = other DNA
aygtttatygtttygtaggtagttttagttygagtggtggtygtgttgggtttgtgttyggggttttttttygtatgttttygttttttagtgtttgygatgaygtgygatttattaattattyggatttagygtatttttatgttaaatagygygtgtttatttgtaaagtataygatagtttttgyggttattgggtgtyggygtttagtttgtttyg

SEQ ID NO: 15577 - DNA, 631 bp, synthetic construct
  misc_feature 1..631: note = Description of Artificial Sequence: Synthetic polynucleotide
  source 1..631: mol_type = other DNA
gyggtgaggggtgatttyggaggaggtagagtttygggtgttygtgggaagttttaaagtygggtygygggayggttattttgggttgtgaygtagtttaggattttygttaaggtatttgttggaggttttttttgggttttaygatttygattgygtttgtyggttgttagygaggaggyggggttaaggygagggyggggtygaggtaggaggggyggggtyggtttgatgggyggggttttygtgtgggyggggttgttggttttgyggtttgagttagyggggagaggttygggyggaggaggttgyggatttttagaggtttagtgtyggaagttgggtttggaaagggggtatygttttttyggttttggtggyggggagtgaggggaygggygaaagyggtatagggaatagtatgataygggtttgaggtagggtatatttggaaaggggygaggagagggtagtggtttttggtayggtagtagtgggtatatagaggtagtygggattygtttggaagagttttygttyggggtaaggagtygggattgtgtttaggaggtagtggggagtttyggagagygaagygttttttgygtagattygygtgtttggagtatyg

SEQ ID NO: 15578 - DNA, 904 bp, synthetic construct
  misc_feature 1..904: note = Description of Artificial Sequence: Synthetic polynucleotide
  source 1..904: mol_type = other DNA
ayggygtttgtttttygtttttggagtgtttttggtttaaygtagtagtttygtagataaaygttatagaaggtagagygttttatagatatgaaggagtggttygtggttttaygtagaataaattattttyggtagaaagattaggaaagtttygaaatygyggagtttttaagggatgggtagaaygggygggtgagtagggttaagygttttttggatagtgattatttyggagtttggggaygygttggggggtaggagttgttttattygtttaggygagggtttgggaagggattttaagygggaggtygaygttgtttgggtttttttttggggyggtygtttttttatttatttygagtatttygaaatttggaaaggagtaaagttgaagygatggttaygtgtatgayggtaggtagtttgtagattygttgttaaattatatttaygtygggtttaataggygygtatttgtyggtaygtygttygttgttgtgatttgggtagygtygggttttaggttttygtttttygygttgtgatagtgagaagtygagaaagttatgttaygttygtttgaggaggtagttttttagtgtggtagaaagaaatgtttatttttygagtattagttaggaygtgtgtttaagttaatttgtttatttttttatttgattttttatgtaatgtaatatgtatgttttatttataaaaatgagtagygaaatttatygatttagtaatatgtttygagataygtaggagttttttttayggagttagttttyggtttttttttttaatatttatttygygttygygtagttygggtttttgttattgygttgttagttgggyggtattttttaggyggggaaaagygaattttttgtyg

SEQ ID NO: 15579 - DNA, 519 bp, synthetic construct
  misc_feature 1..519: note = Description of Artificial Sequence: Synthetic polynucleotide
  source 1..519: mol_type = other DNA
aygttattttttgggggygyggtggggttgggtagggagygyggygygtgtttgatatttatggttggttttttttygttttttatagttgtttatggtggataayggggttgatgattggygtatygttatgatttgygagygygtgttttttatttygttagagttggtagtgtgygttatttattyggtgttyggttattatygttttaygtggayggygyggttggtttttaygtaygygttttyggtggtygaggtygaygtggaygtgttgttgtttatttttatgtttttgygtttttatttgttgggtygggtgatgttattgtatagtaaaatttttayggaygtttygagtygtagtatyggggtttttaataagattatttttaataygygtttygttatgaagatatttatgattatttgtttyggtatygtgttgttggtttttagtatttttttttggattatygtagtttggatygtgygygtttgygagaggtgygatygtyg

SEQ ID NO: 15580 - DNA, 204 bp, synthetic construct
  misc_feature 1..204: note = Description of Artificial Sequence: Synthetic polynucleotide
  source 1..204: mol_type = other DNA
tygtygttagtttagtygttygttattttttttagtggtgtttttgttattaatgggttttttataatygattyggtttaygggttgtagatgttgyggattattggygtggggaagtatgagtttatygattyggggtattttagaggtaagttttgttgttaygtgtttttttaygggtttgygtttgtatttttttgygyg

SEQ ID NO: 15581 - DNA, 444 bp, synthetic construct
  misc_feature 1..444: note = Description of Artificial Sequence: Synthetic polynucleotide
  source 1..444: mol_type = other DNA
tyggttttygtgtagatggaygtgaggaaygttattgtttttttttttttttttgttgtyggygttaygtaggagttggttatttttygtyggtagygtygygtttyggggaatttgatgggtttttataggtyggtgggggtggagataggggagaygaagaaggagggggtagttygtttaggaggttaggggggtattygtgttyggtttaggtttatygaygtagatattattgatatttaygttygygttgtgttttttgyggygtttgyggtygttaatgttatttattgggyggtataygttatgtgagtataggatttaggttattttygtttgttttggygttyggyggtagttgtttagaaattttttgggagaaagagttttygggttgtttttttttttgygtgtttygaagtgggatgatagtyggttayg

SEQ ID NO: 15582 - DNA, 397 bp, synthetic construct
  misc_feature 1..397: note = Description of Artificial Sequence: Synthetic polynucleotide
  source 1..397: mol_type = other DNA
aygygttttgtttattaygaggtttgtattttttgggtagtaggtgtygygygttttygggtattttgtaggtggagtygtyggygtagygtagtatttygtgtttttgaygtyggtttyggatttagtygtygtygtatttgttatygtttttgggggatataygtayggagtttatttttaatagggggagtygggtggtggtagtgatttagatyggttttttttatygggtttygtaggtattgygggatygaggtaaaaataggttygagtagatggttttaagagtttttgtttygttagggttagttgggggtygaygataggyggtggggataygttygtttatttttattttagatggtaggtttgttygggaygtatttagttttyg

SEQ ID NO: 15583 - DNA, 1530 bp, synthetic construct
  misc_feature 1..1530: note = Description of Artificial Sequence: Synthetic polynucleotide
  source 1..1530: mol_type = other DNA
aygtatggaattttygagtttggagaaygtgttggagttttgygtttaygtttttatttaygtggttaaggatttttygatygttagatattagggtttgtaatttgtgagtgyggttggagatttygtttttygttygggatttygyggagttttttttagttttttgggaggtygtttygggaggttygygttttgagttttgygtttttttattttttaggtgtatttgtttttygtttattttaaygattatattygttttatttatatggagayggataataagtgtttttatygygagttttygttgtatttggagaggtgggygygyggtygggttaatgyggggyggggtgggyggggygggattyggttttgatgtttygtygygttttaggtttgggttttataaatatatgaagatggataaggaggagggggatgaggatgaagaagaygaggtgtagygtygagttttttttttttttaattyggayggtgagtgttygtagygtttttggttygtatttatttgygtagggagtttttaattygygtttttygtagattttttggaygaygaggaygagggggagttgttygatagtttggagtttatygaggyggtttygtttaggagyggtttttagtttttygttttagtagttttygtttagttyggagttattttygtttygtygattttttttygttttygggayggggggatttttaggtattttygggttttgagttgggtygttagggtygttygttttttgtygttttttttgggtygagtttygttttygygttttgtagtggagtagtygtttttaaaggtgtaygtgattagggtgyggtygggatagygggtattttttygggttttagygtygygtgygttttggtygtttttttttggygtttttttgtattttaggtttttgtttagagtgtagttgygggygtttttaygtttatttyggttttayggtygtaggatyggyggtttttaggttatatagtygaggtttttagttygggygtaggttatttaagggggtygggagggttaggygygtaygttgggatttgyggygtttatagtggatttaaatttgtttttygaagygyggttygtgattttttttttgagtttgttttaggtgttygggtygtagttgtttggggagggygaagaggaggaggaaggggaggaygatggggtttygggygaygaggtygygtyggaggatagygaggaggtygygggttyggygttyggaygttggygtgaggaygttatygattggtagygtaygtttagygtgggygtygtggatttygagttgttgygttyggattggaaygatttgygatgtaaygtttyggggaatttgtagttgtyggaggyggaggtygtggaygtgatygtttagtatatggagyggttgaaygygygttayggygggtatgggggyggtygaaygygygttagggyggttttggaggyggggatagtyg

SEQ ID NO: 15584 - DNA, 414 bp, synthetic construct
  misc_feature 1..414: note = Description of Artificial Sequence: Synthetic polynucleotide
  source 1..414: mol_type = other DNA
ttgttagtgtttgttgttttttatatgtggttgtagttttgtgtatggggttgtttgttattttgttgtttttgatttgggttgtgggtttgtgatatgtgtttgagttttttagttgtggttgtgatgttttgtgtggaggttttgtttgtgtgttgtttttgttttttttgttttggatggttatttattatttttgttttttattttgggggttttatgattttggagtttttatgttttggtatagagtttgtttttttgggattgggttttggttgagtagatattgtttagttgttttttgattagtgttttttgttttgtgtttggttggtattggtggtttgttgagtttagtttggtattttgttggtattggtggtttgttgggtttagtttggtgttgatatg

SEQ ID NO: 15585 - DNA, 987 bp, synthetic construct
  misc_feature 1..987: note = Description of Artificial Sequence: Synthetic polynucleotide
  source 1..987: mol_type = other DNA
ttggagggtttttttgttgataggttttatgttttttatttgtaggataatgaagtggttgttttgtagttttttgtggtgtagttgtatgatagtaatttttatttgtggtgggagtatttttattttattgtgtggttttggtgggtagatgatattttggttagttttttttgtttgtttgagttttagttttattttggagttttgtattatagtttttatgtgtatttgtggttggtgtgatttataagtttatttgtttatagttattgtgatttttagttggtggtgagtgtttttttaaagtgggtttggttttatttagttttttggtttttggtagtagaagagggtttagtttttgtagagttgttgggggttttaggttttggttatgggtgggggtttggtggtttagggttatttagggtggtttggttggttttgggatttgttttttggtggttaagtagtggttatgaaagtttagttgttgttatatttttgaggaattggtgtatttttgtttatagtggtagttgggggtatttatgtggtttggggttgttttgatttggtagtgtatgggggttgttgtttgggttttttagtgtgttatttgtgtgttttttgtttagtgttttttggttgtgtttgtttatataggtgtggggttggggtggtgtgtttggggtttgggtgtagggggtagtgtgggatatagtttgtgatgtgtttttttttttgtagttttatttggttgtgtttaatagttttttgttaggtggtatgtggggtatttgtggggttgatttttagtgtttttagtaggtgtgggttgtggggttggtgggtattttttgtgtttttttgtttttgtgtttgtaggatttgtatagtattgtgtgttgtgttgattgtgtagttgtgtttattgttaattttaaggtgggttagtttagttttgagggtgtgggttttttg

SEQ ID NO: 15586 - DNA, 1061 bp, synthetic construct
  misc_feature 1..1061: note = Description of Artificial Sequence: Synthetic polynucleotide
  source 1..1061: mol_type = other DNA
ttgttgttggtggggtttggggagttttgttgtggttgttatttattaggtaggtggtgaaggttttggtgttggtatttattagtgtggttagtttggttgaagttttgtggaagggtgggattaggtgttgtattgttgtgtttagggattggaattggtgttgtttgtaggttatgaggtttattatggagtttagtgttgtattttgtgagaggggtggatgtgggggttgtagggattttagatggtttgggattgattttaggaagagttaggggtttgggtgatttttgtgggggttttatttgtgtggtttttatgtttttatttagggtggttttattgtgttttttttattttgtgttttttttttaatagtgtttttttttttttttgttttttttttaataattgtgttttttttgtttttttttttgtgtttattatggttgtagtggttgttgttattgagttgtttttgggggttgtagagtgggtatttattttttttatgaaggtgtgtagggatttgttgtttaggttttgtttaggtttgtgtttagggattaggtatttgtagggtgggtgtggtttagtgggtttggttggggttggtggggggagtgtagtttttttggggtggttttaggttttatgtttgtttgtatttatggggaggtgattatttggttgagaatttgtggggatttggttggggtttttgtgttttttttagtttttagattttggtttggtgtaggttgagtaggtgtttaaagggaggtgttgggaggatttagttgggtttttatgtagggattttagtgttttgtaaggtttgagaggtagagtttgggaggggtgagaagagggtgggagggtagaggtttatttgatgatttgttttttagggttgaaggggtatagggagtttaggtttagttggtttattatttggaaaaggggtttggagtggaaatggttttggtgtgtttttattattaggaaagttttggaatttgtgggttttatttttgtggtagttgttttttgttttg

SEQ ID NO: 15587 - DNA, 382 bp, synthetic construct
  misc_feature 1..382: note = Description of Artificial Sequence: Synthetic polynucleotide
  source 1..382: mol_type = other DNA
gtgtgtttattatttggtatatgggagatttatgtgtgtttattgttgggtataggggagatttatgtgtgtttattgtttggtatatgagagatttatgtgtgtttattgtttggtatagggagatttatgtgtgtttattgtttggtataggggagatttatgtgtgtttattgtttggtatagggagatttatgtgtgtttattgtttggtataggggagatttatgtgtgtttattgtttggtatagggaagatttatgtgtgtttattgtttggtatataggagatttatatggggtttgtttattatttggtatataggaggtttatgtatttttattgttaggtatatgggaaatttatgtgtgtttattgtttg

SEQ ID NO: 15588 - DNA, 261 bp, synthetic construct
  misc_feature 1..261: note = Description of Artificial Sequence: Synthetic polynucleotide
  source 1..261: mol_type = other DNA
atggaggattttttgtttttgtggttagttggattaggtggttggtagtgagatggaataagtagattaggttgagggtgaaggtgtaggtgattagtagtatggataagaggttgttgtttgttattttttttattgtttggtttagtatttatttatttgtttgtagtaagtttagtagtattattttggttgttgttgttattttattttgttggagatattgaaggttgaggttgttattgatttttttaattgatg

SEQ ID NO: 15589 - DNA, 892 bp, synthetic construct
  misc_feature 1..892: note = Description of Artificial Sequence: Synthetic polynucleotide
  source 1..892: mol_type = other DNA
atgtgggttttttttttgaagtttgtttaggaggtagatggagtgatttgatttggaggataggagggtgtttaggggttttggtgttatagtttttataggatgattttggagtgtttttggattttgagttgttttggttaaggagttgtattttagtttttgtttgtagtttatgggaaatgaagttgtttggtttgaagatttgtttgaagggttttgagtgtatagagtttatggtgtttggttttagatttatgagtatagtgtgggatatgtatttgttatttgtgtggggtgggagggtatgagtgaggggagggttgtgtttttaggagggtggtgggggaaggatgggggttgtattgttggttttgtggtggtgtatgttgatgtgttttagttgtaggtggttgtttttgtggtaggtgttagtggagttgatggtatgtttattagagattattttttagaattgtggagatgggaggggttagataggttggggttgagttatggaggtgttttagttgtttttttatttttatttgtatttttatttttaggttgttttgtttttggggtttatttttgttgttttgttagttatttggttttattgtttttggtagggagtttaggggttgtaatgtaggggtattgtttttgttgttgttaatattttttttggttatttggtaggtttgggttgggtttttagagttttggttgttaattttggtgttgatttggtttttgtattgtttggtttgtgtgagtataagtttttttgtggttaaggtaggattagggtggtaggagaagtgtgagaaggaggagtagatgtatagtgatttagtttggtttttgttaatgtttaaatagttttgtg

SEQ ID NO: 15590 - DNA, 682 bp, synthetic construct
  misc_feature 1..682: note = Description of Artificial Sequence: Synthetic polynucleotide
  source 1..682: mol_type = other DNA
ttgggggtttatggtgtagtgggttgttagttgggttttgggttttttgggtagtaagggttttggtaggattttgagggttgggttaaggagggtagtttgttttggggtatttgttaggggttttatatggttgtttttaggttaggggtggtaaagatgttgttgttgtttgttttgggtttggtttttatggttgtgaaggatttttgttattttttgttgtttgtttgggttgtttggggatttttttgttgtgttagtatagagtttggaattgtggttaaggtaggaagtttttttgtgaaggtattaagtatggtagatgtttttatattgttggggtttgtttttttgtggatgggaagtgggaatgtgatgtggatgtgatgtgggaatgtaatgtgatgtgatgtgatgtgatgtggtatggtgtgaggatagtgtggtgggagtggtgttttagatttagtagggagggagatgaaaggtggatggaagaggggtttttggattttgttttttgaggtttgtgtgttgttttggttgtggtgttttgggtgatgggaaatagagttaggatatagattagggagggttggggtagagttagggtatttgtgggtgaggatggttgggtgttgggtttttggtgttagggtgtaatgttgtttgttgggtg

SEQ ID NO: 15591 - DNA, 223 bp, synthetic construct
  misc_feature 1..223: note = Description of Artificial Sequence: Synthetic polynucleotide
  source 1..223: mol_type = other DNA
atgtgttttggtaggatttttattttatgtgatttatttttgggtttgttgtgtaggatagaagttagttttgggtggggtttttgaatatggtggtggggtttgggtgggatagaggtggggtgtgaggtggagagattttgttttttagaataggtaaagggtggggttgggattagatttgtgtatttttttgttttgtatttagtgtttttgttttttg

SEQ ID NO: 15592 - DNA, 255 bp, synthetic construct
  misc_feature 1..255: note = Description of Artificial Sequence: Synthetic polynucleotide
  source 1..255: mol_type = other DNA
gtggatagtttgaatgtattgtagaagtatttgtttattagtgggttttattgttgggtataggtttgtgtgtttagggtagagtgtttggtgtatgttgtggagggtgtgggtaatggtgtatattgtattaattataaattgtattttgtttttttgtttgtaggtggagttttggttgatgtgttttttgtttgttttagggatgtttagagaaagtgtgtttggtttttatgtattgaatttggttttttg

SEQ ID NO: 15593 - DNA, 309 bp, synthetic construct
  misc_feature 1..309: note = Description of Artificial Sequence: Synthetic polynucleotide
  source 1..309: mol_type = other DNA
ttgtttgtgtattttggagatatagtagatgtattgttggaaggtgtatagtattattttttttagtattgttatggtttttttgttggttgttagtgtgtaggagaatagtgatttttttgagtttgttgggagatagttatgttaatggttataatgggtatagtgtttaggaatgtagtaatttagttagttgttagttttttttttggtgtgggtattatttaatgtgtttatttggggtttagatgtgataaattggttgagggattttgggttttggttgggatgagtgtagtaaatttgttg

SEQ ID NO: 15594 - DNA, 992 bp, synthetic construct
  misc_feature 1..992: note = Description of Artificial Sequence: Synthetic polynucleotide
  source 1..992: mol_type = other DNA
ttgttttgtgtttagtagtatagtattgtgggggttagatagaggtgtttttgttttttagttggggttagttttgggttttttttttttttagattggtataggatttagattgtttattttagtatattgatttagatagttttgtggattagtttggttattttgagtaggagttgtttgaatgtgtttggttggaagtgggtggttgagtgttggatgtagaggtataggaggaaggtgggggttagtttgtggttgttgttttttggtttgattaatgttatgattttttgtagtagtgtgttttttaggtggggtttaaattttaggagtagttgttggtgttggggtagggtggtttgagtaggggaggtggttttttgggttttgagtgtggttttgtatagttggtagttttgtggtatagtttggaggtgtgttaaggtttgggtgggtaggggttgggtttgtgtggggtttttgaatagtagtaggtagtagagttttagggagagtaggtttttgtggtgtagtattatggttttgtgttttattttggagaagttgatggagatgtgtgttttggggatgggttttaggattagtttttttgtggtttggttgttgtttgggagtggttgttggtggatggtgtagtgtagaggtaggatgttgggggttgagaggttgatgttgggtttgttggagggggtttgttggtttattgtgtgttggttttggttgagtatatatattaggttgttttgaaatagagattttgtttagggtaggtgtaatgtgagtagtatatgggaaaagtgttttgtgtttagttattggttgttgaagtagtgtggttgggatgttgttgttatgggttttttatgtttttggttatttttatattagaattttgatggtttttaggaatttgttttttgatgtttgggtttattttagaggaggttggttttttggaggagtatatg

SEQ ID NO: 15595 - DNA, 265 bp, synthetic construct
  misc_feature 1..265: note = Description of Artificial Sequence: Synthetic polynucleotide
  source 1..265: mol_type = other DNA
ttgtgttttgtgtttttggttttttttttttttagtgttttttttatttggtgttgtttggttgtaattttggtttttttggggaagaggtttggattttattttttatttgatatgaagaggtttggatttttagttttatttggtatgtttatgggtagtagttttattttgtttggtgtgtttatgggtagtagttttgttttatttggtgtgtttatggttagtagttttgttgtgtttggtgtgtttatgggtagttttg

SEQ ID NO: 15596 - DNA, 488 bp, synthetic construct
  misc_feature 1..488: note = Description of Artificial Sequence: Synthetic polynucleotide
  source 1..488: mol_type = other DNA
ttggtggaggtgggtgtggtgggggaggggtttttttttttgtttttttatttttttggtaggtgttttagggtgggggtgttgttgtgtgttttggtgtgttttggttttgttattagttttattggggttttataattgtttagttgtttagtgtgtgtttggagaaagagaagtgggtgattatggagtagtgtttttattattgattgtttttttgttattgtatttatataatttgttttaaatgggtaatttattaagtatattttgtttttgtttttgttgtaggtttttgttggattgttgtttataagtttttatagtttgtgagtttttttagtttggtttggtttattttgtggtgtttatgtttattttgggttttttttgatttttttttaatttttagtagagttgtgggttttttttagttagtttttatagtgtgtttaggagattgtgtttttttttgttagatatgggtg

SEQ ID NO: 15597 - DNA, 676 bp, synthetic construct
  misc_feature 1..676: note = Description of Artificial Sequence: Synthetic polynucleotide
  source 1..676: mol_type = other DNA
ttgttatttggatatgatggattgttttgtgttggaggatgaaggtttgtatattattgtggtgtattgtatgtagtttatttatttttatttgtgttgttgtgtttgtttgattgatgaaggtttgtgttatttggtgatttattgtgtttttattaaggagttgagtgttagtgattgttgttttgttagtgattttggtttgtgggagattgttaagttggagttttgtttgtggtatttgagtattgtgtattgtggttgggttattgatgtgggtatttgttatgtggttaagtattgtagtaagttgtgttattttaatgtgaggggttgtgagggtattatggattatggtgtggagtattttgttaagaattgtattaaatttaaatttttggatattggtaaatgttttttggtatttgatatgggtttggagtgtttggttttgaattgttttaattttaagtggtttagttttaagttttgtgagagtattattggttagggtttgtagattgtggttgttaattgttttgatttttagatgttgaatgtttaggattgtgaggtttttgtggaggttttgtgttttgttaaatgttattgtaagtgttgtgttattgagtatattaatttggtttttttttgaagggatagagtttatttggtg

SEQ ID NO: 15598 - DNA, 1238 bp, synthetic construct
  misc_feature 1..1238: note = Description of Artificial Sequence: Synthetic polynucleotide
  source 1..1238: mol_type = other DNA
gtggtttaaaggtattggatgttggggttaagatgatttttgtgttgttatgaattaggttattggatgtgggttttgtgttgagtttgtagtttttgaggagttttttgggtttttttgttttgattatatttttttggatggttgttgggtttttgtttgttttgttttgtattgagttttttatgattttttttgtttttagtttgttttttttgtttttttggaagtagttgagggttggtttggggttttttaatttgattattttggaggttttaggattggttttgatggttttttgaggttttattgattgatttaggttgggttttagtttttgttttttggttttgatatgtagtgttaggggttgtattgggtgtaatttgggtttggaggtggtgttgtttgatgttgttggtggttgtaggagttgtaggttgggtttgaattgtaatagttgtgtttgtgtggatgaggtagtggtttttttgttttgggtttgaggttgtggtagtagtaatatttgttttggttttatttgtagtagttgttgtattgtgggttgtaagttggatgttattgtttttttgtatgatgaggttaaggttgtattggttgttgtgtttagtgtgggagatgatggagggggttttatggttgttgtttaaaaggaggtgtttttgattggtagtgggggtggagtgggatgtaatgggtgtggttgaggtggtggtttgggtttggttttttttatgggggagggggatgttttggttaggattgtgagtttagttgtttgttggtgatttttttttttttttttttggttaagagttttgtaaggtttttgttatttagaattttatgtggtttaaaatgtagttgtttgtttgggttttatttaattataatgattgatatttgtggatggttaattataggtgggttttttggttttttttggtttttatttttgttttgtgttgagtttttgaattatttgttatggtaggagttgttgtatttgttgtatatttttgttttgatttttttgtggagtttttttatagttgttgtttttagttattttttttttatttggagttgtgataatggtgttgtttaggaaatgttgtgtttttaggttgttgatatttagggaatgaagttttgtgttataaggggagtgatggttttgtgtatgtgttttgtgtggtttgagtaatttgttg

SEQ ID NO: 15599 - DNA, 220 bp, synthetic construct
  misc_feature 1..220: note = Description of Artificial Sequence: Synthetic polynucleotide
  source 1..220: mol_type = other DNA
atgtttattgttttgtaggtagttttagtttgagtggtggttgtgttgggtttgtgtttggggtttttttttgtatgtttttgttttttagtgtttgtgatgatgtgtgatttattaattatttggatttagtgtatttttatgttaaatagtgtgtgtttatttgtaaagtatatgatagtttttgtggttattgggtgttggtgtttagtttgttttg

SEQ ID NO: 15600 - DNA, 631 bp, synthetic construct
  misc_feature 1..631: note = Description of Artificial Sequence: Synthetic polynucleotide
  source 1..631: mol_type = other DNA
gtggtgaggggtgattttggaggaggtagagttttgggtgtttgtgggaagttttaaagttgggttgtgggatggttattttgggttgtgatgtagtttaggatttttgttaaggtatttgttggaggttttttttgggttttatgattttgattgtgtttgttggttgttagtgaggaggtggggttaaggtgagggtggggttgaggtaggaggggtggggttggtttgatgggtggggtttttgtgtgggtggggttgttggttttgtggtttgagttagtggggagaggtttgggtggaggaggttgtggatttttagaggtttagtgttggaagttgggtttggaaagggggtattgtttttttggttttggtggtggggagtgaggggatgggtgaaagtggtatagggaatagtatgatatgggtttgaggtagggtatatttggaaaggggtgaggagagggtagtggtttttggtatggtagtagtgggtatatagaggtagttgggatttgtttggaagagtttttgtttggggtaaggagttgggattgtgtttaggaggtagtggggagttttggagagtgaagtgttttttgtgtagatttgtgtgtttggagtattg

SEQ ID NO: 15601 - DNA, 904 bp, synthetic construct
  misc_feature 1..904: note = Description of Artificial Sequence: Synthetic polynucleotide
  source 1..904: mol_type = other DNA
atggtgtttgttttttgtttttggagtgtttttggtttaatgtagtagttttgtagataaatgttatagaaggtagagtgttttatagatatgaaggagtggtttgtggttttatgtagaataaattatttttggtagaaagattaggaaagttttgaaattgtggagtttttaagggatgggtagaatgggtgggtgagtagggttaagtgttttttggatagtgattattttggagtttggggatgtgttggggggtaggagttgttttatttgtttaggtgagggtttgggaagggattttaagtgggaggttgatgttgtttgggtttttttttggggtggttgtttttttatttattttgagtattttgaaatttggaaaggagtaaagttgaagtgatggttatgtgtatgatggtaggtagtttgtagatttgttgttaaattatatttatgttgggtttaataggtgtgtatttgttggtatgttgtttgttgttgtgatttgggtagtgttgggttttaggtttttgttttttgtgttgtgatagtgagaagttgagaaagttatgttatgtttgtttgaggaggtagttttttagtgtggtagaaagaaatgtttattttttgagtattagttaggatgtgtgtttaagttaatttgtttatttttttatttgattttttatgtaatgtaatatgtatgttttatttataaaaatgagtagtgaaatttattgatttagtaatatgttttgagatatgtaggagttttttttatggagttagtttttggtttttttttttaatatttattttgtgtttgtgtagtttgggtttttgttattgtgttgttagttgggtggtattttttaggtggggaaaagtgaattttttgttg

SEQ ID NO: 15602 - DNA, 519 bp, synthetic construct
  misc_feature 1..519: note = Description of Artificial Sequence: Synthetic polynucleotide
  source 1..519: mol_type = other DNA
atgttattttttgggggtgtggtggggttgggtagggagtgtggtgtgtgtttgatatttatggttggtttttttttgttttttatagttgtttatggtggataatggggttgatgattggtgtattgttatgatttgtgagtgtgtgttttttattttgttagagttggtagtgtgtgttatttatttggtgtttggttattattgttttatgtggatggtgtggttggtttttatgtatgtgtttttggtggttgaggttgatgtggatgtgttgttgtttatttttatgtttttgtgtttttatttgttgggttgggtgatgttattgtatagtaaaatttttatggatgttttgagttgtagtattggggtttttaataagattatttttaatatgtgttttgttatgaagatatttatgattatttgttttggtattgtgttgttggtttttagtatttttttttggattattgtagtttggattgtgtgtgtttgtgagaggtgtgattgttg

SEQ ID NO: 15603 - DNA, 204 bp, synthetic construct
  misc_feature 1..204: note = Description of Artificial Sequence: Synthetic polynucleotide
  source 1..204: mol_type = other DNA
ttgttgttagtttagttgtttgttattttttttagtggtgtttttgttattaatgggttttttataattgatttggtttatgggttgtagatgttgtggattattggtgtggggaagtatgagtttattgatttggggtattttagaggtaagttttgttgttatgtgtttttttatgggtttgtgtttgtatttttttgtgtg

SEQ ID NO: 15604 - DNA, 444 bp, synthetic construct
  misc_feature 1..444: note = Description of Artificial Sequence: Synthetic polynucleotide
  source 1..444: mol_type = other DNA
ttggtttttgtgtagatggatgtgaggaatgttattgtttttttttttttttttgttgttggtgttatgtaggagttggttattttttgttggtagtgttgtgttttggggaatttgatgggtttttataggttggtgggggtggagataggggagatgaagaaggagggggtagtttgtttaggaggttaggggggtatttgtgtttggtttaggtttattgatgtagatattattgatatttatgtttgtgttgtgttttttgtggtgtttgtggttgttaatgttatttattgggtggtatatgttatgtgagtataggatttaggttatttttgtttgttttggtgtttggtggtagttgtttagaaattttttgggagaaagagtttttgggttgtttttttttttgtgtgttttgaagtgggatgatagttggttatg

SEQ ID NO: 15605 - DNA, 397 bp, synthetic construct
  misc_feature 1..397: note = Description of Artificial Sequence: Synthetic polynucleotide
  source 1..397: mol_type = other DNA
atgtgttttgtttattatgaggtttgtattttttgggtagtaggtgttgtgtgtttttgggtattttgtaggtggagttgttggtgtagtgtagtattttgtgtttttgatgttggttttggatttagttgttgttgtatttgttattgtttttgggggatatatgtatggagtttatttttaatagggggagttgggtggtggtagtgatttagattggttttttttattgggttttgtaggtattgtgggattgaggtaaaaataggtttgagtagatggttttaagagtttttgttttgttagggttagttgggggttgatgataggtggtggggatatgtttgtttatttttattttagatggtaggtttgtttgggatgtatttagtttttg

SEQ ID NO: 15606 - DNA, 1530 bp, synthetic construct
  misc_feature 1..1530: note = Description of Artificial Sequence: Synthetic polynucleotide
  source 1..1530: mol_type = other DNA
atgtatggaatttttgagtttggagaatgtgttggagttttgtgtttatgtttttatttatgtggttaaggattttttgattgttagatattagggtttgtaatttgtgagtgtggttggagattttgttttttgtttgggattttgtggagttttttttagttttttgggaggttgttttgggaggtttgtgttttgagttttgtgtttttttattttttaggtgtatttgttttttgtttattttaatgattatatttgttttatttatatggagatggataataagtgtttttattgtgagtttttgttgtatttggagaggtgggtgtgtggttgggttaatgtggggtggggtgggtggggtgggatttggttttgatgttttgttgtgttttaggtttgggttttataaatatatgaagatggataaggaggagggggatgaggatgaagaagatgaggtgtagtgttgagttttttttttttttaatttggatggtgagtgtttgtagtgtttttggtttgtatttatttgtgtagggagtttttaatttgtgttttttgtagattttttggatgatgaggatgagggggagttgtttgatagtttggagtttattgaggtggttttgtttaggagtggtttttagttttttgttttagtagtttttgtttagtttggagttatttttgttttgttgatttttttttgtttttgggatggggggatttttaggtatttttgggttttgagttgggttgttagggttgtttgttttttgttgttttttttgggttgagttttgtttttgtgttttgtagtggagtagttgtttttaaaggtgtatgtgattagggtgtggttgggatagtgggtatttttttgggttttagtgttgtgtgtgttttggttgtttttttttggtgtttttttgtattttaggtttttgtttagagtgtagttgtgggtgtttttatgtttattttggttttatggttgtaggattggtggtttttaggttatatagttgaggtttttagtttgggtgtaggttatttaagggggttgggagggttaggtgtgtatgttgggatttgtggtgtttatagtggatttaaatttgttttttgaagtgtggtttgtgattttttttttgagtttgttttaggtgtttgggttgtagttgtttggggagggtgaagaggaggaggaaggggaggatgatggggttttgggtgatgaggttgtgttggaggatagtgaggaggttgtgggtttggtgtttggatgttggtgtgaggatgttattgattggtagtgtatgtttagtgtgggtgttgtggattttgagttgttgtgtttggattggaatgatttgtgatgtaatgttttggggaatttgtagttgttggaggtggaggttgtggatgtgattgtttagtatatggagtggttgaatgtgtgttatggtgggtatgggggtggttgaatgtgtgttagggtggttttggaggtggggatagttg

SEQ ID NO: 15607 - DNA, 414 bp, synthetic construct
  misc_feature 1..414: note = Description of Artificial Sequence: Synthetic polynucleotide
  source 1..414: mol_type = other DNA
ygtgttagygttaggttggatttagygagtygtygatgttagygagatgttaggttggatttagtaagtygtygatgttagttagaygtagagtagagaaygttggttaaagagtagttaggyggtgtttgttyggtygaagtttagtttyggagaggtaggttttgtattaggaygtggaggtttyggggttatgaaatttttagggtgagagataaaggtagtgagtggtygtttagggtagaggggayggaggtagtaygyggayggagttttygtatagagygttayggttaygattggaaagtttagataygtgttaygagtttatagtttaggttagaggyggtaggatggygggyggttttatgtatagaattgyggttaygtgtggaaggygayggatattggygg

SEQ ID NO: 15608 - DNA, 987 bp, synthetic construct
  misc_feature 1..987: note = Description of Artificial Sequence: Synthetic polynucleotide
  source 1..987: mol_type = other DNA
ygaggagttygygtttttaggattggattgatttattttgaggttgaygatgggtayggttgygyggtyggtayggygtaygatgttgtataggttttgtaggygygaggataggaaggygyggaaggtgttygttagttttayggttygygtttgttggaagtattggaagtyggtttygyggatgtttygtatgtygtttgatagggggttgttgagygtaattaggtggagttgyggggagaggggygygttaygggttgtgttttaygttgttttttgtatttaggtttygggygtattatttyggtttygtatttgtgtggataggtayggtygaggggygttgagygggaggygygtaagtgatatattgaggggtttaggtagtagtttttataygttgttaggttagagtagtttygggttaygtgggtgtttttagttgtygttgtaggyggaggtaygtyggttttttaaggatgtgatagyggttggatttttatgattattgtttggttattagagggtaagttttagggttagttaagtygttttgagtggttttgagtygttagatttttatttatggtygaagtttgggatttttagtagttttgtaggggttgggtttttttttgttgtygagagtygaggggttagatggagttaagtttattttgggggggtatttattatyggttggaagtygyggtggttgtgggygggtgggtttgtgggtygygtyggtygtaggtgtaygtaggagttgtggtgyggggtttyggggtagggttggggttygggtaggygaggggggttggttaggatgttatttgttygttagggtygygyggtggggtgggggtgttttygtygygggtaggggttgttgtygtgtagttgtattayggggggttgtaaggyggttattttattgttttgtaggtgggagaygtggggtttgtyggyggggggatttttygg

SEQ ID NO: 15609 - DNA, 1061 bp, synthetic construct
  misc_feature 1..1061: note = Description of Artificial Sequence: Synthetic polynucleotide
  source 1..1061: mol_type = other DNA
yggggtagggggyggttgtygtaagggtgggattygygggtttygaggtttttttggtggtggagaygygtygaggtygtttttattttaagttttttttttaggtggtgagtyggttgggtttggattttttgtgtttttttagttttaaggagyggattatygagtgagtttttgttttttygttttttttttatttttttygggttttgtttttygggttttgyggggygttggggtttttgygtggagattyggttgagtttttttagygtttttttttgggygtttattyggtttgygttaagtyggggtttgggggttgaggggggtatagagatttyggtygggttttygtaggtttttagtygagtggttattttttygtgggtgtagaygggygtggggtttggggtygtttygggaggattgygttttttttattaatttyggttagattygttgagtygygtttattttgtaggtatttggtttttgagygygggtttgagygaggtttgggtagtaagtttttgygygttttygtgggggaggtgggtgttygttttgyggttttygggggyggttyggtggyggyggtygttgyggttatggtgagygyggggggaggggtaggggaggygtagttgttggggggagggyggggagggggaagggygttgttggggggagggtayggggtggggagggygyggtggggtygttttgggtggagaygtgggggttataygggtgggattttygtagggattattygggtttttggttttttttggggtyggtttygggtygtttggggtttttgygatttttatatttatttttttygtagggtgyggygttgggttttatggtgggttttatgatttaygggyggygttaattttagtttttggataygaygatgyggygtttgatttygttttttygygaggtttyggttaagttaattaygttggtggatgtygaygtygaggtttttatygtttatttggtgagtggyggttatagtagggtttttygggttttattaatagyga

SEQ ID NO: 15610 - DNA, 382 bp, synthetic construct
  misc_feature 1..382: note = Description of Artificial Sequence: Synthetic polynucleotide
  source 1..382: mol_type = other DNA
yggayggtaaataygygtgggtttttygtgtgtttgayggtaaagatgtatgggttttttgtgtgtyggatggtaaataggtttygtgtgggttttttgtgtgtyggatagtaaatataygtgggttttttttgtgtyggatagtaaatataygtgggttttttttgtgtyggatagtaaataygygtgggtttttttgtgtyggatagtaaataygygtgggttttttttgtgtyggatagtaaataygygtgggtttttttgtgttaaayggtaaataygygtgggtttttygtgtgtygaatagtaaataygygtgggttttttttgtgttygatagtaaataygygtgggtttttygtgtgtyggatgataaataygt

SEQ ID NO: 15611 - DNA, 261 bp, synthetic construct
  misc_feature 1..261: note = Description of Artificial Sequence: Synthetic polynucleotide
  source 1..261: mol_type = other DNA
ygtygattaggaggatyggtggygatttyggtttttagtgttttygatagagtgaaatggyggyggyggtygggatgatgttgttgggtttgttataggygggtgggtaggtgttgggttaggygatggaggaggtggtaggyggtaattttttgtttatgttgttgatygtttgygtttttatttttagtttggtttatttgtttygtttygttgtyggttatttggtttagttgatygtaggggygaaaagtttttygt

SEQ ID NO: 15612 - DNA, 892 bp, synthetic construct
  misc_feature 1..892: note = Description of Artificial Sequence: Synthetic polynucleotide
  source 1..892: mol_type = other DNA
ygyggggttgtttaagygttggyggaggtygggttgggtygttgtgygtttgtttttttttttygygttttttttgtygttttaattttgttttggttaygagggagtttgtgtttaygtagatygggtagtgygggaattagatyggygttaaggttggtagtyggggttttgagggtttagttygggtttgtygggtggtyggggaagatgttggtagyggygggggyggtgtttttgtattgyggtttttgggttttttgtyggggayggtggaatygggtggttggygaggyggygggggtggattttagggatagggyggtttggggatgggggtgyggatgggggtgggagagyggttggggygttttygtgatttagtttyggtttgtttggtttttttygttttygtagttttgggaggtgatttttgatgaatatgttatygatttygttggtatttattayggggatagttatttgtagttggagygtattaaygtgtattattaygaggttagyggtgygattttygttttttttttatygtttttttgggaaygyggtttttttttygtttatgttttttygttttaygtaggtggtaggtaygtgtttygygttgtgttygtggatttggagtygggtattatggattttgtgygttyggggtttttygggtaggtttttaggttagataattttatttttygtgagttgygggygaggattggggtgyggttttttagttagggtagttygaaatttaggaaygttttaaggttattttgtgggaattgtggygttagggtttttgaatatttttttgtttttygagtygagtygttttatttgttttttaaaygggtttygggaggaaggttygygt

SEQ ID NO: 15613 - DNA, 682 bp, synthetic construct
  misc_feature 1..682: note = Description of Artificial Sequence: Synthetic polynucleotide
  source 1..682: mol_type = other DNA
ygtttagtaggyggtattgygttttgaygtyggggatttagtatttagtygttttygttygtaggtgttttggttttgtttyggttttttttggtttgtgttttgattttgtttttygtygtttagaaygtygtagttagggyggtatataagtttygaggggyggggttygggggttttttttttattygtttttygtttttttttttgttggatttgaggygtygttttygtygygttgttttygygttatgttaygttaygttaygttaygttaygttaygtttttaygttaygtttaygttaygtttttatttttygtttatagggaaaygggtttyggygatgtgagggygtttgtygtgtttggtgtttttataggggagttttttgttttggtygyggttttaggttttgtgttgaygtagtaggagggttttygggtagtttaggtaggygayggggagtgaygagggttttttatagttatgggagtygagtttagagtaggyggtagtagygtttttgttatttttggtttaaaagtagtygtgtggggtttttgataggtgtttyggagygaattgttttttttggtttagtttttagggttttgttagggtttttgttgtttagaaggttyggggttyggttgaygattygttatatygtgggttttygg

SEQ ID NO: 15614 - DNA, 223 bp, synthetic construct
  misc_feature 1..223: note = Description of Artificial Sequence: Synthetic polynucleotide
  source 1..223: mol_type = other DNA
ygaaaaatagaggygttgggtgygaggyggagagatgtataggtttggtttyggtttygttttttgtttgttttaaagggtaaggttttttygtttygygtttygtttttgttttatttaggtttygttattatgttygggggttttattygggattggtttttgttttgygtagtaaattyggaagtggattaygtggagtaaaggttttatygaggygygt

SEQ ID NO: 15615 - DNA, 255 bp, synthetic construct
  misc_feature 1..255: note = Description of Artificial Sequence: Synthetic polynucleotide
  source 1..255: mol_type = other DNA
ygggaggtygggttyggtgtatgggggtygggtatattttttttgggtatttttaggataggygaggaaygtatyggtygggattttatttaygagtaggagggtaaggtgtagtttgtgattgatgyggtgtaygttattgtttaygttttttatagtatgtattaggygttttgttttgggtatataggtttgtgttyggygatggaatttattgatgggyggatgtttttgtagtatattygagttgttygt

SEQ ID NO: 15616 - DNA, 309 bp, synthetic construct
  misc_feature 1..309: note = Description of Artificial Sequence: Synthetic polynucleotide
  source 1..309: mol_type = other DNA
yggtaggtttgttgygttygttttagttagggtttagagtttttyggttagtttatygtatttggattttagatgggygygttgggtggtgttygygttagggaaagagttggyggttggttgagttgttgygtttttgagygttgtgttygttgtgattattggygtggttgtttttyggtaggttygaaggaatygttgtttttttgtaygttgayggttagygaggaggttatggyggtgttggaggaggtggtgttgtaygttttttagtagtgygtttattatgtttttaaggtgtayggaygg

SEQ ID NO: 15617 - DNA, 992 bp, synthetic construct
  misc_feature 1..992: note = Description of Artificial Sequence: Synthetic polynucleotide
  source 1..992: mol_type = other DNA
ygtgtgttttttygggaaatygattttttttgggatgggttyggatatygaggggygggtttttgagagtygtyggggttttggtgtgggggtggttagggatatggagagttygtggygatagtattttagttaygttgttttagtaattagtgattagataygggaygtttttttygtgtgttgttygygttaygtttgttttgagyggagtttttgttttaggatagtttggtgtatgtgtttaatygggatyggtatayggtgggttagyggattttttttagtaagtttagtattagttttttagttttygatattttgtttttatattgtattattygtyggtaatygttttyggatagyggttaggtygyggggaggttggttttggagtttattttyggggygtatattttygttaattttttygaggtggggtataggatygtggtgttgtattayggggatttgttttttttggggttttattatttgttgttatttaaggatttygygtaggtttagtttttgttygttygggttttggygygttttygggttgtgtygtagagttgtyggttgtgyggggtygygttyggggttyggggagtygttttttttatttaggtygttttgtttyggygttagtagttgtttttggagtttgagttttatttggaggataygttgttgtagaggattatgaygttgatygagtyggggggygaygattataagttgattttygttttttttttgtgtttttgtatttagtattyggttatttatttttagtygggtatattygggtagtttttgtttaagatagttaggttgattygygagattgtttgggttagtgtgttggggtgggyggtttgggttttgtgtyggtttgggggaagagggggttyggagttggtttyggttgggaggygggagygtttttatttgatttttayggtgttgtgttgttgagygtagggygg

SEQ ID NO: 15618 - DNA, 265 bp, synthetic construct
  misc_feature 1..265: note = Description of Artificial Sequence: Synthetic polynucleotide
  source 1..265: mol_type = other DNA
yggggttgttygtgaataygttaagtataayggggttgttgatygtgaataygtygaataaaatagggttgttgttygtgaataygttaaataaaatggggttgttgttygtgaatatgtygaataaaattgggagttygaatttttttatgttaaataaagagtagggttygaattttttttttaggagggttagggttgyggtygggygaygttaggtggggaagatattagaagaggagaaaattaggagygtaggaygygg

SEQ ID NO: 15619 - DNA, 488 bp, synthetic construct
  misc_feature 1..488: note = Description of Artificial Sequence: Synthetic polynucleotide
  source 1..488: mol_type = other DNA
ygttygtgtttggygggagaggatayggttttttaggygygttgtagaagttgattggagaaggttygygattttgttgagggttaaagaggaatyggaaagggttyggggtagaygtgggygttatagggtgagtygggttaggttgagaggatttaygggttatgggagtttgtgggygayggttyggtaggggtttgyggygggaatagggataaaatatatttaataaattgtttatttagagtaagttgtgtgggtataatggygagaaaayggttagtaatggagaygttgtttygtagtygtttatttttttttttttaggygygtattggayggttgagygattgtgaggttttagtggggttggtgatagaattaaggygygtygaagygygyggtagtattttygttttagggygtttattagaggggtaaaagggtaaaagagagagttttttttttattaygttygttttygtygg

SEQ ID NO: 15620 - DNA, 676 bp, synthetic construct
  misc_feature 1..676: note = Description of Artificial Sequence: Synthetic polynucleotide
  source 1..676: mol_type = other DNA
ygtyggatgaattttgtttttttagaagaaagtygggttggtgtgttygatgaygtagygtttgtagtggygtttgataaagygtagggtttttayggagatttygtagttttggatatttagygtttggaggttaaagtagttggyggttaygatttgtaagttttggtyggtgatgttttygtaggatttgaggttgagtygtttgaggttgaagtagtttagggttaggtattttaggttygtgtyggatattaaagggtatttgtygatatttagggatttgagtttggtgtagtttttggygaggtattttatatygtggttygtgatgttttygtagtttttygygttgaggtagygtagtttgttgtagtatttggttaygtagyggatgtttaygtyggtgattyggtygtagtgygygatgtttaggtatygtaggygggattttagtttggygatttttygtaggtygaagtygttgaygaagyggtagtygttgaygtttagttttttgatggaggygtagtagattattaggtagygtaggttttygtyggttaggyggaygtagyggygtaggtagaggtgggtgagttgygtgtagtgygtygygatggtgtgtaggttttygttttttagtaygaagtagttygttatgtttaggtagygg

SEQ ID NO: 15621 - DNA, 1238 bp, synthetic construct
  misc_feature 1..1238: note = Description of Artificial Sequence: Synthetic polynucleotide
  source 1..1238: mol_type = other DNA
ygatagattatttaggtygtatagagygygtgtataaggtygtygttttttttgtgaygtaagattttattttttggatgttagyggtttggaagygtaaygttttttgggtaaygttattgtygtagtttygggtgggggagggatgattaaagataayggttgtaagagaattttataagagagttagaaygaaaatgtgtaataagtgyggyggtttttattatggtaggtgattygaggatttagtaygaggygagagtagggattaggaagagtyggaaaattygtttgtgattggtygtttaygggtatyggtygttgtgattgggtgaggtttagatagatagttgygttttgaatygygtagggttttgggtagtaaaggttttgtaaggtttttaatygaaagggggagggggaaggtygttaataaayggttgagtttataattttggtyggggygttttttttttttatggagagagttagattygagtygtygttttagtygygttygttgygtttygtttygttttygttgtyggtygagggtatttttttttgggtagtagttatggagtttttttygtygttttttatattgagygyggtagttagtgygattttggtttygtygtgyggggaggtagtggygttyggtttatagttygyggtgyggyggttgttgtaggtgaagttagagtaggtgttgttgttattatagttttaggtttagaaygaggaagtygttgtttygttygygtaggygyggttgttgtagtttaggttygatttgyggtttttgtagtygtygatagygttagayggygttatttttaggttygagttgtattyggtgtagtttttggygttgtatgttaaggttaagaagtagaagttggggtttagtttggattagttagtggggtttygaggggtygtygaaatyggttttagagtttttagggtggttaagttggaaggtttygggtyggttttyggttattttygaggggaygagaagggtaagttggaggyggaggaggttatgagagattygatgtaaggyggggtaggtaaaagttyggtagttattygagaaggtgtgattaaaayggaggaattygagagatttttygaggattgtaggttyggygyggagttygygtttaatggtttggtttatggtagygyggaggttattttggttttaaygttyggtgtttttgggtygt

SEQ ID NO: 15622 - DNA, 220 bp, synthetic construct
  misc_feature 1..220: note = Description of Artificial Sequence: Synthetic polynucleotide
  source 1..220: mol_type = other DNA
ygggataggttgggygtyggtatttagtggtygtaggggttgtygtgtgttttgtagatggataygygttatttaatatagagatgygttgagttygggtgattagtgaatygtaygttatygtagatattagaaagygaaagtataygggggaaggtttygggtatagatttagtayggttattattygagttggagttgtttgygagaygatgagygt

SEQ ID NO: 15623 - DNA, 631 bp, synthetic construct
  misc_feature 1..631: note = Description of Artificial Sequence: Synthetic polynucleotide
  source 1..631: mol_type = other DNA
yggtattttaagtaygygagtttgygtaggaggygtttygtttttyggagttttttattgttttttagatatagtttyggttttttatttygggyggaggtttttttagaygggtttygattgtttttgtatgtttattgttgtygtgttagaagttattgtttttttttygtttttttttaaatgtgttttgttttaggttygtgttatgttgttttttgtgtygttttygttygtttttttatttttygttattagaatygggaaggyggtgttttttttttaggtttaattttyggtattgaatttttaggagttygtagtttttttygttygggttttttttygttggtttagatygtagggttagtagtttygtttatayggaagtttygtttattaggtygatttygttttttttgtttyggtttygttttygttttggtttygttttttygttggtagtyggtaggygtagtyggggtygtgggatttaggaggggtttttagtaggtgttttggygaagattttggattgygttatagtttagggtagtygtttygyggttyggttttggagttttttayggatattyggggttttgtttttttygaaattattttttatygt

SEQ ID NO: 15624 - DNA, 904 bp, synthetic construct
  misc_feature 1..904: note = Description of Artificial Sequence: Synthetic polynucleotide
  source 1..904: mol_type = other DNA
yggtagaagattygttttttttygtttgaaaggtgtygtttagttggtagygtaatggtaggagttygggttaygygagygyggggtggatgttggaggggaaggtygggagttggtttygtggaaaaggtttttgygtgtttyggaatatgttgttgggtyggtggatttygttgtttatttttgtggatgaaatatgtatgttatattatataagggattaggtggaagaatgaataggttggtttaagtataygttttggttggtgttyggagagtgggtatttttttttgttatattgaggagttgtttttttagayggaygtgatatgattttttyggttttttattgttatagygygagaggygggggtttgagattygaygttgtttaggttatagtagygggyggygtgtyggtaggtgygygtttgttagattyggygtgagtgtagtttaataaygaatttgtaggttgtttgtygttatgtaygtggttatygttttagttttgtttttttttaggtttygggatgttyggggtgaatggggaggyggtygttttaagggaggatttaggtagygtyggtttttygtttggggtttttttttagattttygtttgaaygagtgggatagtttttgttttttagygygtttttaggtttygggatggttattgtttaggaggygtttggttttgtttattygttygttttgtttattttttgagaatttygygatttygaaatttttttgatttttttgtyggaagtaatttgttttaygtgaaattaygggttatttttttatatttgtagagygttttattttttgtaaygtttatttgygaaattgttgygttaggttaggagtattttaagagygagaggtagaygtygt

SEQ ID NO: 15625 - DNA, 519 bp, synthetic construct
  misc_feature 1..519: note = Description of Artificial Sequence: Synthetic polynucleotide
  source 1..519: mol_type = other DNA
yggyggtygtatttttygtagaygygtayggtttaggttgygatgatttaggaggagatgttgaagattagtagtayggtgtyggggtagatggttatgagtgtttttatgaygaagygygtgttgaaggtgattttgttgagggtttygatgttgyggttygaggygttygtgaagattttgttgtgtagtagtattattyggtttagtaggtagaggygtaggaatatggggatggatagtagtaygtttaygtyggtttyggttatygagggygygtaygtgaaggttagtygygtygtttaygtgaagyggtagtggtygggtatygggtgaatggygtatattgttagttttagygagatgaggaataygygttygtaggttatggygatgygttagttattagtttygttgtttattatgaatagttgtggagggygggagggaattagttatgggtgttagataygygtygygttttttgtttagttttatygygtttttagagagtgaygt

SEQ ID NO: 15626 - DNA, 204 bp, synthetic construct
  misc_feature 1..204: note = Description of Artificial Sequence: Synthetic polynucleotide
  source 1..204: mol_type = other DNA
ygygtagggaggtgtagaygtaggttygtggggaggtaygtggtagtaggatttatttttggggtgtttygggtyggtgaatttatatttttttaygttaatggttygtagtatttgtagttygtgggtygagtyggttgtggggggtttattggtggtaggggtattattggggagagtggyggayggttgggttggyggygg

SEQ ID NO: 15627 - DNA, 444 bp, synthetic construct
  misc_feature 1..444: note = Description of Artificial Sequence: Synthetic polynucleotide
  source 1..444: mol_type = other DNA
ygtggtygattgttattttatttygaaataygtagaggggaaggtagttygagggtttttttttttaggaagtttttgggtagttgtygtygggygttaggataagygagggtggtttgagttttgtgtttatatggygtatgtygtttagtagatgatattgayggtygtaaaygtygtagggaatatagygygggygtaaatgttaatggtgtttgygtygatgggtttgagtygggtayggatgtttttttggttttttgagygggttgtttttttttttttygttttttttgtttttatttttatygatttgtaggagtttattaggtttttygggaygyggygttgtyggygggagatggttagtttttgygtgaygtyggtagtagagagggagaagaggataatggygttttttaygtttatttgtaygaaggtygg

SEQ ID NO: 15628 - DNA, 397 bp, synthetic construct
  misc_feature 1..397: note = Description of Artificial Sequence: Synthetic polynucleotide
  source 1..397: mol_type = other DNA
yggaagttgagtgygtttygagtaggtttattatttagggtgggggtgggyggaygtgtttttatygtttgtygtyggtttttagttggttttggygaggtaggagtttttggggttatttgttygggtttatttttgtttyggtttygtagtgtttgyggagttyggtgggaggagtyggtttgagttattgttattattyggttttttttgttgagagtggatttygtgygtgtgttttttaggaayggtgataagtaygayggygattgggttygggatyggygttagggatayggggtgttgygttgygtygayggttttatttataaggtattygggggygygyggtatttgttgtttagagggtataggtttygtggtgggtagggygygt

SEQ ID NO: 15629 - DNA, 1530 bp, synthetic construct
  misc_feature 1..1530: note = Description of Artificial Sequence: Synthetic polynucleotide
  source 1..1530: mol_type = other DNA
yggttgttttygtttttaaaatygttttggygygygttyggtygtttttatattygtygtggygygygtttagtygttttatgtattgagyggttaygtttayggttttygttttyggtagttgtaggtttttygaaaygttgtatygtaggtygttttagttygagygtagtagttygaagtttayggygtttaygttgaaygtgygttgttagtygatggygtttttaygttagygttygagygtygggttygyggttttttygttgtttttygaygyggtttygtygttyggggttttatygttttttttttttttttttttttygttttttttgggtagttgyggttyggatatttgggataagtttaggaaggaggttaygggtygygtttyggaggataagtttgagtttattgtgggygtygtaggttttagygtgygygtttggttttttyggtttttttgggtggtttgygttygggttgggggtttyggttgtgtggtttgggggtygtyggttttgyggtygtggggtyggggtgggygtgggggygttygtagttgtattttgggtagaggtttggggtgtaggaagaygttagggaagggyggttagggygtaygyggygttggggttyggggggatgttygttgtttyggtygtattttggttaygtatatttttgggggyggttgttttattgtagggygygggggyggagttyggtttaagaagagyggtaaagggygggyggttttggyggtttagtttagggttygggagtgtttgggggttttttygtttygggggyggggaggggtyggyggggygagggtggtttygggttgggygggggttgttggggygggggattgggggtygtttttgggyggggtygtttyggtgggttttaggttgtygagtagttttttttygttttygtygtttaggaagtttgygggaaaygygggttagaagttttttgygtaggtgggtgygggttaggggygttgyggatatttatygttygggttgaggaagaggaaggttyggygttgtatttygttttttttatttttattttttttttttttgtttatttttatgtatttatagaatttaaatttggggygyggyggggtattagagtygagtttygtttygtttatttygtttygtattagttyggtygygygtttatttttttagatatagyggagattygyggtagaagtatttgttgttygtttttatgtgggtgaggygagtgtagtygttgggataaaygaaggataggtatatttggggggtgggggggygtagggtttagggygyggatttttyggggyggttttttaaggggttggagaaggtttygyggagtttyggaygggagayggggtttttagtygtatttataaattgtaggttttggtatttggygatygggaagtttttgattaygtaggtgggggygtaggygtagggttttagtaygttttttaggttygaagattttatgygt

SEQ ID NO: 15630 - DNA, 414 bp, synthetic construct
  misc_feature 1..414: note = Description of Artificial Sequence: Synthetic polynucleotide
  source 1..414: mol_type = other DNA
tgtgttagtgttaggttggatttagtgagttgttgatgttagtgagatgttaggttggatttagtaagttgttgatgttagttagatgtagagtagagaatgttggttaaagagtagttaggtggtgtttgtttggttgaagtttagttttggagaggtaggttttgtattaggatgtggaggttttggggttatgaaatttttagggtgagagataaaggtagtgagtggttgtttagggtagaggggatggaggtagtatgtggatggagtttttgtatagagtgttatggttatgattggaaagtttagatatgtgttatgagtttatagtttaggttagaggtggtaggatggtgggtggttttatgtatagaattgtggttatgtgtggaaggtgatggatattggtgg

SEQ ID NO: 15631 - DNA, 987 bp, synthetic construct
  misc_feature 1..987: note = Description of Artificial Sequence: Synthetic polynucleotide
  source 1..987: mol_type = other DNA
tgaggagtttgtgtttttaggattggattgatttattttgaggttgatgatgggtatggttgtgtggttggtatggtgtatgatgttgtataggttttgtaggtgtgaggataggaaggtgtggaaggtgtttgttagttttatggtttgtgtttgttggaagtattggaagttggttttgtggatgttttgtatgttgtttgatagggggttgttgagtgtaattaggtggagttgtggggagaggggtgtgttatgggttgtgttttatgttgttttttgtatttaggttttgggtgtattattttggttttgtatttgtgtggataggtatggttgaggggtgttgagtgggaggtgtgtaagtgatatattgaggggtttaggtagtagtttttatatgttgttaggttagagtagttttgggttatgtgggtgtttttagttgttgttgtaggtggaggtatgttggttttttaaggatgtgatagtggttggatttttatgattattgtttggttattagagggtaagttttagggttagttaagttgttttgagtggttttgagttgttagatttttatttatggttgaagtttgggatttttagtagttttgtaggggttgggtttttttttgttgttgagagttgaggggttagatggagttaagtttattttgggggggtatttattattggttggaagttgtggtggttgtgggtgggtgggtttgtgggttgtgttggttgtaggtgtatgtaggagttgtggtgtggggttttggggtagggttggggtttgggtaggtgaggggggttggttaggatgttatttgtttgttagggttgtgtggtggggtgggggtgtttttgttgtgggtaggggttgttgttgtgtagttgtattatggggggttgtaaggtggttattttattgttttgtaggtgggagatgtggggtttgttggtggggggattttttgg

SEQ ID NO: 15632 - DNA, 1061 bp, synthetic construct
  misc_feature 1..1061: note = Description of Artificial Sequence: Synthetic polynucleotide
  source 1..1061: mol_type = other DNA
tggggtagggggtggttgttgtaagggtgggatttgtgggttttgaggtttttttggtggtggagatgtgttgaggttgtttttattttaagttttttttttaggtggtgagttggttgggtttggattttttgtgtttttttagttttaaggagtggattattgagtgagtttttgtttttttgttttttttttattttttttgggttttgttttttgggttttgtggggtgttggggtttttgtgtggagatttggttgagtttttttagtgtttttttttgggtgtttatttggtttgtgttaagttggggtttgggggttgaggggggtatagagattttggttgggtttttgtaggtttttagttgagtggttatttttttgtgggtgtagatgggtgtggggtttggggttgttttgggaggattgtgttttttttattaattttggttagatttgttgagttgtgtttattttgtaggtatttggtttttgagtgtgggtttgagtgaggtttgggtagtaagtttttgtgtgtttttgtgggggaggtgggtgtttgttttgtggtttttgggggtggtttggtggtggtggttgttgtggttatggtgagtgtggggggaggggtaggggaggtgtagttgttggggggagggtggggagggggaagggtgttgttggggggagggtatggggtggggagggtgtggtggggttgttttgggtggagatgtgggggttatatgggtgggatttttgtagggattatttgggtttttggttttttttggggttggttttgggttgtttggggtttttgtgatttttatatttattttttttgtagggtgtggtgttgggttttatggtgggttttatgatttatgggtggtgttaattttagtttttggatatgatgatgtggtgtttgattttgtttttttgtgaggttttggttaagttaattatgttggtggatgttgatgttgaggtttttattgtttatttggtgagtggtggttatagtagggttttttgggttttattaatagtga

SEQ ID NO: 15633 - DNA, 382 bp, synthetic construct
  misc_feature 1..382: note = Description of Artificial Sequence: Synthetic polynucleotide
  source 1..382: mol_type = other DNA
tggatggtaaatatgtgtgggttttttgtgtgtttgatggtaaagatgtatgggttttttgtgtgttggatggtaaataggttttgtgtgggttttttgtgtgttggatagtaaatatatgtgggttttttttgtgttggatagtaaatatatgtgggttttttttgtgttggatagtaaatatgtgtgggtttttttgtgttggatagtaaatatgtgtgggttttttttgtgttggatagtaaatatgtgtgggtttttttgtgttaaatggtaaatatgtgtgggttttttgtgtgttgaatagtaaatatgtgtgggttttttttgtgtttgatagtaaatatgtgtgggttttttgtgtgttggatgataaatatgt

SEQ ID NO: 15634 - DNA, 261 bp, synthetic construct
  misc_feature 1..261: note = Description of Artificial Sequence: Synthetic polynucleotide
  source 1..261: mol_type = other DNA
tgttgattaggaggattggtggtgattttggtttttagtgtttttgatagagtgaaatggtggtggtggttgggatgatgttgttgggtttgttataggtgggtgggtaggtgttgggttaggtgatggaggaggtggtaggtggtaattttttgtttatgttgttgattgtttgtgtttttatttttagtttggtttatttgttttgttttgttgttggttatttggtttagttgattgtaggggtgaaaagttttttgt

SEQ ID NO: 15635 - DNA, 892 bp, synthetic construct
  misc_feature 1..892: note = Description of Artificial Sequence: Synthetic polynucleotide
  source 1..892: mol_type = other DNA
tgtggggttgtttaagtgttggtggaggttgggttgggttgttgtgtgtttgttttttttttttgtgttttttttgttgttttaattttgttttggttatgagggagtttgtgtttatgtagattgggtagtgtgggaattagattggtgttaaggttggtagttggggttttgagggtttagtttgggtttgttgggtggttggggaagatgttggtagtggtgggggtggtgtttttgtattgtggtttttgggttttttgttggggatggtggaattgggtggttggtgaggtggtgggggtggattttagggatagggtggtttggggatgggggtgtggatgggggtgggagagtggttggggtgtttttgtgatttagttttggtttgtttggttttttttgtttttgtagttttgggaggtgatttttgatgaatatgttattgattttgttggtatttattatggggatagttatttgtagttggagtgtattaatgtgtattattatgaggttagtggtgtgatttttgttttttttttattgtttttttgggaatgtggttttttttttgtttatgtttttttgttttatgtaggtggtaggtatgtgttttgtgttgtgtttgtggatttggagttgggtattatggattttgtgtgtttggggttttttgggtaggtttttaggttagataattttattttttgtgagttgtgggtgaggattggggtgtggttttttagttagggtagtttgaaatttaggaatgttttaaggttattttgtgggaattgtggtgttagggtttttgaatatttttttgttttttgagttgagttgttttatttgttttttaaatgggttttgggaggaaggtttgtgt

SEQ ID NO: 15636 - DNA, 682 bp, synthetic construct
  misc_feature 1..682: note = Description of Artificial Sequence: Synthetic polynucleotide
  source 1..682: mol_type = other DNA
tgtttagtaggtggtattgtgttttgatgttggggatttagtatttagttgtttttgtttgtaggtgttttggttttgttttggttttttttggtttgtgttttgattttgttttttgttgtttagaatgttgtagttagggtggtatataagttttgaggggtggggtttgggggttttttttttatttgttttttgtttttttttttgttggatttgaggtgttgtttttgttgtgttgtttttgtgttatgttatgttatgttatgttatgttatgttatgtttttatgttatgtttatgttatgtttttattttttgtttatagggaaatgggttttggtgatgtgagggtgtttgttgtgtttggtgtttttataggggagttttttgttttggttgtggttttaggttttgtgttgatgtagtaggagggtttttgggtagtttaggtaggtgatggggagtgatgagggttttttatagttatgggagttgagtttagagtaggtggtagtagtgtttttgttatttttggtttaaaagtagttgtgtggggtttttgataggtgttttggagtgaattgttttttttggtttagtttttagggttttgttagggtttttgttgtttagaaggtttggggtttggttgatgatttgttatattgtgggtttttgg

SEQ ID NO: 15637 - DNA, 223 bp, synthetic construct
  misc_feature 1..223: note = Description of Artificial Sequence: Synthetic polynucleotide
  source 1..223: mol_type = other DNA
tgaaaaatagaggtgttgggtgtgaggtggagagatgtataggtttggttttggttttgttttttgtttgttttaaagggtaaggtttttttgttttgtgttttgtttttgttttatttaggttttgttattatgtttgggggttttatttgggattggtttttgttttgtgtagtaaatttggaagtggattatgtggagtaaaggttttattgaggtgtgt

SEQ ID NO: 15638 - DNA, 255 bp, synthetic construct
  misc_feature 1..255: note = Description of Artificial Sequence: Synthetic polynucleotide
  source 1..255: mol_type = other DNA
tgggaggttgggtttggtgtatgggggttgggtatattttttttgggtatttttaggataggtgaggaatgtattggttgggattttatttatgagtaggagggtaaggtgtagtttgtgattgatgtggtgtatgttattgtttatgttttttatagtatgtattaggtgttttgttttgggtatataggtttgtgtttggtgatggaatttattgatgggtggatgtttttgtagtatatttgagttgtttgt

SEQ ID NO: 15639 - DNA, 309 bp, synthetic construct
  misc_feature 1..309: note = Description of Artificial Sequence: Synthetic polynucleotide
  source 1..309: mol_type = other DNA
tggtaggtttgttgtgtttgttttagttagggtttagagttttttggttagtttattgtatttggattttagatgggtgtgttgggtggtgtttgtgttagggaaagagttggtggttggttgagttgttgtgtttttgagtgttgtgtttgttgtgattattggtgtggttgttttttggtaggtttgaaggaattgttgtttttttgtatgttgatggttagtgaggaggttatggtggtgttggaggaggtggtgttgtatgttttttagtagtgtgtttattatgtttttaaggtgtatggatgg

SEQ ID NO: 15640 - DNA, 992 bp, synthetic construct
  misc_feature 1..992: note = Description of Artificial Sequence: Synthetic polynucleotide
  source 1..992: mol_type = other DNA
tgtgtgtttttttgggaaattgattttttttgggatgggtttggatattgaggggtgggtttttgagagttgttggggttttggtgtgggggtggttagggatatggagagtttgtggtgatagtattttagttatgttgttttagtaattagtgattagatatgggatgttttttttgtgtgttgtttgtgttatgtttgttttgagtggagtttttgttttaggatagtttggtgtatgtgtttaattgggattggtatatggtgggttagtggattttttttagtaagtttagtattagttttttagtttttgatattttgtttttatattgtattatttgttggtaattgtttttggatagtggttaggttgtggggaggttggttttggagtttatttttggggtgtatatttttgttaatttttttgaggtggggtataggattgtggtgttgtattatggggatttgttttttttggggttttattatttgttgttatttaaggattttgtgtaggtttagtttttgtttgtttgggttttggtgtgtttttgggttgtgttgtagagttgttggttgtgtggggttgtgtttggggtttggggagttgttttttttatttaggttgttttgttttggtgttagtagttgtttttggagtttgagttttatttggaggatatgttgttgtagaggattatgatgttgattgagttggggggtgatgattataagttgatttttgttttttttttgtgtttttgtatttagtatttggttatttatttttagttgggtatatttgggtagtttttgtttaagatagttaggttgatttgtgagattgtttgggttagtgtgttggggtgggtggtttgggttttgtgttggtttgggggaagagggggtttggagttggttttggttgggaggtgggagtgtttttatttgatttttatggtgttgtgttgttgagtgtagggtgg

SEQ ID NO: 15641 - DNA, 265 bp, synthetic construct
  misc_feature 1..265: note = Description of Artificial Sequence: Synthetic polynucleotide
  source 1..265: mol_type = other DNA
tggggttgtttgtgaatatgttaagtataatggggttgttgattgtgaatatgttgaataaaatagggttgttgtttgtgaatatgttaaataaaatggggttgttgtttgtgaatatgttgaataaaattgggagtttgaatttttttatgttaaataaagagtagggtttgaattttttttttaggagggttagggttgtggttgggtgatgttaggtggggaagatattagaagaggagaaaattaggagtgtaggatgtgg

SEQ ID NO: 15642 - DNA, 488 bp, synthetic construct
  misc_feature 1..488: note = Description of Artificial Sequence: Synthetic polynucleotide
  source 1..488: mol_type = other DNA
tgtttgtgtttggtgggagaggatatggttttttaggtgtgttgtagaagttgattggagaaggtttgtgattttgttgagggttaaagaggaattggaaagggtttggggtagatgtgggtgttatagggtgagttgggttaggttgagaggatttatgggttatgggagtttgtgggtgatggtttggtaggggtttgtggtgggaatagggataaaatatatttaataaattgtttatttagagtaagttgtgtgggtataatggtgagaaaatggttagtaatggagatgttgttttgtagttgtttatttttttttttttaggtgtgtattggatggttgagtgattgtgaggttttagtggggttggtgatagaattaaggtgtgttgaagtgtgtggtagtatttttgttttagggtgtttattagaggggtaaaagggtaaaagagagagttttttttttattatgtttgtttttgttgg

SEQ ID NO: 15643 - DNA, 676 bp, synthetic construct
  misc_feature 1..676: note = Description of Artificial Sequence: Synthetic polynucleotide
  source 1..676: mol_type = other DNA
tgttggatgaattttgtttttttagaagaaagttgggttggtgtgtttgatgatgtagtgtttgtagtggtgtttgataaagtgtagggtttttatggagattttgtagttttggatatttagtgtttggaggttaaagtagttggtggttatgatttgtaagttttggttggtgatgtttttgtaggatttgaggttgagttgtttgaggttgaagtagtttagggttaggtattttaggtttgtgttggatattaaagggtatttgttgatatttagggatttgagtttggtgtagtttttggtgaggtattttatattgtggtttgtgatgtttttgtagttttttgtgttgaggtagtgtagtttgttgtagtatttggttatgtagtggatgtttatgttggtgatttggttgtagtgtgtgatgtttaggtattgtaggtgggattttagtttggtgattttttgtaggttgaagttgttgatgaagtggtagttgttgatgtttagttttttgatggaggtgtagtagattattaggtagtgtaggtttttgttggttaggtggatgtagtggtgtaggtagaggtgggtgagttgtgtgtagtgtgttgtgatggtgtgtaggtttttgttttttagtatgaagtagtttgttatgtttaggtagtgg

SEQ ID NO: 15644 - DNA, 1238 bp, synthetic construct
  misc_feature 1..1238: note = Description of Artificial Sequence: Synthetic polynucleotide
  source 1..1238: mol_type = other DNA
tgatagattatttaggttgtatagagtgtgtgtataaggttgttgttttttttgtgatgtaagattttattttttggatgttagtggtttggaagtgtaatgttttttgggtaatgttattgttgtagttttgggtgggggagggatgattaaagataatggttgtaagagaattttataagagagttagaatgaaaatgtgtaataagtgtggtggtttttattatggtaggtgatttgaggatttagtatgaggtgagagtagggattaggaagagttggaaaatttgtttgtgattggttgtttatgggtattggttgttgtgattgggtgaggtttagatagatagttgtgttttgaattgtgtagggttttgggtagtaaaggttttgtaaggtttttaattgaaagggggagggggaaggttgttaataaatggttgagtttataattttggttggggtgttttttttttttatggagagagttagatttgagttgttgttttagttgtgtttgttgtgttttgttttgtttttgttgttggttgagggtatttttttttgggtagtagttatggagttttttttgttgttttttatattgagtgtggtagttagtgtgattttggttttgttgtgtggggaggtagtggtgtttggtttatagtttgtggtgtggtggttgttgtaggtgaagttagagtaggtgttgttgttattatagttttaggtttagaatgaggaagttgttgttttgtttgtgtaggtgtggttgttgtagtttaggtttgatttgtggtttttgtagttgttgatagtgttagatggtgttatttttaggtttgagttgtatttggtgtagtttttggtgttgtatgttaaggttaagaagtagaagttggggtttagtttggattagttagtggggttttgaggggttgttgaaattggttttagagtttttagggtggttaagttggaaggttttgggttggtttttggttatttttgaggggatgagaagggtaagttggaggtggaggaggttatgagagatttgatgtaaggtggggtaggtaaaagtttggtagttatttgagaaggtgtgattaaaatggaggaatttgagagattttttgaggattgtaggtttggtgtggagtttgtgtttaatggtttggtttatggtagtgtggaggttattttggttttaatgtttggtgtttttgggttgt

SEQ ID NO: 15645 - DNA, 220 bp, synthetic construct
  misc_feature 1..220: note = Description of Artificial Sequence: Synthetic polynucleotide
  source 1..220: mol_type = other DNA
tgggataggttgggtgttggtatttagtggttgtaggggttgttgtgtgttttgtagatggatatgtgttatttaatatagagatgtgttgagtttgggtgattagtgaattgtatgttattgtagatattagaaagtgaaagtatatgggggaaggttttgggtatagatttagtatggttattatttgagttggagttgtttgtgagatgatgagtgt

SEQ ID NO: 15646 - DNA, 631 bp, synthetic construct
  misc_feature 1..631: note = Description of Artificial Sequence: Synthetic polynucleotide
  source 1..631: mol_type = other DNA
tggtattttaagtatgtgagtttgtgtaggaggtgttttgttttttggagttttttattgttttttagatatagttttggttttttattttgggtggaggtttttttagatgggttttgattgtttttgtatgtttattgttgttgtgttagaagttattgttttttttttgtttttttttaaatgtgttttgttttaggtttgtgttatgttgttttttgtgttgtttttgtttgtttttttattttttgttattagaattgggaaggtggtgttttttttttaggtttaatttttggtattgaatttttaggagtttgtagttttttttgtttgggtttttttttgttggtttagattgtagggttagtagttttgtttatatggaagttttgtttattaggttgattttgttttttttgttttggttttgtttttgttttggttttgtttttttgttggtagttggtaggtgtagttggggttgtgggatttaggaggggtttttagtaggtgttttggtgaagattttggattgtgttatagtttagggtagttgttttgtggtttggttttggagttttttatggatatttggggttttgttttttttgaaattattttttattgt

SEQ ID NO: 15647 - DNA, 904 bp, synthetic construct
  misc_feature 1..904: note = Description of Artificial Sequence: Synthetic polynucleotide
  source 1..904: mol_type = other DNA
tggtagaagatttgtttttttttgtttgaaaggtgttgtttagttggtagtgtaatggtaggagtttgggttatgtgagtgtggggtggatgttggaggggaaggttgggagttggttttgtggaaaaggtttttgtgtgttttggaatatgttgttgggttggtggattttgttgtttatttttgtggatgaaatatgtatgttatattatataagggattaggtggaagaatgaataggttggtttaagtatatgttttggttggtgtttggagagtgggtatttttttttgttatattgaggagttgtttttttagatggatgtgatatgatttttttggttttttattgttatagtgtgagaggtgggggtttgagatttgatgttgtttaggttatagtagtgggtggtgtgttggtaggtgtgtgtttgttagatttggtgtgagtgtagtttaataatgaatttgtaggttgtttgttgttatgtatgtggttattgttttagttttgtttttttttaggttttgggatgtttggggtgaatggggaggtggttgttttaagggaggatttaggtagtgttggttttttgtttggggtttttttttagatttttgtttgaatgagtgggatagtttttgttttttagtgtgtttttaggttttgggatggttattgtttaggaggtgtttggttttgtttatttgtttgttttgtttattttttgagaattttgtgattttgaaatttttttgatttttttgttggaagtaatttgttttatgtgaaattatgggttatttttttatatttgtagagtgttttattttttgtaatgtttatttgtgaaattgttgtgttaggttaggagtattttaagagtgagaggtagatgttgt

SEQ ID NO: 15648 - DNA, 519 bp, synthetic construct
  misc_feature 1..519: note = Description of Artificial Sequence: Synthetic polynucleotide
  source 1..519: mol_type = other DNA
tggtggttgtattttttgtagatgtgtatggtttaggttgtgatgatttaggaggagatgttgaagattagtagtatggtgttggggtagatggttatgagtgtttttatgatgaagtgtgtgttgaaggtgattttgttgagggttttgatgttgtggtttgaggtgtttgtgaagattttgttgtgtagtagtattatttggtttagtaggtagaggtgtaggaatatggggatggatagtagtatgtttatgttggttttggttattgagggtgtgtatgtgaaggttagttgtgttgtttatgtgaagtggtagtggttgggtattgggtgaatggtgtatattgttagttttagtgagatgaggaatatgtgtttgtaggttatggtgatgtgttagttattagttttgttgtttattatgaatagttgtggagggtgggagggaattagttatgggtgttagatatgtgttgtgttttttgtttagttttattgtgtttttagagagtgatgt

SEQ ID NO: 15649 - DNA, 204 bp, synthetic construct
  misc_feature 1..204: note = Description of Artificial Sequence: Synthetic polynucleotide
  source 1..204: mol_type = other DNA
tgtgtagggaggtgtagatgtaggtttgtggggaggtatgtggtagtaggatttatttttggggtgttttgggttggtgaatttatatttttttatgttaatggtttgtagtatttgtagtttgtgggttgagttggttgtggggggtttattggtggtaggggtattattggggagagtggtggatggttgggttggtggtgg

SEQ ID NO: 15650 - DNA, 444 bp, synthetic construct
  misc_feature 1..444: note = Description of Artificial Sequence: Synthetic polynucleotide
  source 1..444: mol_type = other DNA
tgtggttgattgttattttattttgaaatatgtagaggggaaggtagtttgagggtttttttttttaggaagtttttgggtagttgttgttgggtgttaggataagtgagggtggtttgagttttgtgtttatatggtgtatgttgtttagtagatgatattgatggttgtaaatgttgtagggaatatagtgtgggtgtaaatgttaatggtgtttgtgttgatgggtttgagttgggtatggatgtttttttggttttttgagtgggttgttttttttttttttgttttttttgtttttatttttattgatttgtaggagtttattaggttttttgggatgtggtgttgttggtgggagatggttagtttttgtgtgatgttggtagtagagagggagaagaggataatggtgttttttatgtttatttgtatgaaggttgg

SEQ ID NO: 15651 - DNA, 397 bp, synthetic construct
  misc_feature 1..397: note = Description of Artificial Sequence: Synthetic polynucleotide
  source 1..397: mol_type = other DNA
tggaagttgagtgtgttttgagtaggtttattatttagggtgggggtgggtggatgtgtttttattgtttgttgttggtttttagttggttttggtgaggtaggagtttttggggttatttgtttgggtttatttttgttttggttttgtagtgtttgtggagtttggtgggaggagttggtttgagttattgttattatttggttttttttgttgagagtggattttgtgtgtgtgttttttaggaatggtgataagtatgatggtgattgggtttgggattggtgttagggatatggggtgttgtgttgtgttgatggttttatttataaggtatttgggggtgtgtggtatttgttgtttagagggtataggttttgtggtgggtagggtgtgt

SEQ ID NO: 15652 - DNA, 1530 bp, synthetic construct
  misc_feature 1..1530: note = Description of Artificial Sequence: Synthetic polynucleotide
  source 1..1530: mol_type = other DNA
tggttgtttttgtttttaaaattgttttggtgtgtgtttggttgtttttatatttgttgtggtgtgtgtttagttgttttatgtattgagtggttatgtttatggtttttgtttttggtagttgtaggttttttgaaatgttgtattgtaggttgttttagtttgagtgtagtagtttgaagtttatggtgtttatgttgaatgtgtgttgttagttgatggtgtttttatgttagtgtttgagtgttgggtttgtggtttttttgttgttttttgatgtggttttgttgtttggggttttattgtttttttttttttttttttttttgttttttttgggtagttgtggtttggatatttgggataagtttaggaaggaggttatgggttgtgttttggaggataagtttgagtttattgtgggtgttgtaggttttagtgtgtgtgtttggtttttttggtttttttgggtggtttgtgtttgggttgggggttttggttgtgtggtttgggggttgttggttttgtggttgtggggttggggtgggtgtgggggtgtttgtagttgtattttgggtagaggtttggggtgtaggaagatgttagggaagggtggttagggtgtatgtggtgttggggtttggggggatgtttgttgttttggttgtattttggttatgtatatttttgggggtggttgttttattgtagggtgtgggggtggagtttggtttaagaagagtggtaaagggtgggtggttttggtggtttagtttagggtttgggagtgtttgggggtttttttgttttgggggtggggaggggttggtggggtgagggtggttttgggttgggtgggggttgttggggtgggggattgggggttgtttttgggtggggttgttttggtgggttttaggttgttgagtagtttttttttgtttttgttgtttaggaagtttgtgggaaatgtgggttagaagttttttgtgtaggtgggtgtgggttaggggtgttgtggatatttattgtttgggttgaggaagaggaaggtttggtgttgtattttgttttttttatttttattttttttttttttgtttatttttatgtatttatagaatttaaatttggggtgtggtggggtattagagttgagttttgttttgtttattttgttttgtattagtttggttgtgtgtttatttttttagatatagtggagatttgtggtagaagtatttgttgtttgtttttatgtgggtgaggtgagtgtagttgttgggataaatgaaggataggtatatttggggggtgggggggtgtagggtttagggtgtggattttttggggtggttttttaaggggttggagaaggttttgtggagttttggatgggagatggggtttttagttgtatttataaattgtaggttttggtatttggtgattgggaagtttttgattatgtaggtgggggtgtaggtgtagggttttagtatgttttttaggtttgaagattttatgtgt

SEQ ID NO: 15653-15654 - skipped (2 entries)

SEQ ID NO: 15655 - DNA, 36 bp, Homo sapiens; identical to SEQ ID NO: 12683
  source 1..36: mol_type = unassigned DNA

SEQ ID NO: 15656 - skipped

SEQ ID NO: 15657 - DNA, 181 bp, Homo sapiens; identical to SEQ ID NO: 12705
  source 1..181: mol_type = unassigned DNA

SEQ ID NO: 15658 - DNA, 369 bp, Homo sapiens; identical to SEQ ID NO: 12716
  source 1..369: mol_type = unassigned DNA

SEQ ID NO: 15659 - skipped

SEQ ID NO: 15660 - DNA, 35 bp, Homo sapiens; identical to SEQ ID NO: 12738
  source 1..35: mol_type = unassigned DNA

SEQ ID NO: 15661 - DNA, 487 bp, Homo sapiens; identical to SEQ ID NO: 12749
  source 1..487: mol_type = unassigned DNA

SEQ ID NO: 15662 - DNA, 28 bp, Homo sapiens
  source 1..28: mol_type = unassigned DNA
cgtcttgatctcctgacctcgtgatccg

SEQ ID NO: 15663 - skipped

SEQ ID NO: 15664 - DNA, 18 bp, Homo sapiens
  source 1..18: mol_type = unassigned DNA
cgcgccttcctgaccgcg

SEQ ID NO: 15665 - DNA, 18 bp, Homo sapiens
  source 1..18: mol_type = unassigned DNA
cgcaggtcagtgagtgcg

SEQ ID NO: 15666 - DNA, 87 bp, Homo sapiens; identical to SEQ ID NO: 12794
  source 1..87: mol_type = unassigned DNA

SEQ ID NO: 15667 - DNA, 11 bp, Homo sapiens
  source 1..11: mol_type = unassigned DNA
cggagcttgcg

SEQ ID NO: 15668 - skipped

SEQ ID NO: 15669 - DNA, 167 bp, Homo sapiens; identical to SEQ ID NO: 12825
  source 1..167: mol_type = unassigned DNA

SEQ ID NO: 15670-15672 - skipped (3 entries)

SEQ ID NO: 15673 - DNA, 185 bp, Homo sapiens; identical to SEQ ID NO: 12829
  source 1..185: mol_type = unassigned DNA

SEQ ID NO: 15674 - DNA, 17 bp, Homo sapiens
  source 1..17: mol_type = unassigned DNA
cgagccgaagcagggcg

SEQ ID NO: 15675 - DNA, 135 bp, Homo sapiens; identical to SEQ ID NO: 12831
  source 1..135: mol_type = unassigned DNA

SEQ ID NO: 15676 - skipped

SEQ ID NO: 15677 - DNA, 71 bp, Homo sapiens; identical to SEQ ID NO: 12833
  source 1..71: mol_type = unassigned DNA

SEQ ID NO: 15678 - DNA, 54 bp, Homo sapiens; identical to SEQ ID NO: 12834
  source 1..54: mol_type = unassigned DNA

SEQ ID NO: 15679 - skipped

SEQ ID NO: 15680 - DNA, 29 bp, Homo sapiens
  source 1..29: mol_type = unassigned DNA
cgccggtttttaagcccgtaggaaaagcg

SEQ ID NO: 15681 - DNA, 18 bp, Homo sapiens
  source 1..18: mol_type = unassigned DNA
cgctttctagtgtctgcg

SEQ ID NO: 15682-15683 - skipped (2 entries)

SEQ ID NO: 15684 - DNA, 24 bp, Homo sapiens
  source 1..24: mol_type = unassigned DNA
cgaagcgcctcctgcgcagactcg

SEQ ID NO: 15685-15687 - skipped (3 entries)

SEQ ID NO: 15688 - DNA, 12 bp, Homo sapiens
  source 1..12: mol_type = unassigned DNA
cggggcaggtcg

SEQ ID NO: 15689 - skipped

SEQ ID NO: 15690 - DNA, 80 bp, Homo sapiens; identical to SEQ ID NO: 12875
  source 1..80: mol_type = unassigned DNA

SEQ ID NO: 15691 - skipped

SEQ ID NO: 15692 - DNA, 3039 bp, Homo sapiens; identical to SEQ ID NO: 12897
  source 1..3039: mol_type = unassigned DNA

SEQ ID NO: 15693-15694 - skipped (2 entries)

SEQ ID NO: 15695 - DNA, 36 bp, Homo sapiens; identical to SEQ ID NO: 12920
  source 1..36: mol_type = unassigned DNA

SEQ ID NO: 15696 - skipped

SEQ ID NO: 15697 - DNA, 181 bp, Homo sapiens; identical to SEQ ID NO: 12942
  source 1..181: mol_type = unassigned DNA

SEQ ID NO: 15698 - DNA, 369 bp, Homo sapiens; identical to SEQ ID NO: 12953
  source 1..369: mol_type = unassigned DNA

SEQ ID NO: 15699 - skipped

SEQ ID NO: 15700 - DNA, 35 bp, Homo sapiens; identical to SEQ ID NO: 12975
  source 1..35: mol_type = unassigned DNA

SEQ ID NO: 15701 - DNA, 487 bp, Homo sapiens; identical to SEQ ID NO: 12986
  source 1..487: mol_type = unassigned DNA

SEQ ID NO: 15702 - DNA, 28 bp, Homo sapiens
  source 1..28: mol_type = unassigned DNA
cggatcacgaggtcaggagatcaagacg

SEQ ID NO: 15703 - skipped

SEQ ID NO: 15704 - DNA, 18 bp, Homo sapiens
  source 1..18: mol_type = unassigned DNA
cgcggtcaggaaggcgcg

SEQ ID NO: 15705 - DNA, 18 bp, Homo sapiens
  source 1..18: mol_type = unassigned DNA
cgcactcactgacctgcg

SEQ ID NO: 15706 - DNA, 87 bp, Homo sapiens; identical to SEQ ID NO: 13031
  source 1..87: mol_type = unassigned DNA

SEQ ID NO: 15707 - DNA, 11 bp, Homo sapiens
  source 1..11: mol_type = unassigned DNA
cgcaagctccg

SEQ ID NO: 15708 - skipped

SEQ ID NO: 15709 - DNA, 167 bp, Homo sapiens; identical to SEQ ID NO: 13062
  source 1..167: mol_type = unassigned DNA

SEQ ID NO: 15710-15712 - skipped (3 entries)

SEQ ID NO: 15713 - DNA, 185 bp, Homo sapiens; identical to SEQ ID NO: 13066
  source 1..185: mol_type = unassigned DNA

SEQ ID NO: 15714 - DNA, 17 bp, Homo sapiens
  source 1..17: mol_type = unassigned DNA
cgccctgcttcggctcg

SEQ ID NO: 15715 - DNA, 135 bp, Homo sapiens; identical to SEQ ID NO: 13068
  source 1..135: mol_type = unassigned DNA

SEQ ID NO: 15716 - skipped

SEQ ID NO: 15717 - DNA, 71 bp, Homo sapiens; identical to SEQ ID NO: 13070
  source 1..71: mol_type = unassigned DNA

SEQ ID NO: 15718 - DNA, 54 bp, Homo sapiens; identical to SEQ ID NO: 13071
  source 1..54: mol_type = unassigned DNA

SEQ ID NO: 15719 - skipped

SEQ ID NO: 15720 - DNA, 29 bp, Homo sapiens
  source 1..29: mol_type = unassigned DNA
cgcttttcctacgggcttaaaaaccggcg

SEQ ID NO: 15721 - DNA, 18 bp, Homo sapiens
  source 1..18: mol_type = unassigned DNA
cgcagacactagaaagcg

SEQ ID NO: 15722-15723 - skipped (2 entries)

SEQ ID NO: 15724 - DNA, 24 bp, Homo sapiens
  source 1..24: mol_type = unassigned DNA
cgagtctgcgcaggaggcgcttcg

SEQ ID NO: 15725-15727 - skipped (3 entries)

SEQ ID NO: 15728 - DNA, 12 bp, Homo sapiens
  source 1..12: mol_type = unassigned DNA
cgacctgccccg

SEQ ID NO: 15729 - skipped

SEQ ID NO: 15730 - DNA, 80 bp, Homo sapiens; identical to SEQ ID NO: 13112
  source 1..80: mol_type = unassigned DNA

SEQ ID NO: 15731 - skipped

SEQ ID NO: 15732 - DNA, 3039 bp, Homo sapiens; identical to SEQ ID NO: 13134
  source 1..3039: mol_type = unassigned DNA

SEQ ID NO: 15733-15734 - skipped (2 entries)

SEQ ID NO: 15735 - DNA, 36 bp, synthetic construct; identical to SEQ ID NO: 13157
  misc_feature 1..36: note = Description of Artificial Sequence: Synthetic oligonucleotide
  source 1..36: mol_type = other DNA

SEQ ID NO: 15736 - skipped

SEQ ID NO: 15737 - DNA, 181 bp, synthetic construct; identical to SEQ ID NO: 13179
  misc_feature 1..181: note = Description of Artificial Sequence: Synthetic polynucleotide
  source 1..181: mol_type = other DNA

SEQ ID NO: 15738 - DNA, 369 bp, synthetic construct; identical to SEQ ID NO: 13190
  misc_feature 1..369: note = Description of Artificial Sequence: Synthetic polynucleotide
  source 1..369: mol_type = other DNA

SEQ ID NO: 15739 - skipped

SEQ ID NO: 15740 - DNA, 35 bp, synthetic construct; identical to SEQ ID NO: 13212
  misc_feature 1..35: note = Description of Artificial Sequence: Synthetic oligonucleotide
  source 1..35: mol_type = other DNA

SEQ ID NO: 15741 - DNA, 487 bp, synthetic construct; identical to SEQ ID NO: 13223
  misc_feature 1..487: note = Description of Artificial Sequence: Synthetic polynucleotide
  source 1..487: mol_type = other DNA

SEQ ID NO: 15742 - DNA, 28 bp, synthetic construct
  misc_feature 1..28: note = Description of Artificial Sequence: Synthetic oligonucleotide
  source 1..28: mol_type = other DNA
ygttttgattttttgatttygtgattyg

SEQ ID NO: 15743 - skipped

SEQ ID NO: 15744 - DNA, 18 bp, synthetic construct
  misc_feature 1..18: note = Description of Artificial Sequence: Synthetic oligonucleotide
  source 1..18: mol_type = other DNA
ygygtttttttgatygyg

SEQ ID NO: 15745 - DNA, 18 bp, synthetic construct
  misc_feature 1..18: note = Description of Artificial Sequence: Synthetic oligonucleotide
  source 1..18: mol_type = other DNA
ygtaggttagtgagtgyg

SEQ ID NO: 15746 - DNA, 87 bp, synthetic construct; identical to SEQ ID NO: 13268
  misc_feature 1..87: note = Description of Artificial Sequence: Synthetic oligonucleotide
  source 1..87: mol_type = other DNA

SEQ ID NO: 15747 - DNA, 11 bp, synthetic construct
  misc_feature 1..11: note = Description of Artificial Sequence: Synthetic oligonucleotide
  source 1..11: mol_type = other DNA
yggagtttgyg

SEQ ID NO: 15748 - skipped

SEQ ID NO: 15749 - DNA, 167 bp, synthetic construct; identical to SEQ ID NO: 13299
  misc_feature 1..167: note = Description of Artificial Sequence: Synthetic polynucleotide
  source 1..167: mol_type = other DNA

SEQ ID NO: 15750-15752 - skipped (3 entries)

SEQ ID NO: 15753 - DNA, 185 bp, synthetic construct; identical to SEQ ID NO: 13303
  misc_feature 1..185: note = Description of Artificial Sequence: Synthetic polynucleotide
  source 1..185: mol_type = other DNA

SEQ ID NO: 15754 - DNA, 17 bp, synthetic construct
  misc_feature 1..17: note = Description of Artificial Sequence: Synthetic oligonucleotide
  source 1..17: mol_type = other DNA
ygagtygaagtagggyg

SEQ ID NO: 15755 - DNA, 135 bp, synthetic construct; identical to SEQ ID NO: 13305
  misc_feature 1..135: note = Description of Artificial Sequence: Synthetic polynucleotide
  source 1..135: mol_type = other DNA

SEQ ID NO: 15756 - skipped

SEQ ID NO: 15757 - DNA, 71 bp, synthetic construct; identical to SEQ ID NO: 13307
  misc_feature 1..71: note = Description of Artificial Sequence: Synthetic oligonucleotide
  source 1..71: mol_type = other DNA

SEQ ID NO: 15758 - DNA, 54 bp, synthetic construct; identical to SEQ ID NO: 13308
  misc_feature 1..54: note = Description of Artificial Sequence: Synthetic oligonucleotide
  source 1..54: mol_type = other DNA

SEQ ID NO: 15759 - skipped

SEQ ID NO: 15760 - DNA, 29 bp, synthetic construct
  misc_feature 1..29: note = Description of Artificial Sequence: Synthetic oligonucleotide
  source 1..29: mol_type = other DNA
ygtyggtttttaagttygtaggaaaagyg

SEQ ID NO: 15761 - DNA, 18 bp, synthetic construct
  misc_feature 1..18: note = Description of Artificial Sequence: Synthetic oligonucleotide
  source 1..18: mol_type = other DNA
ygttttttagtgtttgyg

SEQ ID NO: 15762-15763 - skipped (2 entries)

SEQ ID NO: 15764 - DNA, 24 bp, synthetic construct
  misc_feature 1..24: note = Description of Artificial Sequence: Synthetic oligonucleotide
  source 1..24: mol_type = other DNA
ygaagygttttttgygtagattyg

SEQ ID NO: 15765-15767 - skipped (3 entries)

SEQ ID NO: 15768 - DNA, 12 bp, synthetic construct
  misc_feature 1..12: note = Description of Artificial Sequence: Synthetic oligonucleotide
  source 1..12: mol_type = other DNA
yggggtaggtyg

SEQ ID NO: 15769 - skipped

SEQ ID NO: 15770 - DNA, 80 bp, synthetic construct; identical to SEQ ID NO: 13349
  misc_feature 1..80: note = Description of Artificial Sequence: Synthetic oligonucleotide
  source 1..80: mol_type = other DNA

SEQ ID NO: 15771 - skipped

SEQ ID NO: 15772 - DNA, 3039 bp, synthetic construct; identical to SEQ ID NO: 13371
  misc_feature 1..3039: note = Description of Artificial Sequence: Synthetic polynucleotide
  source 1..3039: mol_type = other DNA

SEQ ID NO: 15773-15774 - skipped (2 entries)

SEQ ID NO: 15775 - DNA, 36 bp, synthetic construct; identical to SEQ ID NO: 13394
  misc_feature 1..36: note = Description of Artificial Sequence: Synthetic oligonucleotide
  source 1..36: mol_type = other DNA

SEQ ID NO: 15776 - skipped

SEQ ID NO: 15777 - DNA, 181 bp, synthetic construct; identical to SEQ ID NO: 13416
  misc_feature 1..181: note = Description of Artificial Sequence: Synthetic polynucleotide
  source 1..181: mol_type = other DNA

SEQ ID NO: 15778 - DNA, 369 bp, synthetic construct; identical to SEQ ID NO: 13427
  misc_feature 1..369: note = Description of Artificial Sequence: Synthetic polynucleotide
  source 1..369: mol_type = other DNA

SEQ ID NO: 15779 - skipped

SEQ ID NO: 15780 - DNA, 35 bp, synthetic construct; identical to SEQ ID NO: 13449
  misc_feature 1..35: note = Description of Artificial Sequence: Synthetic oligonucleotide
  source 1..35: mol_type = other DNA

SEQ ID NO: 15781 - DNA, 487 bp, synthetic construct; identical to SEQ ID NO: 13460
  misc_feature 1..487: note = Description of Artificial Sequence: Synthetic polynucleotide
  source 1..487: mol_type = other DNA

SEQ ID NO: 15782 - DNA, 28 bp, synthetic construct
  misc_feature 1..28: note = Description of Artificial Sequence: Synthetic oligonucleotide
  source 1..28: mol_type = other DNA
tgttttgattttttgattttgtgatttg

SEQ ID NO: 15783 - skipped

SEQ ID NO: 15784 - DNA, 18 bp, synthetic construct
  misc_feature 1..18: note = Description of Artificial Sequence: Synthetic oligonucleotide
  source 1..18: mol_type = other DNA
tgtgtttttttgattgtg

SEQ ID NO: 15785 - DNA, 18 bp, synthetic construct
  misc_feature 1..18: note = Description of Artificial Sequence: Synthetic oligonucleotide
  source 1..18: mol_type = other DNA
tgtaggttagtgagtgtg

SEQ ID NO: 15786 - DNA, 87 bp, synthetic construct; identical to SEQ ID NO: 13505
  misc_feature 1..87: note = Description of Artificial Sequence: Synthetic oligonucleotide
  source 1..87: mol_type = other DNA

SEQ ID NO: 15787 - DNA, 11 bp, synthetic construct
  misc_feature 1..11: note = Description of Artificial Sequence: Synthetic oligonucleotide
  source 1..11: mol_type = other DNA
tggagtttgtg

SEQ ID NO: 15788 - skipped

SEQ ID NO: 15789 - DNA, 167 bp, synthetic construct; identical to SEQ ID NO: 13536
  misc_feature 1..167: note = Description of Artificial Sequence: Synthetic polynucleotide
  source 1..167: mol_type = other DNA

SEQ ID NO: 15790-15792 - skipped (3 entries)

SEQ ID NO: 15793 - DNA, 185 bp, synthetic construct; identical to SEQ ID NO: 13540
  misc_feature 1..185: note = Description of Artificial Sequence: Synthetic polynucleotide
  source 1..185: mol_type = other DNA

SEQ ID NO: 15794 - DNA, 17 bp, synthetic construct
  misc_feature 1..17: note = Description of Artificial Sequence: Synthetic oligonucleotide
  source 1..17: mol_type = other DNA
tgagttgaagtagggtg

SEQ ID NO: 15795 - DNA, 135 bp, synthetic construct; identical to SEQ ID NO: 13542
  misc_feature 1..135: note = Description of Artificial Sequence: Synthetic polynucleotide
  source 1..135: mol_type = other DNA

SEQ ID NO: 15796 - skipped

SEQ ID NO: 15797 - DNA, 71 bp, synthetic construct; identical to SEQ ID NO: 13544
  misc_feature 1..71: note = Description of Artificial Sequence: Synthetic oligonucleotide
  source 1..71: mol_type = other DNA

SEQ ID NO: 15798 - DNA, 54 bp, synthetic construct; identical to SEQ ID NO: 13545
  misc_feature 1..54: note = Description of Artificial Sequence: Synthetic oligonucleotide
  source 1..54: mol_type = other DNA

SEQ ID NO: 15799 - skipped

SEQ ID NO: 15800 - DNA, 29 bp, synthetic construct
  misc_feature 1..29: note = Description of Artificial Sequence: Synthetic oligonucleotide
  source 1..29: mol_type = other DNA
tgttggtttttaagtttgtaggaaaagtg

SEQ ID NO: 15801 - DNA, 18 bp, synthetic construct
  misc_feature 1..18: note = Description of Artificial Sequence: Synthetic oligonucleotide
  source 1..18: mol_type = other DNA
tgttttttagtgtttgtg

SEQ ID NO: 15802-15803 - skipped (2 entries)

SEQ ID NO: 15804 - DNA, 24 bp, synthetic construct
  misc_feature 1..24: note = Description of Artificial Sequence: Synthetic oligonucleotide
  source 1..24: mol_type = other DNA
tgaagtgttttttgtgtagatttg

SEQ ID NO: 15805-15807 - skipped (3 entries)

SEQ ID NO: 15808 - DNA, 12 bp, synthetic construct
  misc_feature 1..12: note = Description of Artificial Sequence: Synthetic oligonucleotide
  source 1..12: mol_type = other DNA
tggggtaggttg

SEQ ID NO: 15809 - skipped

SEQ ID NO: 15810 - DNA, 80 bp, synthetic construct; identical to SEQ ID NO: 13586
  misc_feature 1..80: note = Description of Artificial Sequence: Synthetic oligonucleotide
  source 1..80: mol_type = other DNA

SEQ ID NO: 15811 - skipped

SEQ ID NO: 15812 - DNA, 3039 bp, synthetic construct; identical to SEQ ID NO: 13608
  misc_feature 1..3039: note = Description of Artificial Sequence: Synthetic polynucleotide
  source 1..3039: mol_type = other DNA

SEQ ID NO: 15813-15814 - skipped (2 entries)

SEQ ID NO: 15815 - DNA, 36 bp, synthetic construct; identical to SEQ ID NO: 13631
  misc_feature 1..36: note = Description of Artificial Sequence: Synthetic oligonucleotide
  source 1..36: mol_type = other DNA

SEQ ID NO: 15816 - skipped

SEQ ID NO: 15817 - DNA, 181 bp, synthetic construct; identical to SEQ ID NO: 13653
  misc_feature 1..181: note = Description of Artificial Sequence: Synthetic polynucleotide
  source 1..181: mol_type = other DNA

SEQ ID NO: 15818 - DNA, 369 bp, synthetic construct; identical to SEQ ID NO: 13664
  misc_feature 1..369: note = Description of Artificial Sequence: Synthetic polynucleotide
  source 1..369: mol_type = other DNA

SEQ ID NO: 15819 - skipped

SEQ ID NO: 15820 - DNA, 35 bp, synthetic construct; identical to SEQ ID NO: 13686
  misc_feature 1..35: note = Description of Artificial Sequence: Synthetic oligonucleotide
  source 1..35: mol_type = other DNA

SEQ ID NO: 15821 - DNA, 487 bp, synthetic construct; identical to SEQ ID NO: 13697
  misc_feature 1..487: note = Description of Artificial Sequence: Synthetic polynucleotide
  source 1..487: mol_type = other DNA

SEQ ID NO: 15822 - DNA, 28 bp, synthetic construct
  misc_feature 1..28: note = Description of Artificial Sequence: Synthetic oligonucleotide
  source 1..28: mol_type = other DNA
yggattaygaggttaggagattaagayg

SEQ ID NO: 15823 - skipped

SEQ ID NO: 15824 - DNA, 18 bp, synthetic construct
  misc_feature 1..18: note = Description of Artificial Sequence: Synthetic oligonucleotide
  source 1..18: mol_type = other DNA
ygyggttaggaaggygyg

SEQ ID NO: 15825 - DNA, 18 bp, synthetic construct
  misc_feature 1..18: note = Description of Artificial Sequence: Synthetic oligonucleotide
  source 1..18: mol_type = other DNA
ygtatttattgatttgyg

SEQ ID NO: 15826 - DNA, 87 bp, synthetic construct; identical to SEQ ID NO: 13742
  misc_feature 1..87: note = Description of Artificial Sequence: Synthetic oligonucleotide
  source 1..87: mol_type = other DNA

SEQ ID NO: 15827 - DNA, 11 bp, synthetic construct
  misc_feature 1..11: note = Description of Artificial Sequence: Synthetic oligonucleotide
  source 1..11: mol_type = other DNA
ygtaagtttyg

SEQ ID NO: 15828 - skipped

SEQ ID NO: 15829 - DNA, 167 bp, synthetic construct; identical to SEQ ID NO: 13773
  misc_feature 1..167: note = Description of Artificial Sequence: Synthetic polynucleotide
  source 1..167: mol_type = other DNA

SEQ ID NO: 15830-15832 - skipped (3 entries)

SEQ ID NO: 15833 - DNA, 185 bp, synthetic construct; identical to SEQ ID NO: 13777
  misc_feature 1..185: note = Description of Artificial Sequence: Synthetic polynucleotide
  source 1..185: mol_type = other DNA

SEQ ID NO: 15834 - DNA, 17 bp, synthetic construct
  misc_feature 1..17: note = Description of Artificial Sequence: Synthetic oligonucleotide
  source 1..17: mol_type = other DNA
ygttttgtttyggttyg

SEQ ID NO: 15835 - DNA, 135 bp, synthetic construct; identical to SEQ ID NO: 13779
  misc_feature 1..135: note = Description of Artificial Sequence: Synthetic polynucleotide
  source 1..135: mol_type = other DNA

SEQ ID NO: 15836 - skipped

SEQ ID NO: 15837 - DNA, 71 bp, synthetic construct; identical to SEQ ID NO: 13781
  misc_feature 1..71: note = Description of Artificial Sequence: Synthetic oligonucleotide
  source 1..71: mol_type = other DNA

SEQ ID NO: 15838 - DNA, 54 bp, synthetic construct; identical to SEQ ID NO: 13782
  misc_feature 1..54: note = Description of Artificial Sequence: Synthetic oligonucleotide
  source 1..54: mol_type = other DNA

SEQ ID NO: 15839 - skipped

SEQ ID NO: 15840 - DNA, 29 bp, synthetic construct
  misc_feature 1..29: note = Description of Artificial Sequence: Synthetic oligonucleotide
  source 1..29: mol_type = other DNA
ygttttttttaygggtttaaaaatyggyg

SEQ ID NO: 15841 - DNA, 18 bp, synthetic construct
  misc_feature 1..18: note = Description of Artificial Sequence: Synthetic oligonucleotide
  source 1..18: mol_type = other DNA
ygtagatattagaaagyg

SEQ ID NO: 15842-15843 - skipped (2 entries)

SEQ ID NO: 15844 - DNA, 24 bp, synthetic construct
  misc_feature 1..24: note = Description of Artificial Sequence: Synthetic oligonucleotide
  source 1..24: mol_type = other DNA
ygagtttgygtaggaggygtttyg

SEQ ID NO: 15845-15847 - skipped (3 entries)

SEQ ID NO: 15848 - DNA, 12 bp, synthetic construct
  misc_feature 1..12: note = Description of Artificial Sequence: Synthetic oligonucleotide
  source 1..12: mol_type = other DNA
ygatttgtttyg

SEQ ID NO: 15849 - skipped

SEQ ID NO: 15850 - DNA, 80 bp, synthetic construct; identical to SEQ ID NO: 13823
  misc_feature 1..80: note = Description of Artificial Sequence: Synthetic oligonucleotide
  source 1..80: mol_type = other DNA

SEQ ID NO: 15851 - skipped

SEQ ID NO: 15852 - DNA, 3039 bp, synthetic construct; identical to SEQ ID NO: 13845
  misc_feature 1..3039: note = Description of Artificial Sequence: Synthetic polynucleotide
  source 1..3039: mol_type = other DNA

SEQ ID NO: 15853-15854 - skipped (2 entries)

SEQ ID NO: 15855 - DNA, 36 bp, synthetic construct; identical to SEQ ID NO: 13868
  misc_feature 1..36: note = Description of Artificial Sequence: Synthetic oligonucleotide
  source 1..36: mol_type = other DNA

SEQ ID NO: 15856 - skipped

SEQ ID NO: 15857 - DNA, 181 bp, synthetic construct; identical to SEQ ID NO: 13890
  misc_feature 1..181: note = Description of Artificial Sequence: Synthetic polynucleotide
  source 1..181: mol_type = other DNA

SEQ ID NO: 15858 - DNA, 369 bp, synthetic construct; identical to SEQ ID NO: 13901
  misc_feature 1..369: note = Description of Artificial Sequence: Synthetic polynucleotide
  source 1..369: mol_type = other DNA

SEQ ID NO: 15859 - skipped

SEQ ID NO: 15860 - DNA, 35 bp, synthetic construct; identical to SEQ ID NO: 13923
  misc_feature 1..35: note = Description of Artificial Sequence: Synthetic oligonucleotide
  source 1..35: mol_type = other DNA

SEQ ID NO: 15861 - DNA, 487 bp, synthetic construct; identical to SEQ ID NO: 13934
  misc_feature 1..487: note = Description of Artificial Sequence: Synthetic polynucleotide
  source 1..487: mol_type = other DNA

SEQ ID NO: 15862 - DNA, 28 bp, synthetic construct
  misc_feature 1..28: note = Description of Artificial Sequence: Synthetic oligonucleotide
  source 1..28: mol_type = other DNA
tggattatgaggttaggagattaagatg

SEQ ID NO: 15863 - skipped

SEQ ID NO: 15864 - DNA, 18 bp, synthetic construct
  misc_feature 1..18: note = Description of Artificial Sequence: Synthetic oligonucleotide
  source 1..18: mol_type = other DNA
tgtggttaggaaggtgtg

SEQ ID NO: 15865 - DNA, 18 bp, synthetic construct
  misc_feature 1..18: note = Description of Artificial Sequence: Synthetic oligonucleotide
  source 1..18: mol_type = other DNA
tgtatttattgatttgtg

SEQ ID NO: 15866 - DNA, 87 bp, synthetic construct; identical to SEQ ID NO: 13979
  misc_feature 1..87: note = Description of Artificial Sequence: Synthetic oligonucleotide
  source 1..87: mol_type = other DNA

SEQ ID NO: 15867 - DNA, 11 bp, synthetic construct
  misc_feature 1..11: note = Description of Artificial Sequence: Synthetic oligonucleotide
  source 1..11: mol_type = other DNA
tgtaagttttg

SEQ ID NO: 15868 - skipped

SEQ ID NO: 15869 - DNA, 167 bp, synthetic construct; identical to SEQ ID NO: 14010
  misc_feature 1..167: note = Description of Artificial Sequence: Synthetic polynucleotide
  source 1..167: mol_type = other DNA

SEQ ID NO: 15870-15872 - skipped (3 entries)

SEQ ID NO: 15873 - DNA, 185 bp, synthetic construct; identical to SEQ ID NO: 14014
  misc_feature 1..185: note = Description of Artificial Sequence: Synthetic polynucleotide
  source 1..185: mol_type = other DNA

SEQ ID NO: 15874 - DNA, 17 bp, synthetic construct
  misc_feature 1..17: note = Description of Artificial Sequence: Synthetic oligonucleotide
  source 1..17: mol_type = other DNA
tgttttgttttggtttg

SEQ ID NO: 15875 - DNA, 135 bp, synthetic construct; identical to SEQ ID NO: 14016
  misc_feature 1..135: note = Description of Artificial Sequence: Synthetic polynucleotide
  source 1..135: mol_type = other DNA

SEQ ID NO: 15876 - skipped

SEQ ID NO: 15877 - DNA, 71 bp, synthetic construct; identical to SEQ ID NO: 14018
  misc_feature 1..71: note = Description of Artificial Sequence: Synthetic oligonucleotide
  source 1..71: mol_type = other DNA

SEQ ID NO: 15878 - DNA, 54 bp, synthetic construct; identical to SEQ ID NO: 14019
  misc_feature 1..54: note = Description of Artificial Sequence: Synthetic oligonucleotide
  source 1..54: mol_type = other DNA

SEQ ID NO: 15879 - skipped

SEQ ID NO: 15880 - DNA, 29 bp, synthetic construct
  misc_feature 1..29: note = Description of Artificial Sequence: Synthetic oligonucleotide
  source 1..29: mol_type = other DNA
tgttttttttatgggtttaaaaattggtg

SEQ ID NO: 15881 - DNA, 18 bp, synthetic construct
  misc_feature 1..18: note = Description of Artificial Sequence: Synthetic oligonucleotide
  source 1..18: mol_type = other DNA
tgtagatattagaaagtg

SEQ ID NO: 15882-15883 - skipped (2 entries)

SEQ ID NO: 15884 - DNA, 24 bp, synthetic construct
  misc_feature 1..24: note = Description of Artificial Sequence: Synthetic oligonucleotide
  source 1..24: mol_type = other DNA
tgagtttgtgtaggaggtgttttg

SEQ ID NO: 15885-15887 - skipped (3 entries)

SEQ ID NO: 15888 - DNA, 12 bp, synthetic construct
  misc_feature 1..12: note = Description of Artificial Sequence: Synthetic oligonucleotide
  source 1..12: mol_type = other DNA
tgatttgttttg

SEQ ID NO: 15889 - skipped

SEQ ID NO: 15890 - DNA, 80 bp, synthetic construct; identical to SEQ ID NO: 14060
  misc_feature 1..80: note = Description of Artificial Sequence: Synthetic oligonucleotide
  source 1..80: mol_type = other DNA

SEQ ID NO: 15891 - skipped

SEQ ID NO: 15892 - DNA, 3039 bp, synthetic construct; identical to SEQ ID NO: 14082
  misc_feature 1..3039: note = Description of Artificial Sequence: Synthetic polynucleotide
  source 1..3039: mol_type = other DNA

SEQ ID NO: 15893 - DNA, 201 bp, Homo sapiens; identical to SEQ ID NO: 14093
  source 1..201: mol_type = unassigned DNA

SEQ ID NO: 15894 - DNA, 208 bp, Homo sapiens; identical to SEQ ID NO: 14094
  source 1..208: mol_type = unassigned DNA

SEQ ID NO: 15895 - DNA, 235 bp, Homo sapiens; identical to SEQ ID NO: 14105
  source 1..235: mol_type = unassigned DNA

SEQ ID NO: 15896 - DNA, 207 bp, Homo sapiens; identical to SEQ ID NO: 14116
  source 1..207: mol_type = unassigned DNA

SEQ ID NO: 15897 - DNA, 380 bp, Homo sapiens; identical to SEQ ID NO: 14127
  source 1..380: mol_type = unassigned DNA

SEQ ID NO: 15898 - DNA, 568 bp, Homo sapiens; identical to SEQ ID NO: 14138
  source 1..568: mol_type = unassigned DNA

SEQ ID NO: 15899 - DNA, 201 bp, Homo sapiens; identical to SEQ ID NO: 14149
  source 1..201: mol_type = unassigned DNA

SEQ ID NO: 15900 - DNA, 234 bp, Homo sapiens; identical to SEQ ID NO: 14160
  source 1..234: mol_type = unassigned DNA

SEQ ID NO: 15901 - DNA, 686 bp, Homo sapiens; identical to SEQ ID NO: 14171
  source 1..686: mol_type = unassigned DNA

SEQ ID NO: 15902 - DNA, 227 bp, Homo sapiens; identical to SEQ ID NO: 14182
  source 1..227: mol_type = unassigned DNA

SEQ ID NO: 15903 - DNA, 201 bp, Homo sapiens; identical to SEQ ID NO: 14193
  source 1..201: mol_type = unassigned DNA

SEQ ID NO: 15904 - DNA, 217 bp, Homo sapiens; identical to SEQ ID NO: 14204
  source 1..217: mol_type = unassigned DNA

SEQ ID NO: 15905 - DNA, 217 bp, Homo sapiens; identical to SEQ ID NO: 14205
  source 1..217: mol_type = unassigned DNA

SEQ ID NO: 15906 - DNA, 286 bp, Homo sapiens; identical to SEQ ID NO: 14216
  source 1..286: mol_type = unassigned DNA

SEQ ID NO: 15907 - DNA, 210 bp, Homo sapiens; identical to SEQ ID NO: 14227
  source 1..210: mol_type = unassigned DNA

SEQ ID NO: 15908 - DNA, 201 bp, Homo sapiens; identical to SEQ ID NO: 14238
  source 1..201: mol_type = unassigned DNA

SEQ ID NO: 15909 - DNA, 366 bp, Homo sapiens; identical to SEQ ID NO: 14247
  source 1..366: mol_type = unassigned DNA

SEQ ID NO: 15910 - DNA, 201 bp, Homo sapiens; identical to SEQ ID NO: 14248
  source 1..201: mol_type = unassigned DNA

SEQ ID NO: 15911 - DNA, 201 bp, Homo sapiens; identical to SEQ ID NO: 14249
  source 1..201: mol_type = unassigned DNA

SEQ ID NO: 15912 - DNA, 201 bp, Homo sapiens; identical to SEQ ID NO: 14250
  source 1..201: mol_type = unassigned DNA

SEQ ID NO: 15913 - DNA, 384 bp, Homo sapiens; identical to SEQ ID NO: 14251
  source 1..384: mol_type = unassigned DNA

SEQ ID NO: 15914 - DNA, 216 bp, Homo sapiens; identical to SEQ ID NO: 14252
  source 1..216: mol_type = unassigned DNA

SEQ ID NO: 15915 - DNA, 334 bp, Homo sapiens; identical to SEQ ID NO: 14253
  source 1..334: mol_type = unassigned DNA

SEQ ID NO: 15916 - DNA, 201 bp, Homo sapiens; identical to SEQ ID NO: 14254
  source 1..201: mol_type = unassigned DNA

SEQ ID NO: 15917 - DNA, 270 bp, Homo sapiens; identical to SEQ ID NO: 14255
  source 1..270: mol_type = unassigned DNA

SEQ ID NO: 15918 - DNA, 253 bp, Homo sapiens; identical to SEQ ID NO: 14256
  source 1..253: mol_type = unassigned DNA

SEQ ID NO: 15919 - DNA, 204 bp, Homo sapiens; identical to SEQ ID NO: 14257
  source 1..204: mol_type = unassigned DNA

SEQ ID NO: 15920 - DNA, 228 bp, Homo sapiens; identical to SEQ ID NO: 14258
  source 1..228: mol_type = unassigned DNA

SEQ ID NO: 15921 - DNA, 217 bp, Homo sapiens; identical to SEQ ID NO: 14259
  source 1..217: mol_type = unassigned DNA

SEQ ID NO: 15922 - DNA, 201 bp, Homo sapiens; identical to SEQ ID NO: 14260
  source 1..201: mol_type = unassigned DNA

SEQ ID NO: 15923 - DNA, 204 bp, Homo sapiens; identical to SEQ ID NO: 14261
  source 1..204: mol_type = unassigned DNA

SEQ ID NO: 15924 - DNA, 223 bp, Homo sapiens; identical to SEQ ID NO: 14262
  source 1..223: mol_type = unassigned DNA

SEQ ID NO: 15925 - DNA, 201 bp, Homo sapiens; identical to SEQ ID NO: 14263
  source 1..201: mol_type = unassigned DNA

SEQ ID NO: 15926 - DNA, 203 bp, Homo sapiens; identical to SEQ ID NO: 14264
  source 1..203: mol_type = unassigned DNA

SEQ ID NO: 15927 - DNA, 201 bp, Homo sapiens; identical to SEQ ID NO: 14265
  source 1..201: mol_type = unassigned DNA

SEQ ID NO: 15928 - DNA, 211 bp, Homo sapiens; identical to SEQ ID NO: 14275
  source 1..211: mol_type = unassigned DNA

SEQ ID NO: 15929 - DNA, 201 bp, Homo sapiens; identical to SEQ ID NO: 14286
  source 1..201: mol_type = unassigned DNA

SEQ ID NO: 15930 - DNA, 279 bp, Homo sapiens; identical to SEQ ID NO: 14297
  source 1..279: mol_type = unassigned DNA

SEQ ID NO: 15931 - DNA, 203 bp, Homo sapiens; identical to SEQ ID NO: 14308
  source 1..203: mol_type = unassigned DNA

SEQ ID NO: 15932 - DNA, 3238 bp, Homo sapiens; identical to SEQ ID NO: 14319
  source 1..3238: mol_type = unassigned DNA

SEQ ID NO: 15933 - DNA, 201 bp, Homo sapiens; identical to SEQ ID NO: 14330
  source 1..201: mol_type = unassigned DNA

SEQ ID NO: 15934 - DNA, 208 bp, Homo sapiens; identical to SEQ ID NO: 14331
  source 1..208: mol_type = unassigned DNA

SEQ ID NO: 15935 - DNA, 235 bp, Homo sapiens; identical to SEQ ID NO: 14342
  source 1..235: mol_type = unassigned DNA

SEQ ID NO: 15936 - DNA, 207 bp, Homo sapiens; identical to SEQ ID NO: 14353
  source 1..207: mol_type = unassigned DNA

SEQ ID NO: 15937 - DNA, 380 bp, Homo sapiens; identical to SEQ ID NO: 14364
  source 1..380: mol_type = unassigned DNA

SEQ ID NO: 15938 - DNA, 568 bp, Homo sapiens; identical to SEQ ID NO: 14375
  source 1..568: mol_type = unassigned DNA

SEQ ID NO: 15939 - DNA, 201 bp, Homo sapiens; identical to SEQ ID NO: 14386
  source 1..201: mol_type = unassigned DNA

SEQ ID NO: 15940 - DNA, 234 bp, Homo sapiens; identical to SEQ ID NO: 14397
  source 1..234: mol_type = unassigned DNA

SEQ ID NO: 15941 - DNA, 686 bp, Homo sapiens; identical to SEQ ID NO: 14408
  source 1..686: mol_type = unassigned DNA

SEQ ID NO: 15942 - DNA, 227 bp, Homo sapiens; identical to SEQ ID NO: 14419
  source 1..227: mol_type = unassigned DNA

SEQ ID NO: 15943 - DNA, 201 bp, Homo sapiens; identical to SEQ ID NO: 14430
  source 1..201: mol_type = unassigned DNA

SEQ ID NO: 15944 - DNA, 217 bp, Homo sapiens; identical to SEQ ID NO: 14441
  source 1..217: mol_type = unassigned DNA

SEQ ID NO: 15945 - DNA, 217 bp, Homo sapiens; identical to SEQ ID NO: 14442
  source 1..217: mol_type = unassigned DNA

SEQ ID NO: 15946 - DNA, 286 bp, Homo sapiens; identical to SEQ ID NO: 14453
  source 1..286: mol_type = unassigned DNA

SEQ ID NO: 15947 - DNA, 210 bp, Homo sapiens; identical to SEQ ID NO: 14464
  source 1..210: mol_type = unassigned DNA

SEQ ID NO: 15948 - DNA, 201 bp, Homo sapiens; identical to SEQ ID NO: 14475
  source 1..201: mol_type = unassigned DNA

SEQ ID NO: 15949 - DNA, 366 bp, Homo sapiens; identical to SEQ ID NO: 14484
  source 1..366: mol_type = unassigned DNA

SEQ ID NO: 15950 - DNA, 201 bp, Homo sapiens; identical to SEQ ID NO: 14485
  source 1..201: mol_type = unassigned DNA

SEQ ID NO: 15951 - DNA, 201 bp, Homo sapiens; identical to SEQ ID NO: 14486
  source 1..201: mol_type = unassigned DNA

SEQ ID NO: 15952 - DNA, 201 bp, Homo sapiens; identical to SEQ ID NO: 14487
  source 1..201: mol_type = unassigned DNA

SEQ ID NO: 15953 - DNA, 384 bp, Homo sapiens; identical to SEQ ID NO: 14488
  source 1..384: mol_type = unassigned DNA

SEQ ID NO: 15954 - DNA, 216 bp, Homo sapiens; identical to SEQ ID NO: 14489
  source 1..216: mol_type = unassigned DNA

SEQ ID NO: 15955 - DNA, 334 bp, Homo sapiens; identical to SEQ ID NO: 14490
  source 1..334: mol_type = unassigned DNA

SEQ ID NO: 15956 - DNA, 201 bp, Homo sapiens; identical to SEQ ID NO: 14491
  source 1..201: mol_type = unassigned DNA

SEQ ID NO: 15957 - DNA, 270 bp, Homo sapiens; identical to SEQ ID NO: 14492
  source 1..270: mol_type = unassigned DNA

SEQ ID NO: 15958 - DNA, 253 bp, Homo sapiens; identical to SEQ ID NO: 14493
  source 1..253: mol_type = unassigned DNA

SEQ ID NO: 15959 - DNA, 204 bp, Homo sapiens; identical to SEQ ID NO: 14494
  source 1..204: mol_type = unassigned DNA

SEQ ID NO: 15960 - DNA, 228 bp, Homo sapiens; identical to SEQ ID NO: 14495
  source 1..228: mol_type = unassigned DNA

SEQ ID NO: 15961 - DNA, 217 bp, Homo sapiens; identical to SEQ ID NO: 14496
  source 1..217: mol_type = unassigned DNA

SEQ ID NO: 15962 - DNA, 201 bp, Homo sapiens; identical to SEQ ID NO: 14497
  source 1..201: mol_type = unassigned DNA

SEQ ID NO: 15963 - DNA, 204 bp, Homo sapiens; identical to SEQ ID NO: 14498
  source 1..204: mol_type = unassigned DNA

SEQ ID NO: 15964 - DNA, 223 bp, Homo sapiens; identical to SEQ ID NO: 14499
  source 1..223: mol_type = unassigned DNA

SEQ ID NO: 15965 - DNA, 201 bp, Homo sapiens; identical to SEQ ID NO: 14500
  source 1..201: mol_type = unassigned DNA

SEQ ID NO: 15966 - DNA, 203 bp, Homo sapiens; identical to SEQ ID NO: 14501
  source 1..203: mol_type = unassigned DNA

SEQ ID NO: 15967 - DNA, 201 bp, Homo sapiens; identical to SEQ ID NO: 14502
  source 1..201: mol_type = unassigned DNA

SEQ ID NO: 15968 - DNA, 211 bp, Homo sapiens; identical to SEQ ID NO: 14512
  source 1..211: mol_type = unassigned DNA

SEQ ID NO: 15969 - DNA, 201 bp, Homo sapiens; identical to SEQ ID NO: 14523
  source 1..201: mol_type = unassigned DNA

SEQ ID NO: 15970 - DNA, 279 bp, Homo sapiens; identical to SEQ ID NO: 14534
  source 1..279: mol_type = unassigned DNA

SEQ ID NO: 15971 - DNA, 203 bp, Homo sapiens; identical to SEQ ID NO: 14545
  source 1..203: mol_type = unassigned DNA

SEQ ID NO: 15972 - DNA, 3238 bp, Homo sapiens; identical to SEQ ID NO: 14556
  source 1..3238: mol_type = unassigned DNA

SEQ ID NO: 15973 - DNA, 201 bp, synthetic construct; identical to SEQ ID NO: 14567
  misc_feature 1..201: note = Description of Artificial Sequence: Synthetic polynucleotide
  source 1..201: mol_type = other DNA

SEQ ID NO: 15974 - DNA, 208 bp, synthetic construct; identical to SEQ ID NO: 14568
  misc_feature 1..208: note = Description of Artificial Sequence: Synthetic polynucleotide
  source 1..208: mol_type = other DNA

SEQ ID NO: 15975 - DNA, 235 bp, synthetic construct; identical to SEQ ID NO: 14579
  misc_feature 1..235: note = Description of Artificial Sequence: Synthetic polynucleotide
  source 1..235: mol_type = other DNA

SEQ ID NO: 15976 - DNA, 207 bp, synthetic construct; identical to SEQ ID NO: 14590
  misc_feature 1..207: note = Description of Artificial Sequence: Synthetic polynucleotide
  source 1..207: mol_type = other DNA

SEQ ID NO: 15977 - DNA, 380 bp, synthetic construct; identical to SEQ ID NO: 14601
  misc_feature 1..380: note = Description of Artificial Sequence: Synthetic polynucleotide
  source 1..380: mol_type = other DNA

SEQ ID NO: 15978 - DNA, 568 bp, synthetic construct; identical to SEQ ID NO: 14612
  misc_feature 1..568: note = Description of Artificial Sequence: Synthetic polynucleotide
  source 1..568: mol_type = other DNA

SEQ ID NO: 15979 - DNA, 201 bp, synthetic construct; identical to SEQ ID NO: 14623
  misc_feature 1..201: note = Description of Artificial Sequence: Synthetic polynucleotide
  source 1..201: mol_type = other DNA

SEQ ID NO: 15980 - DNA, 234 bp, synthetic construct; identical to SEQ ID NO: 14634
  misc_feature 1..234: note = Description of Artificial Sequence: Synthetic polynucleotide
  source 1..234: mol_type = other DNA

SEQ ID NO: 15981 - DNA, 686 bp, synthetic construct; identical to SEQ ID NO: 14645
  misc_feature 1..686: note = Description of Artificial Sequence: Synthetic polynucleotide
  source 1..686: mol_type = other DNA

SEQ ID NO: 15982 - DNA, 227 bp, synthetic construct; identical to SEQ ID NO: 14656
  misc_feature 1..227: note = Description of Artificial Sequence: Synthetic polynucleotide
  source 1..227: mol_type = other DNA

SEQ ID NO: 15983 - DNA, 201 bp, synthetic construct; identical to SEQ ID NO: 14667
  misc_feature 1..201: note = Description of Artificial Sequence: Synthetic polynucleotide
  source 1..201: mol_type = other DNA

SEQ ID NO: 15984 - DNA, 217 bp, synthetic construct; identical to SEQ ID NO: 14678
  misc_feature 1..217: note = Description of Artificial Sequence: Synthetic polynucleotide
  source 1..217: mol_type = other DNA

SEQ ID NO: 15985 - DNA, 217 bp, synthetic construct; identical to SEQ ID NO: 14679
  misc_feature 1..217: note = Description of Artificial Sequence: Synthetic polynucleotide
  source 1..217: mol_type = other DNA

SEQ ID NO: 15986 - DNA, 286 bp, synthetic construct; identical to SEQ ID NO: 14690
  misc_feature 1..286: note = Description of Artificial Sequence: Synthetic polynucleotide
  source 1..286: mol_type = other DNA

SEQ ID NO: 15987 - DNA, 210 bp, synthetic construct; identical to SEQ ID NO: 14701
  misc_feature 1..210: note = Description of Artificial Sequence: Synthetic polynucleotide
  source 1..210: mol_type = other DNA

SEQ ID NO: 15988 - DNA, 201 bp, synthetic construct; identical to SEQ ID NO: 14712
  misc_feature 1..201: note = Description of Artificial Sequence: Synthetic polynucleotide
  source 1..201: mol_type = other DNA

SEQ ID NO: 15989 - DNA, 366 bp, synthetic construct; identical to SEQ ID NO: 14721
  misc_feature 1..366: note = Description of Artificial Sequence: Synthetic polynucleotide
  source 1..366: mol_type = other DNA

SEQ ID NO: 15990 - DNA, 201 bp, synthetic construct; identical to SEQ ID NO: 14722
  misc_feature 1..201: note = Description of Artificial Sequence: Synthetic polynucleotide
  source 1..201: mol_type = other DNA

SEQ ID NO: 15991 - DNA, 201 bp, synthetic construct; identical to SEQ ID NO: 14723
  misc_feature 1..201: note = Description of Artificial Sequence: Synthetic polynucleotide
  source 1..201: mol_type = other DNA

SEQ ID NO: 15992 - DNA, 201 bp, synthetic construct; identical to SEQ ID NO: 14724
  misc_feature 1..201: note = Description of Artificial Sequence: Synthetic polynucleotide
  source 1..201: mol_type = other DNA

SEQ ID NO: 15993 - DNA, 384 bp, synthetic construct; identical to SEQ ID NO: 14725
  misc_feature 1..384: note = Description of Artificial Sequence: Synthetic polynucleotide
  source 1..384: mol_type = other DNA

SEQ ID NO: 15994 - DNA, 216 bp, synthetic construct; identical to SEQ ID NO: 14726
  misc_feature 1..216: note = Description of Artificial Sequence: Synthetic polynucleotide
  source 1..216: mol_type = other DNA

SEQ ID NO: 15995 - DNA, 334 bp, synthetic construct; identical to SEQ ID NO: 14727
  misc_feature 1..334: note = Description of Artificial Sequence: Synthetic polynucleotide
  source 1..334: mol_type = other DNA

SEQ ID NO: 15996 - DNA, 201 bp, synthetic construct; identical to SEQ ID NO: 14728
  misc_feature 1..201: note = Description of Artificial Sequence: Synthetic polynucleotide
  source 1..201: mol_type = other DNA

SEQ ID NO: 15997 - DNA, 270 bp, synthetic construct; identical to SEQ ID NO: 14729
  misc_feature 1..270: note = Description of Artificial Sequence: Synthetic polynucleotide
  source 1..270: mol_type = other DNA

SEQ ID NO: 15998 - DNA, 253 bp, synthetic construct; identical to SEQ ID NO: 14730
  misc_feature 1..253: note = Description of Artificial Sequence: Synthetic polynucleotide
  source 1..253: mol_type = other DNA

SEQ ID NO: 15999 - DNA, 204 bp, synthetic construct; identical to SEQ ID NO: 14731
  misc_feature 1..204: note = Description of Artificial Sequence: Synthetic polynucleotide
  source 1..204: mol_type = other DNA

SEQ ID NO: 16000 - DNA, 228 bp, synthetic construct; identical to SEQ ID NO: 14732
  misc_feature 1..228: note = Description of Artificial Sequence: Synthetic polynucleotide
  source 1..228: mol_type = other DNA

SEQ ID NO: 16001 - DNA, 217 bp, synthetic construct; identical to SEQ ID NO: 14733
  misc_feature 1..217: note = Description of Artificial Sequence: Synthetic polynucleotide
  source 1..217: mol_type = other DNA

SEQ ID NO: 16002 - DNA, 201 bp, synthetic construct; identical to SEQ ID NO: 14734
  misc_feature 1..201: note = Description of Artificial Sequence: Synthetic polynucleotide
  source 1..201: mol_type = other DNA

SEQ ID NO: 16003 - DNA, 204 bp, synthetic construct; identical to SEQ ID NO: 14735
  misc_feature 1..204: note = Description of Artificial Sequence: Synthetic polynucleotide
  source 1..204: mol_type = other DNA

SEQ ID NO: 16004 - DNA, 223 bp, synthetic construct; identical to SEQ ID NO: 14736
  misc_feature 1..223: note = Description of Artificial Sequence: Synthetic polynucleotide
  source 1..223: mol_type = other DNA

SEQ ID NO: 16005 - DNA, 201 bp, synthetic construct; identical to SEQ ID NO: 14737
  misc_feature 1..201: note = Description of Artificial Sequence: Synthetic polynucleotide
  source 1..201: mol_type = other DNA

SEQ ID NO: 16006 - DNA, 203 bp, synthetic construct; identical to SEQ ID NO: 14738
  misc_feature 1..203: note = Description of Artificial Sequence: Synthetic polynucleotide
  source 1..203: mol_type = other DNA

SEQ ID NO: 16007 - DNA, 201 bp, synthetic construct; identical to SEQ ID NO: 14739
  misc_feature 1..201: note = Description of Artificial Sequence: Synthetic polynucleotide
  source 1..201: mol_type = other DNA

SEQ ID NO: 16008 - DNA, 211 bp, synthetic construct; identical to SEQ ID NO: 14749
  misc_feature 1..211: note = Description of Artificial Sequence: Synthetic polynucleotide
  source 1..211: mol_type = other DNA

SEQ ID NO: 16009 - DNA, 201 bp, synthetic construct; identical to SEQ ID NO: 14760
  misc_feature 1..201: note = Description of Artificial Sequence: Synthetic polynucleotide
  source 1..201: mol_type = other DNA

SEQ ID NO: 16010 - DNA, 279 bp, synthetic construct; identical to SEQ ID NO: 14771
  misc_feature 1..279: note = Description of Artificial Sequence: Synthetic polynucleotide
  source 1..279: mol_type = other DNA

SEQ ID NO: 16011 - DNA, 203 bp, synthetic construct; identical to SEQ ID NO: 14782
  misc_feature 1..203: note = Description of Artificial Sequence: Synthetic polynucleotide
  source 1..203: mol_type = other DNA

SEQ ID NO: 16012 - DNA, 3238 bp, synthetic construct; identical to SEQ ID NO: 14793
  misc_feature 1..3238: note = Description of Artificial Sequence: Synthetic polynucleotide
  source 1..3238: mol_type = other DNA

SEQ ID NO: 16013 - DNA, 201 bp, synthetic construct; identical to SEQ ID NO: 14804
  misc_feature 1..201: note = Description of Artificial Sequence: Synthetic polynucleotide
  source 1..201: mol_type = other DNA

SEQ ID NO: 16014 - DNA, 208 bp, synthetic construct; identical to SEQ ID NO: 14805
  misc_feature 1..208: note = Description of Artificial Sequence: Synthetic polynucleotide
  source 1..208: mol_type = other DNA

SEQ ID NO: 16015 - DNA, 235 bp, synthetic construct; identical to SEQ ID NO: 14816
  misc_feature 1..235: note = Description of Artificial Sequence: Synthetic polynucleotide
  source 1..235: mol_type = other DNA

SEQ ID NO: 16016 - DNA, 207 bp, synthetic construct; identical to SEQ ID NO: 14827
  misc_feature 1..207: note = Description of Artificial Sequence: Synthetic polynucleotide
  source 1..207: mol_type = other DNA

SEQ ID NO: 16017 - DNA, 380 bp, synthetic construct; identical to SEQ ID NO: 14838
  misc_feature 1..380: note = Description of Artificial Sequence: Synthetic polynucleotide
  source 1..380: mol_type = other DNA

SEQ ID NO: 16018 - DNA, 568 bp, synthetic construct; identical to SEQ ID NO: 14849
  misc_feature 1..568: note = Description of Artificial Sequence: Synthetic polynucleotide
  source 1..568: mol_type = other DNA

SEQ ID NO: 16019 - DNA, 201 bp, synthetic construct; identical to SEQ ID NO: 14860
  misc_feature 1..201: note = Description of Artificial Sequence: Synthetic polynucleotide
  source 1..201: mol_type = other DNA

SEQ ID NO: 16020 - DNA, 234 bp, synthetic construct; identical to SEQ ID NO: 14871
  misc_feature 1..234: note = Description of Artificial Sequence: Synthetic polynucleotide
  source 1..234: mol_type = other DNA

SEQ ID NO: 16021 - DNA, 686 bp, synthetic construct; identical to SEQ ID NO: 14882
  misc_feature 1..686: note = Description of Artificial Sequence: Synthetic polynucleotide
  source 1..686: mol_type = other DNA

SEQ ID NO: 16022 - DNA, 227 bp, synthetic construct; identical to SEQ ID NO: 14893
  misc_feature 1..227: note = Description of Artificial Sequence: Synthetic polynucleotide
  source 1..227: mol_type = other DNA

SEQ ID NO: 16023 - DNA, 201 bp, synthetic construct; identical to SEQ ID NO: 14904
  misc_feature 1..201: note = Description of Artificial Sequence: Synthetic polynucleotide
  source 1..201: mol_type = other DNA

SEQ ID NO: 16024 - DNA, 217 bp, synthetic construct; identical to SEQ ID NO: 14915
  misc_feature 1..217: note = Description of Artificial Sequence: Synthetic polynucleotide
  source 1..217: mol_type = other DNA

SEQ ID NO: 16025 - DNA, 217 bp, synthetic construct; identical to SEQ ID NO: 14916
  misc_feature 1..217: note = Description of Artificial Sequence: Synthetic polynucleotide
  source 1..217: mol_type = other DNA

SEQ ID NO: 16026 - DNA, 286 bp, synthetic construct; identical to SEQ ID NO: 14927
  misc_feature 1..286: note = Description of Artificial Sequence: Synthetic polynucleotide
  source 1..286: mol_type = other DNA

SEQ ID NO: 16027 - DNA, 210 bp, synthetic construct; identical to SEQ ID NO: 14938
  misc_feature 1..210: note = Description of Artificial Sequence: Synthetic polynucleotide
  source 1..210: mol_type = other DNA

SEQ ID NO: 16028 - DNA, 201 bp, synthetic construct; identical to SEQ ID NO: 14949
  misc_feature 1..201: note = Description of Artificial Sequence: Synthetic polynucleotide
  source 1..201: mol_type = other DNA

SEQ ID NO: 16029 - DNA, 366 bp, synthetic construct; identical to SEQ ID NO: 14958
  misc_feature 1..366: note = Description of Artificial Sequence: Synthetic polynucleotide
  source 1..366: mol_type = other DNA

SEQ ID NO: 16030 - DNA, 201 bp, synthetic construct; identical to SEQ ID NO: 14959
  misc_feature 1..201: note = Description of Artificial Sequence: Synthetic polynucleotide
  source 1..201: mol_type = other DNA

SEQ ID NO: 16031 - DNA, 201 bp, synthetic construct; identical to SEQ ID NO: 14960
  misc_feature 1..201: note = Description of Artificial Sequence: Synthetic polynucleotide
  source 1..201: mol_type = other DNA

SEQ ID NO: 16032 - DNA, 201 bp, synthetic construct; identical to SEQ ID NO: 14961
  misc_feature 1..201: note = Description of Artificial Sequence: Synthetic polynucleotide
  source 1..201: mol_type = other DNA

SEQ ID NO: 16033 - DNA, 384 bp, synthetic construct; identical to SEQ ID NO: 14962
  misc_feature 1..384: note = Description of Artificial Sequence: Synthetic polynucleotide
  source 1..384: mol_type = other DNA

SEQ ID NO: 16034 - DNA, 216 bp, synthetic construct; identical to SEQ ID NO: 14963
  misc_feature 1..216: note = Description of Artificial Sequence: Synthetic polynucleotide
  source 1..216: mol_type = other DNA

SEQ ID NO: 16035 - DNA, 334 bp, synthetic construct; identical to SEQ ID NO: 14964
  misc_feature 1..334: note = Description of Artificial Sequence: Synthetic polynucleotide
  source 1..334: mol_type = other DNA

SEQ ID NO: 16036 - DNA, 201 bp, synthetic construct; identical to SEQ ID NO: 14965
  misc_feature 1..201: note = Description of Artificial Sequence: Synthetic polynucleotide
  source 1..201: mol_type = other DNA

SEQ ID NO: 16037 - DNA, 270 bp, synthetic construct; identical to SEQ ID NO: 14966
  misc_feature 1..270: note = Description of Artificial Sequence: Synthetic polynucleotide
  source 1..270: mol_type = other DNA

SEQ ID NO: 16038 - DNA, 253 bp, synthetic construct; identical to SEQ ID NO: 14967
  misc_feature 1..253: note = Description of Artificial Sequence: Synthetic polynucleotide
  source 1..253: mol_type = other DNA

SEQ ID NO: 16039 - DNA, 204 bp, synthetic construct; identical to SEQ ID NO: 14968
  misc_feature 1..204: note = Description of Artificial Sequence: Synthetic polynucleotide
  source 1..204: mol_type = other DNA

SEQ ID NO: 16040 - DNA, 228 bp, synthetic construct; identical to SEQ ID NO: 14969
  misc_feature 1..228: note = Description of Artificial Sequence: Synthetic polynucleotide
  source 1..228: mol_type = other DNA

SEQ ID NO: 16041 - DNA, 217 bp, synthetic construct; identical to SEQ ID NO: 14970
  misc_feature 1..217: note = Description of Artificial Sequence: Synthetic polynucleotide
  source 1..217: mol_type = other DNA

SEQ ID NO: 16042 - DNA, 201 bp, synthetic construct; identical to SEQ ID NO: 14971
  misc_feature 1..201: note = Description of Artificial Sequence: Synthetic polynucleotide
  source 1..201: mol_type = other DNA

SEQ ID NO: 16043 - DNA, 204 bp, synthetic construct; identical to SEQ ID NO: 14972
  misc_feature 1..204: note = Description of Artificial Sequence: Synthetic polynucleotide
  source 1..204: mol_type = other DNA

SEQ ID NO: 16044 - DNA, 223 bp, synthetic construct; identical to SEQ ID NO: 14973
  misc_feature 1..223: note = Description of Artificial Sequence: Synthetic polynucleotide
  source 1..223: mol_type = other DNA

SEQ ID NO: 16045 - DNA, 201 bp, synthetic construct; identical to SEQ ID NO: 14974
  misc_feature 1..201: note = Description of Artificial Sequence: Synthetic polynucleotide
  source 1..201: mol_type = other DNA

SEQ ID NO: 16046 - DNA, 203 bp, synthetic construct; identical to SEQ ID NO: 14975
  misc_feature 1..203: note = Description of Artificial Sequence: Synthetic polynucleotide
  source 1..203: mol_type = other DNA

SEQ ID NO: 16047 - DNA, 201 bp, synthetic construct; identical to SEQ ID NO: 14976
  misc_feature 1..201: note = Description of Artificial Sequence: Synthetic polynucleotide
  source 1..201: mol_type = other DNA

SEQ ID NO: 16048 - DNA, 211 bp, synthetic construct; identical to SEQ ID NO: 14986
  misc_feature 1..211: note = Description of Artificial Sequence: Synthetic polynucleotide
  source 1..211: mol_type = other DNA

SEQ ID NO: 16049 - DNA, 201 bp, synthetic construct; identical to SEQ ID NO: 14997
  misc_feature 1..201: note = Description of Artificial Sequence: Synthetic polynucleotide
  source 1..201: mol_type = other DNA

SEQ ID NO: 16050 - DNA, 279 bp, synthetic construct; identical to SEQ ID NO: 15008
  misc_feature 1..279: note = Description of Artificial Sequence: Synthetic polynucleotide
  source 1..279: mol_type = other DNA

SEQ ID NO: 16051 - DNA, 203 bp, synthetic construct; identical to SEQ ID NO: 15019
  misc_feature 1..203: note = Description of Artificial Sequence: Synthetic polynucleotide
  source 1..203: mol_type = other DNA

SEQ ID NO: 16052 - DNA, 3238 bp, synthetic construct; identical to SEQ ID NO: 15030
  misc_feature 1..3238: note = Description of Artificial Sequence: Synthetic polynucleotide
  source 1..3238: mol_type = other DNA

SEQ ID NO: 16053 - DNA, 201 bp, synthetic construct; identical to SEQ ID NO: 15041
  misc_feature 1..201: note = Description of Artificial Sequence: Synthetic polynucleotide
  source 1..201: mol_type = other DNA

SEQ ID NO: 16054 - DNA, 208 bp, synthetic construct; identical to SEQ ID NO: 15042
  misc_feature 1..208: note = Description of Artificial Sequence: Synthetic polynucleotide
  source 1..208: mol_type = other DNA

SEQ ID NO: 16055 - DNA, 235 bp, synthetic construct; identical to SEQ ID NO: 15053
  misc_feature 1..235: note = Description of Artificial Sequence: Synthetic polynucleotide
  source 1..235: mol_type = other DNA

SEQ ID NO: 16056 - DNA, 207 bp, synthetic construct; identical to SEQ ID NO: 15064
  misc_feature 1..207: note = Description of Artificial Sequence: Synthetic polynucleotide
  source 1..207: mol_type = other DNA

SEQ ID NO: 16057 - DNA, 380 bp, synthetic construct; identical to SEQ ID NO: 15075
  misc_feature 1..380: note = Description of Artificial Sequence: Synthetic polynucleotide
  source 1..380: mol_type = other DNA

SEQ ID NO: 16058 - DNA, 568 bp, synthetic construct; identical to SEQ ID NO: 15086
  misc_feature 1..568: note = Description of Artificial Sequence: Synthetic polynucleotide
  source 1..568: mol_type = other DNA

SEQ ID NO: 16059 - DNA, 201 bp, synthetic construct; identical to SEQ ID NO: 15097
  misc_feature 1..201: note = Description of Artificial Sequence: Synthetic polynucleotide
  source 1..201: mol_type = other DNA

SEQ ID NO: 16060 - DNA, 234 bp, synthetic construct; identical to SEQ ID NO: 15108
  misc_feature 1..234: note = Description of Artificial Sequence: Synthetic polynucleotide
  source 1..234: mol_type = other DNA

SEQ ID NO: 16061 - DNA, 686 bp, synthetic construct; identical to SEQ ID NO: 15119
  misc_feature 1..686: note = Description of Artificial Sequence: Synthetic polynucleotide
  source 1..686: mol_type = other DNA

SEQ ID NO: 16062 - DNA, 227 bp, synthetic construct; identical to SEQ ID NO: 15130
  misc_feature 1..227: note = Description of Artificial Sequence: Synthetic polynucleotide
  source 1..227: mol_type = other DNA

SEQ ID NO: 16063 - DNA, 201 bp, synthetic construct; identical to SEQ ID NO: 15141
  misc_feature 1..201: note = Description of Artificial Sequence: Synthetic polynucleotide
  source 1..201: mol_type = other DNA

SEQ ID NO: 16064 - DNA, 217 bp, synthetic construct; identical to SEQ ID NO: 15152
  misc_feature 1..217: note = Description of Artificial Sequence: Synthetic polynucleotide
  source 1..217: mol_type = other DNA

SEQ ID NO: 16065 - DNA, 217 bp, synthetic construct; identical to SEQ ID NO: 15153
  misc_feature 1..217: note = Description of Artificial Sequence: Synthetic polynucleotide
  source 1..217: mol_type = other DNA

SEQ ID NO: 16066 - DNA, 286 bp, synthetic construct; identical to SEQ ID NO: 15164
  misc_feature 1..286: note = Description of Artificial Sequence: Synthetic polynucleotide
  source 1..286: mol_type = other DNA

SEQ ID NO: 16067 - DNA, 210 bp, synthetic construct; identical to SEQ ID NO: 15175
  misc_feature 1..210: note = Description of Artificial Sequence: Synthetic polynucleotide
  source 1..210: mol_type = other DNA

SEQ ID NO: 16068 - DNA, 201 bp, synthetic construct; identical to SEQ ID NO: 15186
  misc_feature 1..201: note = Description of Artificial Sequence: Synthetic polynucleotide
  source 1..201: mol_type = other DNA

SEQ ID NO: 16069 - DNA, 366 bp, synthetic construct; identical to SEQ ID NO: 15195
  misc_feature 1..366: note = Description of Artificial Sequence: Synthetic polynucleotide
  source 1..366: mol_type = other DNA

SEQ ID NO: 16070 - DNA, 201 bp, synthetic construct; identical to SEQ ID NO: 15196
  misc_feature 1..201: note = Description of Artificial Sequence: Synthetic polynucleotide
  source 1..201: mol_type = other DNA

SEQ ID NO: 16071 - DNA, 201 bp, synthetic construct; identical to SEQ ID NO: 15197
  misc_feature 1..201: note = Description of Artificial Sequence: Synthetic polynucleotide
  source 1..201: mol_type = other DNA

SEQ ID NO: 16072 - DNA, 201 bp, synthetic construct; identical to SEQ ID NO: 15198
  misc_feature 1..201: note = Description of Artificial Sequence: Synthetic polynucleotide
  source 1..201: mol_type = other DNA

SEQ ID NO: 16073 - DNA, 384 bp, synthetic construct; identical to SEQ ID NO: 15199
  misc_feature 1..384: note = Description of Artificial Sequence: Synthetic polynucleotide
  source 1..384: mol_type = other DNA

SEQ ID NO: 16074 - DNA, 216 bp, synthetic construct; identical to SEQ ID NO: 15200
  misc_feature 1..216: note = Description of Artificial Sequence: Synthetic polynucleotide
  source 1..216: mol_type = other DNA

SEQ ID NO: 16075 - DNA, 334 bp, synthetic construct; identical to SEQ ID NO: 15201
  misc_feature 1..334: note = Description of Artificial Sequence: Synthetic polynucleotide
  source 1..334: mol_type = other DNA

SEQ ID NO: 16076 - DNA, 201 bp, synthetic construct; identical to SEQ ID NO: 15202
  misc_feature 1..201: note = Description of Artificial Sequence: Synthetic polynucleotide
  source 1..201: mol_type = other DNA

SEQ ID NO: 16077 - DNA, 270 bp, synthetic construct; identical to SEQ ID NO: 15203
  misc_feature 1..270: note = Description of Artificial Sequence: Synthetic polynucleotide
  source 1..270: mol_type = other DNA

SEQ ID NO: 16078 - DNA, 253 bp, synthetic construct; identical to SEQ ID NO: 15204
  misc_feature 1..253: note = Description of Artificial Sequence: Synthetic polynucleotide
  source 1..253: mol_type = other DNA

SEQ ID NO: 16079 - DNA, 204 bp, synthetic construct; identical to SEQ ID NO: 15205
  misc_feature 1..204: note = Description of Artificial Sequence: Synthetic polynucleotide
  source 1..204: mol_type = other DNA

SEQ ID NO: 16080 - DNA, 228 bp, synthetic construct; identical to SEQ ID NO: 15206
  misc_feature 1..228: note = Description of Artificial Sequence: Synthetic polynucleotide
  source 1..228: mol_type = other DNA

SEQ ID NO: 16081 - DNA, 217 bp, synthetic construct; identical to SEQ ID NO: 15207
  misc_feature 1..217: note = Description of Artificial Sequence: Synthetic polynucleotide
  source 1..217: mol_type = other DNA

SEQ ID NO: 16082 - DNA, 201 bp, synthetic construct; identical to SEQ ID NO: 15208
  misc_feature 1..201: note = Description of Artificial Sequence: Synthetic polynucleotide
  source 1..201: mol_type = other DNA

SEQ ID NO: 16083 - DNA, 204 bp, synthetic construct; identical to SEQ ID NO: 15209
  misc_feature 1..204: note = Description of Artificial Sequence: Synthetic polynucleotide
  source 1..204: mol_type = other DNA

SEQ ID NO: 16084 - DNA, 223 bp, synthetic construct; identical to SEQ ID NO: 15210
  misc_feature 1..223: note = Description of Artificial Sequence: Synthetic polynucleotide
  source 1..223: mol_type = other DNA

SEQ ID NO: 16085 - DNA, 201 bp, synthetic construct; identical to SEQ ID NO: 15211
  misc_feature 1..201: note = Description of Artificial Sequence: Synthetic polynucleotide
  source 1..201: mol_type = other DNA

SEQ ID NO: 16086 - DNA, 203 bp, synthetic construct; identical to SEQ ID NO: 15212
  misc_feature 1..203: note = Description of Artificial Sequence: Synthetic polynucleotide
  source 1..203: mol_type = other DNA

SEQ ID NO: 16087 - DNA, 201 bp, synthetic construct; identical to SEQ ID NO: 15213
  misc_feature 1..201: note = Description of Artificial Sequence: Synthetic polynucleotide
  source 1..201: mol_type = other DNA

SEQ ID NO: 16088 - DNA, 211 bp, synthetic construct; identical to SEQ ID NO: 15223
  misc_feature 1..211: note = Description of Artificial Sequence: Synthetic polynucleotide
  source 1..211: mol_type = other DNA

SEQ ID NO: 16089 - DNA, 201 bp, synthetic construct; identical to SEQ ID NO: 15234
  misc_feature 1..201: note = Description of Artificial Sequence: Synthetic polynucleotide
  source 1..201: mol_type = other DNA

SEQ ID NO: 16090 - DNA, 279 bp, synthetic construct; identical to SEQ ID NO: 15245
  misc_feature 1..279: note = Description of Artificial Sequence: Synthetic polynucleotide
  source 1..279: mol_type = other DNA

SEQ ID NO: 16091 - DNA, 203 bp, synthetic construct; identical to SEQ ID NO: 15256
  misc_feature 1..203: note = Description of Artificial Sequence: Synthetic polynucleotide
  source 1..203: mol_type = other DNA

SEQ ID NO: 16092 - DNA, 3238 bp, synthetic construct; identical to SEQ ID NO: 15267
  misc_feature 1..3238: note = Description of Artificial Sequence: Synthetic polynucleotide
  source 1..3238: mol_type = other DNA

SEQ ID NO: 16093 - DNA, 201 bp, synthetic construct; identical to SEQ ID NO: 15278
  misc_feature 1..201: note = Description of Artificial Sequence: Synthetic polynucleotide
  source 1..201: mol_type = other DNA

SEQ ID NO: 16094 - DNA, 208 bp, synthetic construct; identical to SEQ ID NO: 15279
  misc_feature 1..208: note = Description of Artificial Sequence: Synthetic polynucleotide
  source 1..208: mol_type = other DNA

SEQ ID NO: 16095 - DNA, 235 bp, synthetic construct; identical to SEQ ID NO: 15290
  misc_feature 1..235: note = Description of Artificial Sequence: Synthetic polynucleotide
  source 1..235: mol_type = other DNA

SEQ ID NO: 16096 - DNA, 207 bp, synthetic construct; identical to SEQ ID NO: 15301
  misc_feature 1..207: note = Description of Artificial Sequence: Synthetic polynucleotide
  source 1..207: mol_type = other DNA

SEQ ID NO: 16097 - DNA, 380 bp, synthetic construct; identical to SEQ ID NO: 15312
  misc_feature 1..380: note = Description of Artificial Sequence: Synthetic polynucleotide
  source 1..380: mol_type = other DNA

SEQ ID NO: 16098 - DNA, 568 bp, synthetic construct; identical to SEQ ID NO: 15323
  misc_feature 1..568: note = Description of Artificial Sequence: Synthetic polynucleotide
  source 1..568: mol_type = other DNA

SEQ ID NO: 16099 - DNA, 201 bp, synthetic construct; identical to SEQ ID NO: 15334
  misc_feature 1..201: note = Description of Artificial Sequence: Synthetic polynucleotide
  source 1..201: mol_type = other DNA

SEQ ID NO: 16100 - DNA, 234 bp, synthetic construct; identical to SEQ ID NO: 15345
  misc_feature 1..234: note = Description of Artificial Sequence: Synthetic polynucleotide
  source 1..234: mol_type = other DNA

SEQ ID NO: 16101 - DNA, 686 bp, synthetic construct; identical to SEQ ID NO: 15356
  misc_feature 1..686: note = Description of Artificial Sequence: Synthetic polynucleotide
  source 1..686: mol_type = other DNA

SEQ ID NO: 16102 - DNA, 227 bp, synthetic construct; identical to SEQ ID NO: 15367
  misc_feature 1..227: note = Description of Artificial Sequence: Synthetic polynucleotide
  source 1..227: mol_type = other DNA

SEQ ID NO: 16103 - DNA, 201 bp, synthetic construct; identical to SEQ ID NO: 15378
  misc_feature 1..201: note = Description of Artificial Sequence: Synthetic polynucleotide
  source 1..201: mol_type = other DNA

SEQ ID NO: 16104 - DNA, 217 bp, synthetic construct; identical to SEQ ID NO: 15389
  misc_feature 1..217: note = Description of Artificial Sequence: Synthetic polynucleotide
  source 1..217: mol_type = other DNA

SEQ ID NO: 16105 - DNA, 217 bp, synthetic construct; identical to SEQ ID NO: 15390
  misc_feature 1..217: note = Description of Artificial Sequence: Synthetic polynucleotide
  source 1..217: mol_type = other DNA

SEQ ID NO: 16106 - DNA, 286 bp, synthetic construct; identical to SEQ ID NO: 15401
  misc_feature 1..286: note = Description of Artificial Sequence: Synthetic polynucleotide
  source 1..286: mol_type = other DNA

SEQ ID NO: 16107 - DNA, 210 bp, synthetic construct; identical to SEQ ID NO: 15412
  misc_feature 1..210: note = Description of Artificial Sequence: Synthetic polynucleotide
  source 1..210: mol_type = other DNA

SEQ ID NO: 16108 - DNA, 201 bp, synthetic construct; identical to SEQ ID NO: 15423
  misc_feature 1..201: note = Description of Artificial Sequence: Synthetic polynucleotide
  source 1..201: mol_type = other DNA

SEQ ID NO: 16109 - DNA, 366 bp, synthetic construct; identical to SEQ ID NO: 15432
  misc_feature 1..366: note = Description of Artificial Sequence: Synthetic polynucleotide
  source 1..366: mol_type = other DNA

SEQ ID NO: 16110 - DNA, 201 bp, synthetic construct; identical to SEQ ID NO: 15433
  misc_feature 1..201: note = Description of Artificial Sequence: Synthetic polynucleotide
  source 1..201: mol_type = other DNA

SEQ ID NO: 16111 - DNA, 201 bp, synthetic construct; identical to SEQ ID NO: 15434
  misc_feature 1..201: note = Description of Artificial Sequence: Synthetic polynucleotide
  source 1..201: mol_type = other DNA

SEQ ID NO: 16112 - DNA, 201 bp, synthetic construct; identical to SEQ ID NO: 15435
  misc_feature 1..201: note = Description of Artificial Sequence: Synthetic polynucleotide
  source 1..201: mol_type = other DNA

SEQ ID NO: 16113 - DNA, 384 bp, synthetic construct; identical to SEQ ID NO: 15436
  misc_feature 1..384: note = Description of Artificial Sequence: Synthetic polynucleotide
  source 1..384: mol_type = other DNA

SEQ ID NO: 16114 - DNA, 216 bp, synthetic construct; identical to SEQ ID NO: 15437
  misc_feature 1..216: note = Description of Artificial Sequence: Synthetic polynucleotide
  source 1..216: mol_type = other DNA

SEQ ID NO: 16115 - DNA, 334 bp, synthetic construct; identical to SEQ ID NO: 15438
  misc_feature 1..334: note = Description of Artificial Sequence: Synthetic polynucleotide
  source 1..334: mol_type = other DNA

SEQ ID NO: 16116 - DNA, 201 bp, synthetic construct; identical to SEQ ID NO: 15439
  misc_feature 1..201: note = Description of Artificial Sequence: Synthetic polynucleotide
  source 1..201: mol_type = other DNA

SEQ ID NO: 16117 - DNA, 270 bp, synthetic construct; identical to SEQ ID NO: 15440
  misc_feature 1..270: note = Description of Artificial Sequence: Synthetic polynucleotide
  source 1..270: mol_type = other DNA

SEQ ID NO: 16118 - DNA, 253 bp, synthetic construct; identical to SEQ ID NO: 15441
  misc_feature 1..253: note = Description of Artificial Sequence: Synthetic polynucleotide
  source 1..253: mol_type = other DNA

SEQ ID NO: 16119 - DNA, 204 bp, synthetic construct; identical to SEQ ID NO: 15442
  misc_feature 1..204: note = Description of Artificial Sequence: Synthetic polynucleotide
  source 1..204: mol_type = other DNA

SEQ ID NO: 16120 - DNA, 228 bp, synthetic construct; identical to SEQ ID NO: 15443
  misc_feature 1..228: note = Description of Artificial Sequence: Synthetic polynucleotide
  source 1..228: mol_type = other DNA

SEQ ID NO: 16121 - DNA, 217 bp, synthetic construct; identical to SEQ ID NO: 15444
  misc_feature 1..217: note = Description of Artificial Sequence: Synthetic polynucleotide
  source 1..217: mol_type = other DNA

SEQ ID NO: 16122 - DNA, 201 bp, synthetic construct; identical to SEQ ID NO: 15445
  misc_feature 1..201: note = Description of Artificial Sequence: Synthetic polynucleotide
  source 1..201: mol_type = other DNA

SEQ ID NO: 16123 - DNA, 204 bp, synthetic construct; identical to SEQ ID NO: 15446
  misc_feature 1..204: note = Description of Artificial Sequence: Synthetic polynucleotide
  source 1..204: mol_type = other DNA

SEQ ID NO: 16124 - DNA, 223 bp, synthetic construct; identical to SEQ ID NO: 15447
  misc_feature 1..223: note = Description of Artificial Sequence: Synthetic polynucleotide
  source 1..223: mol_type = other DNA

SEQ ID NO: 16125 - DNA, 201 bp, synthetic construct; identical to SEQ ID NO: 15448
  misc_feature 1..201: note = Description of Artificial Sequence: Synthetic polynucleotide
  source 1..201: mol_type = other DNA

SEQ ID NO: 16126 - DNA, 203 bp, synthetic construct; identical to SEQ ID NO: 15449
  misc_feature 1..203: note = Description of Artificial Sequence: Synthetic polynucleotide
  source 1..203: mol_type = other DNA

SEQ ID NO: 16127 - DNA, 201 bp, synthetic construct; identical to SEQ ID NO: 15450
  misc_feature 1..201: note = Description of Artificial Sequence: Synthetic polynucleotide
  source 1..201: mol_type = other DNA

SEQ ID NO: 16128 - DNA, 211 bp, synthetic construct; identical to SEQ ID NO: 15460
  misc_feature 1..211: note = Description of Artificial Sequence: Synthetic polynucleotide
  source 1..211: mol_type = other DNA

SEQ ID NO: 16129 - DNA, 201 bp, synthetic construct; identical to SEQ ID NO: 15471
  misc_feature 1..201: note = Description of Artificial Sequence: Synthetic polynucleotide
  source 1..201: mol_type = other DNA

SEQ ID NO: 16130 - DNA, 279 bp, synthetic construct; identical to SEQ ID NO: 15482
  misc_feature 1..279: note = Description of Artificial Sequence: Synthetic polynucleotide
  source 1..279: mol_type = other DNA

SEQ ID NO: 16131 - DNA, 203 bp, synthetic construct; identical to SEQ ID NO: 15493
  misc_feature 1..203: note = Description of Artificial Sequence: Synthetic polynucleotide
  source 1..203: mol_type = other DNA

SEQ ID NO: 16132 - DNA, 3238 bp, synthetic construct; identical to SEQ ID NO: 15504
  misc_feature 1..3238: note = Description of Artificial Sequence: Synthetic polynucleotide
  source 1..3238: mol_type = other DNA

SEQ ID NO: 16133 - DNA, 223 bp, Homo sapiens; identical to SEQ ID NO: 15522
  source 1..223: mol_type = unassigned DNA

SEQ ID NO: 16134 - DNA, 676 bp, Homo sapiens; identical to SEQ ID NO: 15528
  source 1..676: mol_type = unassigned DNA

SEQ ID NO: 16135 - DNA, 1238 bp, Homo sapiens; identical to SEQ ID NO: 15529
  source 1..1238: mol_type = unassigned DNA

SEQ ID NO: 16136 - DNA, 220 bp, Homo sapiens; identical to SEQ ID NO: 15530
  source 1..220: mol_type = unassigned DNA

SEQ ID NO: 16137 - DNA, 631 bp, Homo sapiens; identical to SEQ ID NO: 15531
  source 1..631: mol_type = unassigned DNA

SEQ ID NO: 16138 - DNA, 223 bp, Homo sapiens; identical to SEQ ID NO: 15545
  source 1..223: mol_type = unassigned DNA

SEQ ID NO: 16139 - DNA, 676 bp, Homo sapiens; identical to SEQ ID NO: 15551
  source 1..676: mol_type = unassigned DNA

SEQ ID NO: 16140 - DNA, 1238 bp, Homo sapiens; identical to SEQ ID NO: 15552
  source 1..1238: mol_type = unassigned DNA

SEQ ID NO: 16141 - DNA, 220 bp, Homo sapiens; identical to SEQ ID NO: 15553
  source 1..220: mol_type = unassigned DNA

SEQ ID NO: 16142 - DNA, 631 bp, Homo sapiens; identical to SEQ ID NO: 15554
  source 1..631: mol_type = unassigned DNA

SEQ ID NO: 16143 - DNA, 223 bp, synthetic construct; identical to SEQ ID NO: 15568
  misc_feature 1..223: note = Description of Artificial Sequence: Synthetic polynucleotide
  source 1..223: mol_type = other DNA

SEQ ID NO: 16144 - DNA, 676 bp, synthetic construct; identical to SEQ ID NO: 15574
  misc_feature 1..676: note = Description of Artificial Sequence: Synthetic polynucleotide
  source 1..676: mol_type = other DNA

SEQ ID NO: 16145 - DNA, 1238 bp, synthetic construct; identical to SEQ ID NO: 15575
  misc_feature 1..1238: note = Description of Artificial Sequence: Synthetic polynucleotide
  source 1..1238: mol_type = other DNA

SEQ ID NO: 16146 - DNA, 220 bp, synthetic construct; identical to SEQ ID NO: 15576
  misc_feature 1..220: note = Description of Artificial Sequence: Synthetic polynucleotide
  source 1..220: mol_type = other DNA

SEQ ID NO: 16147 - DNA, 631 bp, synthetic construct; identical to SEQ ID NO: 15577
  misc_feature 1..631: note = Description of Artificial Sequence: Synthetic polynucleotide
  source 1..631: mol_type = other DNA

SEQ ID NO: 16148 - DNA, 223 bp, synthetic construct; identical to SEQ ID NO: 15591
  misc_feature 1..223: note = Description of Artificial Sequence: Synthetic polynucleotide
  source 1..223: mol_type = other DNA

SEQ ID NO: 16149 - DNA, 676 bp, synthetic construct; identical to SEQ ID NO: 15597
  misc_feature 1..676: note = Description of Artificial Sequence: Synthetic polynucleotide
  source 1..676: mol_type = other DNA

SEQ ID NO: 16150 - DNA, 1238 bp, synthetic construct; identical to SEQ ID NO: 15598
  misc_feature 1..1238: note = Description of Artificial Sequence: Synthetic polynucleotide
  source 1..1238: mol_type = other DNA

SEQ ID NO: 16151 - DNA, 220 bp, synthetic construct; identical to SEQ ID NO: 15599
  misc_feature 1..220: note = Description of Artificial Sequence: Synthetic polynucleotide
  source 1..220: mol_type = other DNA

SEQ ID NO: 16152 - DNA, 631 bp, synthetic construct; identical to SEQ ID NO: 15600
  misc_feature 1..631: note = Description of Artificial Sequence: Synthetic polynucleotide
  source 1..631: mol_type = other DNA

SEQ ID NO: 16153 - DNA, 223 bp, synthetic construct; identical to SEQ ID NO: 15614
  misc_feature 1..223: note = Description of Artificial Sequence: Synthetic polynucleotide
  source 1..223: mol_type = other DNA

SEQ ID NO: 16154 - DNA, 676 bp, synthetic construct; identical to SEQ ID NO: 15620
  misc_feature 1..676: note = Description of Artificial Sequence: Synthetic polynucleotide
  source 1..676: mol_type = other DNA

SEQ ID NO: 16155 - DNA, 1238 bp, synthetic construct; identical to SEQ ID NO: 15621
  misc_feature 1..1238: note = Description of Artificial Sequence: Synthetic polynucleotide
  source 1..1238: mol_type = other DNA

SEQ ID NO: 16156 - DNA, 220 bp, synthetic construct; identical to SEQ ID NO: 15622
  misc_feature 1..220: note = Description of Artificial Sequence: Synthetic polynucleotide
  source 1..220: mol_type = other DNA

SEQ ID NO: 16157 - DNA, 631 bp, synthetic construct; identical to SEQ ID NO: 15623
  misc_feature 1..631: note = Description of Artificial Sequence: Synthetic polynucleotide
  source 1..631: mol_type = other DNA

SEQ ID NO: 16158 - DNA, 223 bp, synthetic construct; identical to SEQ ID NO: 15637
  misc_feature 1..223: note = Description of Artificial Sequence: Synthetic polynucleotide
  source 1..223: mol_type = other DNA

SEQ ID NO: 16159 - DNA, 676 bp, synthetic construct; identical to SEQ ID NO: 15643
  misc_feature 1..676: note = Description of Artificial Sequence: Synthetic polynucleotide
  source 1..676: mol_type = other DNA

SEQ ID NO: 16160 - DNA, 1238 bp, synthetic construct; identical to SEQ ID NO: 15644
  misc_feature 1..1238: note = Description of Artificial Sequence: Synthetic polynucleotide
  source 1..1238: mol_type = other DNA

SEQ ID NO: 16161 - DNA, 220 bp, synthetic construct; identical to SEQ ID NO: 15645
  misc_feature 1..220: note = Description of Artificial Sequence: Synthetic polynucleotide
  source 1..220: mol_type = other DNA

SEQ ID NO: 16162 - DNA, 631 bp, synthetic construct; identical to SEQ ID NO: 15646
  misc_feature 1..631: note = Description of Artificial Sequence: Synthetic polynucleotide
  source 1..631: mol_type = other DNA

SEQ ID NO: 16163-16164 - skipped (2 entries)

SEQ ID NO: 16165 - DNA, 24 bp, Homo sapiens
  source 1..24: mol_type = unassigned DNA
cgaagcgcctcctgcgcagactcg

SEQ ID NO: 16166-16167 - skipped (2 entries)

SEQ ID NO: 16168 - DNA, 24 bp, Homo sapiens
  source 1..24: mol_type = unassigned DNA
cgagtctgcgcaggaggcgcttcg

SEQ ID NO: 16169-16170 - skipped (2 entries)

SEQ ID NO: 16171 - DNA, 24 bp, synthetic construct
  misc_feature 1..24: note = Description of Artificial Sequence: Synthetic oligonucleotide
  source 1..24: mol_type = other DNA
ygaagygttttttgygtagattyg

SEQ ID NO: 16172-16173 - skipped (2 entries)

SEQ ID NO: 16174 - DNA, 24 bp, synthetic construct
  misc_feature 1..24: note = Description of Artificial Sequence: Synthetic oligonucleotide
  source 1..24: mol_type = other DNA
tgaagtgttttttgtgtagatttg

SEQ ID NO: 16175-16176 - skipped (2 entries)

SEQ ID NO: 16177 - DNA, 24 bp, synthetic construct
  misc_feature 1..24: note = Description of Artificial Sequence: Synthetic oligonucleotide
  source 1..24: mol_type = other DNA
ygagtttgygtaggaggygtttyg

SEQ ID NO: 16178-16179 - skipped (2 entries)

SEQ ID NO: 16180 - DNA, 24 bp, synthetic construct
  misc_feature 1..24: note = Description of Artificial Sequence: Synthetic oligonucleotide
  source 1..24: mol_type = other DNA
tgagtttgtgtaggaggtgttttg

SEQ ID NO: 16181 - DNA, 201 bp, Homo sapiens; identical to SEQ ID NO: 14260
  source 1..201: mol_type = unassigned DNA

SEQ ID NO: 16182 - DNA, 204 bp, Homo sapiens; identical to SEQ ID NO: 14261
  source 1..204: mol_type = unassigned DNA

SEQ ID NO: 16183 - DNA, 223 bp, Homo sapiens; identical to SEQ ID NO: 14262
  source 1..223: mol_type = unassigned DNA

SEQ ID NO: 16184 - DNA, 201 bp, Homo sapiens; identical to SEQ ID NO: 14497
  source 1..201: mol_type = unassigned DNA

SEQ ID NO: 16185 - DNA, 204 bp, Homo sapiens; identical to SEQ ID NO: 14498
  source 1..204: mol_type = unassigned DNA

SEQ ID NO: 16186 - DNA, 223 bp, Homo sapiens; identical to SEQ ID NO: 14499
  source 1..223: mol_type = unassigned DNA

SEQ ID NO: 16187 - DNA, 201 bp, synthetic construct; identical to SEQ ID NO: 14734
  misc_feature 1..201: note = Description of Artificial Sequence: Synthetic polynucleotide
  source 1..201: mol_type = other DNA

SEQ ID NO: 16188 - DNA, 204 bp, synthetic construct; identical to SEQ ID NO: 14735
  misc_feature 1..204: note = Description of Artificial Sequence: Synthetic polynucleotide
  source 1..204: mol_type = other DNA

SEQ ID NO: 16189 - DNA, 223 bp, synthetic construct; identical to SEQ ID NO: 14736
  misc_feature 1..223: note = Description of Artificial Sequence: Synthetic polynucleotide
  source 1..223: mol_type = other DNA

SEQ ID NO: 16190 - DNA, 201 bp, synthetic construct; identical to SEQ ID NO: 14971
  misc_feature 1..201: note = Description of Artificial Sequence: Synthetic polynucleotide
  source 1..201: mol_type = other DNA

SEQ ID NO: 16191 - DNA, 204 bp, synthetic construct; identical to SEQ ID NO: 14972
  misc_feature 1..204: note = Description of Artificial Sequence: Synthetic polynucleotide
  source 1..204: mol_type = other DNA

SEQ ID NO: 16192 - DNA, 223 bp, synthetic construct; identical to SEQ ID NO: 14973
  misc_feature 1..223: note = Description of Artificial Sequence: Synthetic polynucleotide
  source 1..223: mol_type = other DNA

SEQ ID NO: 16193 - DNA, 201 bp, synthetic construct; identical to SEQ ID NO: 15208
  misc_feature 1..201: note = Description of Artificial Sequence: Synthetic polynucleotide
  source 1..201: mol_type = other DNA

SEQ ID NO: 16194 - DNA, 204 bp, synthetic construct; identical to SEQ ID NO: 15209
  misc_feature 1..204: note = Description of Artificial Sequence: Synthetic polynucleotide
  source 1..204: mol_type = other DNA

SEQ ID NO: 16195 - DNA, 223 bp, synthetic construct; identical to SEQ ID NO: 15210
  misc_feature 1..223: note = Description of Artificial Sequence: Synthetic polynucleotide
  source 1..223: mol_type = other DNA

SEQ ID NO: 16196 - DNA, 201 bp, synthetic construct; identical to SEQ ID NO: 15445
  misc_feature 1..201: note = Description of Artificial Sequence: Synthetic polynucleotide
  source 1..201: mol_type = other DNA

SEQ ID NO: 16197 - DNA, 204 bp, synthetic construct; identical to SEQ ID NO: 15446
  misc_feature 1..204: note = Description of Artificial Sequence: Synthetic polynucleotide
  source 1..204: mol_type = other DNA

SEQ ID NO: 16198 - DNA, 223 bp, synthetic construct; identical to SEQ ID NO: 15447
  misc_feature 1..223: note = Description of Artificial Sequence: Synthetic polynucleotide
  source 1..223: mol_type = other DNA

SEQ ID NO: 16199 - DNA, 631 bp, Homo sapiens; identical to SEQ ID NO: 15531
  source 1..631: mol_type = unassigned DNA

SEQ ID NO: 16200 - DNA, 631 bp, Homo sapiens; identical to SEQ ID NO: 15554
  source 1..631: mol_type = unassigned DNA

SEQ ID NO: 16201 - DNA, 631 bp, synthetic construct; identical to SEQ ID NO: 15577
  misc_feature 1..631: note = Description of Artificial Sequence: Synthetic polynucleotide
  source 1..631: mol_type = other DNA

SEQ ID NO: 16202 - DNA, 631 bp, synthetic construct; identical to SEQ ID NO: 15600
  misc_feature 1..631: note = Description of Artificial Sequence: Synthetic polynucleotide
  source 1..631: mol_type = other DNA

SEQ ID NO: 16203 - DNA, 631 bp, synthetic construct; identical to SEQ ID NO: 15623
  misc_feature 1..631: note = Description of Artificial Sequence: Synthetic polynucleotide
  source 1..631: mol_type = other DNA

SEQ ID NO: 16204 - DNA, 631 bp, synthetic construct; identical to SEQ ID NO: 15646
  misc_feature 1..631: note = Description of Artificial Sequence: Synthetic polynucleotide
  source 1..631: mol_type = other DNA

SEQ ID NO: 16205 - protein, 393 aa, Homo sapiens [sequence omitted]

SEQ ID NO: 16206 - DNA, 2591 bp, Homo sapiens
  source 1..2591: mol_type = unassigned DNA
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 16207 - DNA, 106 bp, synthetic construct
  misc_feature 1..106: note = Description of Artificial Sequence: Synthetic polynucleotide
  source 1..106: mol_type = other DNA
ttygtttttttatygtaggatgttyggyggttygggtatygygagtyggtygagttttagtyggagttaygtgattaygtttattygtatttatagtttgggtagt

SEQ ID NO: 16208 - DNA, 106 bp, synthetic construct
  misc_feature 1..106: note = Description of Artificial Sequence: Synthetic polynucleotide
  source 1..106: mol_type = other DNA
gttgtttaggttgtaggtgygggtggaygtagttaygtagtttyggttggagttyggtyggttygyggtgttygggtygtygaatattttgyggtaggaggaygag

SEQ ID NO: 16209 - DNA, 25 bp, synthetic construct
  misc_feature 1..25: note = Description of Artificial Sequence: Synthetic oligonucleotide
  source 1..25: mol_type = other DNA
ctcrtcctcctaccrcaaaatattc

SEQ ID NO: 16210 - DNA, 23 bp, synthetic construct
  misc_feature 1..23: note = Description of Artificial Sequence: Synthetic oligonucleotide
  source 1..23: mol_type = other DNA
gttgtttaggttgtaggtgyggg

SEQ ID NO: 16211 - DNA, 59 bp, synthetic construct
  misc_feature 1..59: note = Description of Artificial Sequence: Synthetic oligonucleotide
  source 1..59: mol_type = other DNA
tyggyggttygggtatygygagtyggtygagttttagtyggagttaygtgattaygttt

SEQ ID NO: 16212 - DNA, 59 bp, synthetic construct
  misc_feature 1..59: note = Description of Artificial Sequence: Synthetic oligonucleotide
  source 1..59: mol_type = other DNA
ggaygtagttaygtagtttyggttggagttyggtyggttygyggtgttygggtygtyga
